United States Patent 10,724,096 (METHODS AND COMPOSITIONS FOR INHIBITING AND TREATING NEUROLOGICAL CONDITIONS) - sequence listing, part 20

SEQ ID NO: 167 - DNA, 266658 bp, Homo sapiens
ccccaaccaaacacataaatcttttccatgcattttctttgtttcggtttttcctaaaaaatctggagagggaaaggcatcttgaaccatctgaaatgacagagtcagtggagtctttaataataaatatgtgtttattggattcctatgaattaaatgacatattagctatatgggaggatccaaggaaatcgtaagcaaaattgcattctcaccgaatgtgtaatcaaccagggagaaaagacattgatgggaaggataacgagtgatatgaggccttgggcctcttaaggagtagggacaacagaggtgtcagagtccaggcggggatggctcacttcggcaggggtggtcggggcccagcacacccccaagtgcactgaaagatgcgaccatgtagggagaatgaagctggccttcacagttcataattccatccacaggcagcactgagtgcagccacatttcaacattggaactttccagggcgaagaagcactgaacacgtcgcaagagcatggacttcctaggttttcaccaggccacgcgtgagcatggggctgtgggtgtcggtgtgcctcagcactgccacgtccactctgagtgcaggtccggctcagttttggatgttcctccgagagcagtcctccagggccaccgtgggacgaggcacctctttggtaggccatttgcactccagcacggcctctgttcctaaccacaatgggctgctggttcaaggactccctgccacagccaggaggcacagaagaccccatggaggcacttggctggttaagacccgcaggggtcacctgcctaggcttagcctcaatctccttgtagataaaactggaccctaacccttcactgcccagggcccctagggaataaatgtgccatgctgcgtgggatgcccaaggagagttctgtggcatttatttagccacactggttcctctcccctggtttcttttcatcatcaaatggacatgatggaaagctcctttgcggtctttctaggagaggaggcggcacctatattccagatgcagccatttcacaaccaggcgctgcttcctggtcagagccgctcgaccatgaggatattctacagaaagagaactcagctctctccttcctacctcacatgaccctaaggaaagttaagaaaagaggaaaagacctgtgaagatgcctgatcagctgtcagggttacgtagacactggctgctgttatttactgttccctggctgataaaatagccaggtcacctgtgccgatgaccagacccaccccctacccaccagcagggctgccagggctttctggggagacgctgcagcttggttcttatttcctttgctctgcatccctctgggttgacttgagtctgatcatgggtttattccatttccattttgctagattccctccactccctcaagcttctacaaaactgtggggccaccactccccacaaaagattaaaaccaagatgtttcctagaggtggcattttgtcttcctgaagctgttctgtgcacaggtcctctccacactcatgccaaatgctcggtgaagcgtcttcctgaatgtccctaaggggcacgtgccactggcagagctgatgggcacacctcactcccacacatgctgtgccgagctcatgactcagctgtgcagggcccgcccaagagtgaggcaaacaccaacaccgcacagcgaccctttgtcaatggtggggacctcagtggcttctccatcggaacttagggctgacgggcctccagacctactgttacacactggcccacggaatgaccctcataaacccaagaacagtaaacagagcttaacattctaacgaaatcaagattgctgtgtgtgctttcacaaaatgaaactgcctggaacttctcataacgttttttatgataagcattaaaatgcaaagaggaagattaaagttcctgctacagaccagagcagtaatgagtgtgggaggaggagctctgggtagggtctgggagagaggtttatgtactgcattacagttggatattattatataaaatgagtgtgttattaaaaggatcctgaagttataaaaactcaaaggaacttttactgaggatgaataacttctttggtaaagatgaatgactctcacgtcctagacactgaggtgcagtcacgtgccagagctctttaattgctagtagttggatttcgttgtttttgtggggcacttttttgcgggggaaggggcagaaagattaggaatacattctttgattaggaaagttctagtgggtaagagaaagtccctctagttagtaactgagaatcttgattatcctactagaaaaaggcaataagaagacgcatctcctatggccataacagccacctgattttttttgctctacttcttttaattttgtttgtttgtttgttttcagacagactctcattctgttgcccaggctaaagtgcagtggtgcaatcatagctcactgcaggcttgacctcccgggctcaagccatcctcccacctcagcctcccaagtaactgggaccacaggtgtgtgccaccatgcctggctaatttttaaattttttctagagacagggtcttgctatgttgcccaggctggttgttcgacttcttaaacagtacataccacctcatccatttaatgttacaaacacaatgaaatcagtaagtcagaaaactgtagagtgatgtggtgaaaaacattctttttaaatgtagttctacttattttaaatacatttaattaactaaaattataccagaatatggctttgggcttgatctactcaagtaatttatacattttccctataattttgtttgtgtccataaactaggaaatttccatgtaatctgtatcaagacaatcacaaattctaaattagtgaagaccaaagtaatgtttccctttaccatggttggaagtgtacaggatatttggtttattaattttaaaaattatgagagtaatcccgacagtctggaaaacagaaacaaaagatttcatcacacatactaacacaacgattgccaccttacgcattttctagtcctttctcaaagatgcatgttttaagattttaatctacgaattaataatttattgaaacctgctttttactttaagtggtctgagcatttctgtatcttgccatagtctttctgctgatggacaatattccattgagtgagtgtgtacagagtacttaactatacatctttgtgagtatgaactttccgatgtatctgatcatttcttaagggtagattactagaagtggtatcaatgggtcaaggatattaactttttacaactcctgatgcctactgccacactgcttttcaagaggttgctctaatgtacactcccactggggtttgaacaaggcttaaaagtacctgtttcattatatccttgcccaccctgggtattatcattaaaaaccgttttgggcctggcgcagtggctcatgcctataatcccagcactttgggaggccaaggtgggcccatcacgaggtcaggagatcaagaccatcctagccaacatggtgaaaccctgtctctactaaaaatacaaaaattagctgggtgtggtggggtgcacctgtaatcccagctactcaggaggctgaggcaggagaattgcttgaacccaggaggtgaaggttacagtgagctgagatcgtgcgactgcactccagcctggcgatggagtgggaccccatctcaaaacaaacaaacaaacaaacaaaaaaacattttggtgtgtgtgtttgttggctgatgtagagggtgaaaacagccaacaaacacaccaaaatcatggaggattaggaagtgggacctatggtgtttccttggctcttcattcagattgaagacaggaaacaaccacatagacatattctgtatctggctgcctttcccatgatcttacgcttccgtggctcaatggctgcctttcccacgatcttatgcttttgatcatccatggagaaaaacgcaaacggacgcaggaatgctccaatctgggctgtgaaggctcagacaggcaggaggctgtctgcccaggaaggcaggtcagaagctgctattaaccactctggcagggcagtgtttctgtcagcctgcagagcacttcaggttctgggagcagctgatggcagaactgtggtgttctctccgtggaaaaaaaatgaggaagtcagcaaaatgttcttaagccattccgtccaccattttgtccatctgtgttgatttggcagtggtgttggcaaagaacctgggtgtaggacaatgtgctttgtaaacagaagaaaatgaaatgatagatgcaggggtgcctttgtttgagcttgcttgtatttaaagttggctaaatatgcctcagcagagatctttggggacatgaatcataatagaaaaaaacagcaacatataggcttgtccaaaataaaacctgctcaccgtgcctcaggtaaccctaagaagcgtcctctgttgtaaaaacaattcaaatacataccaagtagcaagaatcgcataaggaaaccccacataggatgtccggggcaacaacatgcagacccccacccctgccggagccgagtacacaccaacccacacatccagggctctgggcagcggtgactgttcagtgagaccgctttcagcatttgcgagaagctgctcaccaactgccaagttcctgctgggtcggccaagaggtatgaaccaaaaatgaaaaaacatgaaaggtttgttttttaaaggcaatacatcaaacataaaaagagcccttttgtatgaattttcagtgtgggagccagagaggagaaaaaatcattttccctcctgggaggaagcagtttgacctcacctgcgacttttctcttacggtgtggatttttctcaccccattaaatgtaacctactctaggtgggttagtaccatgtgagagaaatagggggtgatggggaatatggcagacaggcaggctggggctcagacagaatgccgagcaccctcgagggtgggccctcgagggccacggaagcgggtgccacggggctgcatggaatgcggctgctccaaggggcctgtttgctggacacacaaggattaagtttccatggctccaaaacccttgcagcctcccaccccacccccggcaaaagcactctttgcaaaaggaaaggaaaaaagaacaaccaagttagaatggggttatcttcttaccactttcacaaagaaagggctggctgggatggacacagcaggtttcccactgtgaagccatcagaaaggcagcggaaaaaaacctcatggcagttaggtgtgggccagccacacagacaggaacaagcgagctttcaaacctagaaggtgagtgcgctacctgtcagcgttcacaggactttgctctgaagaacagtaaaagaccatctcagcaccgggtccctaaatccccttcccattaaccaggtgccaatagtgaaacctagaaggggaccctggtaaatcacccggcggctaccccgcaggctcccagcgctacgctctggggaccgtcagccttttcttctgtcacacagcaggagaatgagctcactttggcatctgtgtgaccagggacggctgccatctgtgtgtcactgttatcagtggtcagagcagaagtagcaggtggaaccatgtgaaatccctaacattcaaccgtttagacctgcaaaaatggctctttccttcgatttaccctgatgatgacaagaaaaggagaagggggggagggaagggagagggggagggaagggatggaagggaagggagcggggggaggaggaggacgaccatgatcatcagccaattgtgctacgtcagtccagagtgagctgctacttatgatttcatttcctccttagactgatgggagcaatgacaatccccatttgtagatgaggcacctgctcagagaactgaagttactcatccagggtcacatggctgtcaagaggcatgcccagtacctatgacaaacattcatccccaagtaacgaagccaacaacctgtgtctcactccagaaccacagagctgttacaacacgtggtgcctcctgagccagcagccaggggcaagaacgagaggatgcagggagaggctctggggaaagggctgtgtcccctcagtcatgtgacccccaggctttctagagtgactcatggtgaggacagcaaagatctcaaaatgctgtctagaccttaactctgcccatcaccccatccatttggttttgtttccctttcatttgcatgtgtagtcacatgctcagcatccttgggggcagctgcatctgtggtcctccagaaccccaagctttgcagttggacttgaacccctcatgcgcttttgattcctgattaaataacctgattcgagttgttgagatctttagtttacatcaaataattcttctttctattgctccattcacttctgcacattgccttaggtaccgattcattttctctacgacccccgctgcttacatgagttctaagatcatccacaggtgtgtgcctgtcggagggctcggagaacacgggacagcaggaagcagtcttttttttttttttttttgagatagagtctcgctctgttgcccaggctggagtgcagtggcgcaatcttggctcacttctacctctgcctcctgggccccagttcaagcaattctccttcctcagcctcccaagtagctgggattacaggcatgcaccaccatgcccaaataatttttgtatttttagtagagacagagtttctccatgttggccaggctggtcttgaactccggaccttgtgatccacccgcctcggcctcccaaagtgctggggttacaggtgtgagccaccgcgcccagccaggatgcaatcttattggtgtgtcacttttagcccaagaagcaaaaaagtggagtgagtaagctggtaggatcaactgttatttttatattaaaacaaacatgtaccagaattatggagtaaaaattatgcaaaatttacaagcatgttagagataaatcagaccttaaagaaatttagtgctagtcagaagctacataaatggtcaggcatgtggctgctggtgcaatattgtccctttacggccaagagacctcagacaagttacttaacctctcccatcgaaagcatctctcatgaagatgctgcttcagtcatagggttgtcaggaggatataccaagttagtgcctatgtggacagctgtttagaagcctcagagcaccctgtgaatgtgctttcagacctgccctggattcttagcttctactaaggacgagctacgggtgtgactgggttacgcttggctcattctggcctccctgccgcaacttttccaaagaggcgatctctgagctcctgggagcaaacccatgaggatacagatgattcggcaactttgtgccaggccctctccaggctctggggttgtttctgtgaacaaatgctctgtctctgcacccagggagctggcattctagtatgtgtgtgcaaggcggtgggagagagacataaatgcataatgtgtcaatgcagtgaaaacaaaatacagcagataaggggtacaaggaaggacaaaggatggggtgttcaagtggtccctgaaggctgctgcaataaggcatttgttcagaaagaagatagtgagagcataccatgaagacatgtgacagaggactattccaggcagaggcagcggcaaggccaaaggccctcagtgggattggagaggaacaaaaaggtgaccgacgtggctgaagcacactctgtgcgtatggggttggggggaataggaataagggttatgctggttgggggacagatttggaagtgtgcaggtcatagtaagaactctggattttttactgaatgaagtaggaagcaacactgagcctttctaagctaacagggatgagataactaagttacattttaaaggaattcacctggctgccacatggaaaacagcctggtggaaggaagaaagagatgtgttctgcacattttgaaagtggaacaaagaggacctgatgatgaactgagctcctgaaaggaagatggagtcaagggtgagttcacgacttctggcacacacaactcaaggaaaaagcgatgtgccgtttcccaaaagcaggaggcaagggctgagcaggctggagggtggaatctggtgctggacttagatgtagcaagcataagatgcctatgagacagcccacggaatccaagcagaagtctggagtgggagggagaggtctgggctaggatattcatttgggaatcattatcgtggagatggttcttagaaccatgggaccaggagaggtcagccagcgaatgagttgggctggagaggggaagacgtctgattaacctgactttgttctctggcaaaggcaccaggttgagaattcagaaactcatatccctggtttctttttagcaaacacgaagcatggtgaccaagccatgtcatcacactggaaccgcaaaaaagagaagaaaggaaatgcgcttcgtcttctgcgaggacacattgacggtgctcagctagccagcatctaggtcccacagagggcaggagggatccggaaacactgaggtcccctcctgagaggctcatgccctcacatactttcttaatataatcaaaatgggagtaaatgatgacaatatgcaactttccaaatactgagggttctggaccaagctactgaaacagatttcatagttgctatgctccatactctgcctagcatacggtagtcattttataaacatttgacaaatagttatatttctaacagaaaccagaaatttggggccatgactcctttacagctcaagaaatatgcaaaattagtattccctgagagacagatgtctgaaggccccaagcagtccaaccctgtcctgtcatagcctgagacatcctgccttagggagtaagttattactaactgtggacaagctctgtttcccttttggaggaactgagggcagagatcctgccattaattcctcccccagtgcctgggatagtgccctgtgcacagcaaatgcccaatacatctaaataaatgtcaaatgaatgagcgaataaatattcattaaaaattaaccaaacagttaatttaggtcattcagtggaaaaaagaaaaacagtgaaactagaaaagcatctttttaatttaaaaggttaattaaggacaaggttttaaaaaaatattttggtggatttagtaaaccaagcacacctgggactcaaaatagttgcaatctgtaactctaaacacagcccattatgtcccacgaattagaaaatgagggaaagttgcctgactcgcttcatgattctagtataatctcaattcttcaaccagatagtggacaagaaaataaaaaaccccaaacacttaaacacacagatgtgaaaatcatgaataaaatgctagttaactgaattcaatgctacatcttatgtgtattataatcagatattgtttatcctagaaatgcaaggatggtttaacatcagaaaaatgtatcaacataatacataacatatgggtgggcaaaatgaggaaaatcacatgattttctgaatagatgcagaacagacatttggtaatttcagtagccctaggtcagtccaaatgatctattagtctgatcaatttaatgattttattagattctctaattcccaaaagcatatttctttttactatttaagcattttacagcaatctgttttagatgtataagcagggcccacgagagctgtgaggaaccaggactcggataatccagggcgttgggagacttccccaaaccaggaaatgatcccatgcaccatctgagccttccagtcttcccacagactctaccaaacattatcggggccactaacaaagaaggaagaaaaactactttcaatgttagctctccctttgactcttctactgagggatatgtgggggacccatgtttatgaataataacttccagaaataaaaattcaggagagacaagcaatgcagcacctacagaaacaaaaataatcagacctaaatccacaagtttattaaagtgactttttatcatgatctttttttttttttcctgcaatggagtctcactctattgcccaggctagagtacagtggagtgatctcggctcactgcaacctccacctcccaggttcaagcaattctccagcctcagcctcccaagtagctgggactataggtgcacacaaccacacccggctaatttttgtatttttagtagagacggggttttaccatgttggccaggcgtatctcaaactcctgacctcaagtgatccacccgcctcggcctctcaaagtgctgggattacaggggtgagccacagctcccagcctatcacgatctctcttaacactgccctgacataactcatggctgtaccatccaaagacagtattttgtgctatgtctgaaaaccttccaatctggccttaaaacaaatattcagcaacataatagagtgataatgtcagaaaagagtattggctcccatatccacagttgttttaatagcatttaagaccaacattttataaatattattagaaataatatttattttttattaacattaaaattaatataataaaaatataatttttctcctagctttgcttatgtttgtgttttcataaatagtagaggggagaactaatgattaatcaatgggctgtgcatcacttgggaagttccctgtgtaaaaagctctaagttaacatctttgcaaaaccattaggaagaatttcccaataatccatttaaacatatcagattaatgaggaattaaatgcatctgcacttattcttggtgtggatttcaactgtttctcaaagctgaactgagccagagcctgctcagcagaagaaaaattgagaaggctaatggagagagccgttagcgtaggatgcaatggtttgcaacttggtgggcacacacggtctgaagcctcaccctgccctgacgcctgcattcctaattctgtgcattcacatgttgacttaacactggtttattgagcatttactatgtaacactgttctagagaccgagaaatacagcagtagaccaagtaggcttacgttctggcaggaggagtcagacactcaacaaatatgcaaatacagacacaaatattgggttgtggggttagagaagaagtagtgagagctaaggatggtggggagaagccctctctgataagctaacacgtgagcagagacttgaaggaagtgagagactcgggaagctaccttggcaaggaacgatccgggcagggagaagagtaaacacaaaggatggaggtagtagcgtgtgcttgacctgaggcccaacgaggaggcccagaccactggatgaagtgtgtgcacagtgtgtgtatgtgtgtgtgcaggtatttgggggaggaagggaggcaatcacacagggcttccagggaggtgaggactatgaattttcacttagcataatattttcaagattcacccatgctgtcacacaaattaatattttgttcttttatattgcttggattcctagttgtattctagtaatttgtttatccgttcaccaaatgatgactatttatgttgtttccagtttggggttattcaaataaagctgctatgaatatctacatacagtctttgtatggacaaatgttttcatttatcttggaaaggcatccatctatcaactgattgactgactgattgatctgctcactatgtatcatccagtaatgccattcctagggatttacccaagataaattccagactgttttcaaaagtggctgttatcattctgcattcccaccagtaacacatgagagttccagtttctccacattcttgtcaacatttggtattgtcagtcttttttaagttcagccctactaatgcatgtgaagtggtatcttatcatagtgttaatttgcatttctctgaagactggtgacactgagcattttctcatgtgcctttaggaatttataaattttctttgctgaagtgtcttttcaaatttttgccttttaaaaaaattgagttgtcttaatattgagtcgtaaggttctttatatattctggctatatgtcctttgtcagatatatgtcttgcaaatattttctcccagtctgtggcttaccttttccatttttaaactgtgttttataaaaaaaagaagtttttttagatcaaagtccattttaatcattttttcttttatagttcatgctttttgtgtctcatttaagaaatctttccctactccaatgtcacaaatatattctctgagaagcttaacagtttttgcaactaaatttaggtctatgatccgttttgacttaatttttccatatggtgtcatgtaacagttgagatttttttcctatgcaggcagatattcaatggttcaagtaccatttattgaaatggctatcttttctccactgaatgaccttggcacttttatcaaacatcaactggccacacacaggtgagtctacttctggacacttaccctgttccattcatctgtatatctctatccttacaccaacacgcatagtcttgaatactagggcaagttaattttaagatgtctcctggatatgtaaaaattatatctgagttgaactacagtttatttatatatccaggcagcaaataaatgtgagaatctggaggtgagggaagagatcagagataccaccttggaaaccatcaatttagagatgattcttaaggcaggggactaagggacactctgtaggacacagacatagagaagggaaggggctgcggcctgaacaccccacctgcatgctcactcacatactttcgtcggcctgtgttaacgaagtgctgggtctccccagcctctctcatctgtaagcagtgccaacaacgtccaacacagttccatccaatttggatctgccagatttccaaggagccgaaaacttgaccctacaaatcagagtcccgaattcagcccagaggctcagaaagttgctccagttttctaagcctcagttctcaaatttggaaaaatagaaattcagtaactagccaaaatcatagggttgtttgtggacaactaataagaataaaatgtaaacatttagacacgcaagccccgtgaggaaaatccagccgtccctctttctaatcagggtggtgtgagtttcctatgacccatttccaccatttccacatttatgaaccgtgatcaacattagacactgaaaacacaggaaaacaacttctggacaaatcactgtgagctcaaatgaccccgcagactctgtggccagcttgaccccaccactccatcatcaaagaggaccatggtgagagcctgagggatgaggcactacttgttgatgctggcagggatcagcagaaacatatgttttcatgctgaaaacagaagacacagatgtgggcacacttagaatgcactcctggcacacagtgggtactccgtaactacttggtgaacaaagagacacaaagaaacagcagtcatttgaacaatcagctgagaaaacagagactctgtgaccaagctctccatcaggtatggaacagatgcagtcacaggaatgataacagtcacaaggaaagctgagggtggctccctgccggtaccgctcttggcagtttatgggaaattattcatcctatggagcagcactattattaaccccgttgtaccagtgaggaaacagaggcaggaaggtactagaattactcccacttcataggttaaggaaactaaaacccaccaaaatggcagggctgggacttgaacctaggtcatcaggctatggggttccacggactatggctcagctataatactacgcgatattctctcccatcttcagaatgtttgcttcacttcaagtaaaagacagtaactaaaaattctctttccatcatctgttaccttaaaacagcctaactcacaaaacttcacaacgcaagcccaggtattatggaacccaccaagaatagcaagttcagtgttggctgccatttctaagtggacagtgttaattccctccacttagttgaggggcggagagaggtgttgaaggaaagagatgagatgacaagtctgaagtggcttcatcacaaagcatccatggctgtgatatgtagctgtgtcatccatggcaacattcgcctgaatggagattgtattatggacattgttctgggatgcctgaggctgatgacatgggacatgccggaaatttatgtatttcctacataaatatgcagctgaacatatttatgtaggaaaattaaagaccagactggtcaatcactggtaagccgtcaatgccccctcaatgattacccttgtcattcgtgccagccaaaacacacccagttcacaatagagacgcaagtaacttttcaacctgcaactgaccgctagaaattgattttagtagttgcctctatcctgtgatattttagaaatcaggttatcatgcataattagctctccagcccaaatcatctgtgccacattctattataacaatcggagaggttatgacaatcaagaaaaggaaaaaaacacaggcatctgtctcatagttcaattttaacaggaataaaaataatttgaaagaaagaacaaatacatagatcaaggccacatctgccatctcattgcaaggcacatgcccatcctgtctacaaagcttttggcatagcatgtctggtgcacagtaagtacttaatcagtggcagttcatctttttattattattaatgtttctagcatgaatggatctcagagagtctattaactttccttcctagtcaagggatgcacaaaaatttagcaaaacttcagatattaatttgcttcactgtgagtagttatgttctatttataaaaattgcaaacagattgatttcctttcttttttttttttaaattttttaatttcttttatagagacagttatctaactatgttgcccaagctggtctcaaactcctggtctcaagcaatcctcatgccttggcctcccaaagtattgggactacaggtgtgagccactgcattcagcattgatcttattttcatttgcaattttagcagcaatatgatatatataatattctttaataacaatattcataatgtatatgacataaggtatacaagaatacaactattttatacactaacagtagcaaataatattctctttcaaaattgtgattcatcgaggcaggctaacattagctgaaacaagtccaactgcagtggcccaagtccagggctagtcaggcagctctcctccaagcagtgactgagggccacaggcctcttgcaacttgggatgccgccattttcccacaaggcctccaagattgcagcataaggggaaagggacagtgggagaatctcatgggccaggcctggaagaagcgtacttcatgtccatctgtctgttggttgtccaggcaacgccagcccaactgaaaggggactatgcgcccaggagaaaaatgaaatagggttgggaatcactgttttctgtgtcataaacattctctccgtggacaattaacatctgccttgtactttacagatgtttacacggcacttttcactatgtcttatttattcattcagaaaatttagtcaataaaaaaagttgaaaagttgctattgttattgccattttccaggtgaagaaactgcggcttggagaagtcatttagcatccaagcagatgagtggcacagccaaggcttcattccctgacctccgcatccaaatctcaagccctttccacttttctttgcgtcgtactgaacttcaagaagaacagagatcctgtgataaaacagatttatgacagaagtagggttaccttttcactcccaatgggatccagtgttgtgtagttccataaaaaaggcacgatccccacacaattcaacggaacagcctgagagcaggctttcaccagtccatagtcatatatgagccagtacagggagtgtttcaaaactgaaatagaagttaatatcctgataatctcaaaataagacttctaattcttattttagaggtcaaagagatgggtgtagatatgggtgaacatgattaaatcaaaattatggatgtgaagaaaaactctgggcgatcagggtccagttcctaaccctgtccccttaactagacatgaaacccatgtggaatactcattgtcatggtgacaaccgggtggatggagtttgaagacaggtcagaacacactactaggtccacaaagcccaaggcgtcactgagctgggtgtgaagtggctgtctggcacatcttcttccattgacaagccggcctttgtgatgagaaggaggctcatggcacagtctcagctgagtccactcctgcaggcaggcagcagggaggacaaaacgtccccagcttccttctccatggtctctgcctagagagcatcagtatttcgatgttcagcatggaatagacttccataacattgaaagcagtgatcttctcttttcaaaacaaggtgttgtatgcagtattaaatctggattccagaaacgctcgcacagggcgaccttgtgtgcagaagtttattgccaaggttccagtttatgcccacgaggcgcacagcgaggcttctggaggcagcagcttgcttttggcattcccttacagagctcagagccccgacaggttttggctgtaagaagtatcccgcaactgatttattcctcaatttcaattatttttttctctacatgaatcatttccatgtttccaaagcagaagtagaaagaaagaaaaaaaaactcataaggtgaaaaaaacttccaaagtgttttgttttgttttgtttgtttttttattgaaaaaaaaaaaaagcctgcaatacaggaatggatttgctatcaaacatccatttcaggaaaccaccaggtagaatcgggcaatttgatgggcaattgggtctcaatttccccatcaggaacaacgtctgtgcacacacacatacacacattcactcccaagccatccacctcaccagaccatgagcttttagggagaccgaattccagccaggaaggcagtttccttttcactgtaccaacataatgcttcattacaccaagacacagcactctcccatctgccaggtcaataaagaatgaagcttaaaattcacagtcacctttacaatgctaagcatttcaaccttaaatgaatgtgcagtccaccaatccgcttccccggcctgcatccagctcttcccgtagctgaggctcaaatgatcttccacggggtccattagttcctcttggctggtccctgggttcaatgcaacgctcccagcaggtacggtaactgccactcatctgaaactcccaagttacactctgcctcactgacaagggcatggggcgctgcctcctattctgttttgtgggttctttgatcaccagaaggaatttcgagccactgtgctaagtaactcgaattactcataggctgggatcccagaagccgctgggttcctccatataccatcagaagctgagcttctccagaggacactgaagaggctgctcaagaaccctacagcaggttgtcccagaattacccaccatgacctaggtagctgactaaatgccacagcccacctgaagtttccccaggcaaacacctggagtgtctcatgactaagcaagatgtcctatggagctaaaaataaccctcctatcccttcctcctcctgccatccccatctctctgaccctctgtggtcctcaaagggcatttaagatttgagtttcctggccagaacgtgggcaagtgcttgtatttatttgctatttactaactgctgccatagtagatggcgtttctaaaacggtataaaacatctaccaacaacatcaggtttttggtattctatatgtgactgttaaaataaaaatggaccttggctacctataatgaatgagccaagtaaaagcactccaatcctggcgtccaattctatcagctgatatttgacacagggtttgacagttgacaaactgtctctccatggttccctcttaacagctccatgaggtggcagggccagtacaatcatccttgttttgtatctgagcaaaggacattgtggagagattaagcaaggctacaaaatcggtgaaggattccgactttccactacagcaagaggtctcagtgcatggctagccctaggcgatgccagaaacatgacgacataagtaatactttttttaatagcaaagaaagcaagccagtaagatgtccagcttgggaaatatgaagttggcaaggacaaaagatgcctccaaattttaaagaaaaaaaaatttctctctcggttaaccctcactactccatcaagagtaacagcagagtccaggtatcccctggaagtgggtcaggttcgggtctgcactgtcttccttgcttccaggtaccttcctcctcccaggccgcacggagtcccgggcccggctccgggcgctgtgtttacaggcagggcggcaggaaggacatgacctccccagctctgcggcaggttaagcagcctgattgaacgtggctgctaattaagggcccctcttgtctggcagggccaccagggtaccttctgcacttgttcatgaccactgcacctcgctcagaaattaactcttgatgagtgcagacaggggcccagctggtcctcccgagtcctcccaagtagataaatgaagtgtaataagaatgccgctgactgccaagggaagaggggctctccgtgacctcttggtaaaatccagagtatacttttactatgacttaattctctgcactggggacacctaacgtagccaggaatggtgtgaacagaccactagccacagggacagcatagaggcgtccatcactagacgtccacttcatgaagtaggagttaaaagaataaagaggtaatttatgagaaactaattttcaattgacaaatattttcaggaggtgtgatgacctacttttctccataactcttcatgggcccagggacaatggtggctcctattacagtttgcaaatggtacaatcattccgctcaggtttaaaatattaaatgctcatcttctatcacttacagagggattctttccctgaagctctatttaaggagagggaaattgcggccgtcattgtccaggcctcccacatacagaaacttggtagacagacatgttctgggtcacatggctaagctgtactgacatgctgctcgagtccagaggtatcgccattgagttcagcacagtcaggaccagagccttttccaccattcatctcaggaagccaacacacacagctggtaagggggagggcttggagctaggagactgggaactgtgtgtggtcagaagccacctcactgccctggcccacagtgtggttccctgtgtgacatcatctttgagatatgacagagacaaaaagcaggctgagagtccctgctctggactctagatcacaatgaagccacatctttctacaacttttgaaagaagcaggtgaggtttccgaaaaaaaaaccaagtgaaatgaaaggtgacggtcagtgtgctatcttttgaccgcacagcaaaaaagtggttgccgggctagaagcaagatggaaagatgaagaaatgggcagaaaaggcatttggtgccttgatgaaaaatttcaaaaataaaagggtcccatggtgaaactagagcaattcccagaagactaaatgtgggaggaatgggacgaggtaggggaagtcagcagagactctaagttgtttaagagagcgtattacttatctattgctgtgtaacaaatgaacgcaaaactaagcagcccgagacaacttaagaaacccacgatttccgtgtgcctggagtctgggttggctcagcaggatgcctttagctcagggtctctcacaaggctgcactcaaggtgtcagcgggcactgtggtcatctcaaggcttgcctgggggggtggctccgcctccactttgtcccttcccaacctcatctgtagtctgccacaggcctcggtgccccagtagctgctaatcttttgccatggggctactcatagcacgtcagcttgcttccctcagagctgggggtagggagaagaggaaaagcaagcaagacagaagtcacccagaagtgcaaaaaaggagttgccatcccattacttttgccatatttgatttgttagaagtgatccagtaggtccgacccacctgcaaggggagaggcttacgcaagagcatgaaaacctgaggacagagaccaccaggaccaacaaaggctgtggaccacagagacactctttattcatggaataaacctggagcccgattctcccaaggcgagcctcctgaaatgatagaagctacggagggaggccacatgctaggccacatgtcagcattattactgttcatcattcattcagggcccacaaaagcgagagcatctccatacgggtgtggattttaaaatcaggaaagcaggccagatagaattcatgcttaggcacagctgctcagaactgaccaccctaaggggcccactgttaataactcatcctttctgatgatccgcccactgcctggtgtggctgctgccactgttcagctctgtcccctgccctgagaaacatgtgctgccagaggttcgtcctcacaataataaccgctaacactgagtgacagcatgtgatggtcaagtacagagtctggcactttatgttcatcaccgcgtttcatcctcaccacgaccctgttctgtggatccggctggacgcatccagaggtgggagtccctgtggtctgggcactgatcagtgcctgaatgttctcagggacactccccttcattaaagcagacagttagacattaacaggtctcatgactcaatatataactgaattgttatattatgggcacattgcacaactgttcacttagaaaatctaaaagaatcagctaaaaactattagaaaaacttagtgaagtgtataaaatgaaacactaccgtgccactttaggactctggcaatagctaaaaagtaagttttgtgataactcatgttcattgtagaaaatctagaaaataaaaaaaaaaaaaagtaagactaaggcattaagtcactcatgactttaccaaaagacattttggtatattttctttgatgcatttttctatgttacatgggtgactatatcattgtattttaaaaaattgttgtcatactacactagctgagcatcttgcttttttcacttaatgtaacattgggagcattttcccatgctcatgttcttcaaaaacccaaggttaaatggttactgaatagctcatcatattattacaacctaattttaaaaaactatttccttttactcatttagtcaaaaaaatcaaatttttttcctctgttccccatttcctgtctttaaaaaattatttgaatatccatttcagttcttctattggcttaacacatatttatttacatttttaagttggctgcaagttagaaatataagttttcacagtctgcctacagtcagtactgtacaacctctataataaagaactcttctcaccatcgaggtccgtatctacccctggtctttaccttacagctgttacatgtatctcatctatagatgttataagcctcgcaagacagtgttataatttttgcttaaaattcttatatgattaacaatgaaattaagaagaaaaaagcagaaagaaaactagtattttgtgttgatccaaatatttaccagtccagtagtctttactcttttccaaggacctgagttcccaactggtattatttccctttaactgaaagaagttcctgcagcatttcttacagtgcaggtctgctggtgataaattcttttttcttttatcgaaaaatgcctttatttcccttcaatcttagaaggatatttctacaagatataaaattctgggttagggcaggcgtggtggctcacacctgtaatcccagcactttgggaggctgaggcaagcggatcacttgagggcaggagctcaagactagcttggaccacatggtgagaccctgtctctactaaaaagacaaaaaatagctgggtgtggtggttcgcacctgtagtcccagctactcaggaggctgaggcaggagaactgctcaaacccaggaggcagagattgcagtgagccgacatcatgccactgcactccaacctgggcaacagagcgagacctcaacttaaaaaaaaaaaaattctgggttagaattttctgattctctttcagtaccttgaaaatgttattccatgccgttctggtctgcaaggtttccagtgagaagtcagccattaactggattattactgtatggcttttctcttgttgctttcaagatttgctcttcaactttggttttcaaaagtttgcaagaaccagcgtgggatttttaaatatttattcttattggtgtttcttgagcatatgatcttatatctgtaaatttctacttgtcactgaattctgaaattttttagctattatttcttctactatttttttctgctccattttctctttttcctctgtcattttccccctctctgccttcagctgttaagtccactcagtaaatttttatttgagataactattttcagttctagaatttccatttggttcttctttttatcattctatttctctgctgagctatcttatcttttcattcatagtgagcatatatcatgttatttcatttaggatagttttgttttgctttgctttgagacaaggtcttactctgtcacccaggctggagtgcagtggtgtgatcatggctcactgcagccatgacctcctgggcccaagcaatcctcccacctgagcctccccagtagctgggactacaagggcacactaccatgcccagctaatttttgtattttttgtagacatggggtttccctgtgttgcccaggctggtctcagactctgaggtgggctcaagcaatatgcccaccccagcttcccaaagtgtcgggattacaggcgtgagccgtggcacccagccatttagtatagttataacagccactggaaaaccttgtgtgactctccatatctgcttccccttggggttgaacttcatttgatttctctttttcttgatttgagacagtattctatttccttggttcttcaaatgttggttattttagctttgtatcccagatgtgaggaaggttaaactgtagaggtttgggattttgcgatttttcttggatgactgttagttcttttggttggcaattagctgaacctgaactgcaaactctgaccctttcggcagcaagcacagatttttttgtcattattgtgatctgagtctattctatgcatgtatggttcagcgatcaaagatgtatataaacagaatttggggatcccctctccagcccttttcttctaggagtccctctcactgcaccacctgcccttggccctgagcttacttggtgcagctcaagagtgcagctcaagacccaccttgtcccaacgaggttctcccaccataaacttgcctgcttctgctcactctcaatggcttcaggcagctgctttctgaattatacccagttttcatagttattttctgtatgtgggggtgggagggatggaggtgggagatctgtctggtaagatcttgatctgccattctcagaagaagaagttcccagacctttgtatctaaataccattccccactaaaaggaaccagagttccttctaaaaatgtagaaagtaaaatataaaaacagctcattccagagctgggtacaaggttacgcctggaataccttattatgccagagagtgaggaagtgatcaaagatccaagaggccctgtcaaaaggagatgggagcctacttttcaaaccaaatctgggataatttgagcaaagagaataaggatcataattaataataaaattctgaagaaaagagagacttaatagtccacagtgctgattgagaggaaaaggaagagaagcatattactcatttaattggcagataaaactgaatgtatttgtcatgtacaacacgttttgaagtacctacacattatgaaattactaaatctagctaattaacatatgtattacctcacactgttaccatttgttacatttttaactgatgacgtatctctcatttattggactgataacgtatctattcctcattcactggattctacccagaaacagcacactttcaccctttcatggtacagctgccatgctcttcacaatgttattattctagactattacagtacaagctagcagtgacctatttatcttttaggatcatgaacaatatatatcacttcatttctagaaactgatcttcaaaaactataacctactgcaggacaggtgaggccagggaggcggacacctctgcctccaggaggctactctgtgcctcaagaaccaaagaacgaggggagttcgaccactgcctgtacagagcccgaatgccctccctgctgctgttctaatgcatgtcccatctgcaatgttagaaaacaagcttcagcttgatacagtggaacttggcagatggcacagtttgcttgttacagaactaagtatgaaaataaattcatttagtagtgctccttggagaaatgtggttcagaagtcaaataattttaaaagacctctttcccatgtaagacacccatgaaacaatgctctggtcataattagtctctaacctttcaaaatgcctgcttcagtgacctcacctgctattgaacacgatgcctgcagatggtgtgaggtggccaaagggtggaggactggcagcgggggctgcagcggctgctgtgaccagccactcacttgctgaaggatcagggagagacactgtgtctctctgggtctcggcttcttaacctgtgaaacccaggggttggggaaaagctcgccaagcccccctcctgctttggcatcctgtgagtctttattgtcctgggctagctgggacccctaggacactgggtggctccttccaccccacatgatcattctgctcaacaagaacttgcaggagccacagacctgcctcacaaacatgaggaagcgcatccttctacaaagcgagaggcttgaggtgtgtgtatagccaggtcaaggtgaaagctactgaggttttgcggaatcaactctgtatcaaatcttctctctctatccttctcagagtctgatcaaactgggaggtaacagattctcaacaaatctcaaggagagggaggaaaatatctacctactatggaattatctgtaatttttctaacacacagagtatgttagctaaagctttaatgccccctatcctttctgtcacttacggtacgctttatcctttgatttttgatcaactgttagtcgcagaatgaatatgcctaaattatcactgaaatctagcaaattatgtcttagaatgttagttttaaaaataagtttgaaaatcatttttatgagtctttgtaagctcaaaaatatagctctcattattttgacttagtttgtttaaattgctaagaaaattatttcctcaaaaaacagacactgtactcttcaccaaatttagtatgttgaaaactgaaaataagaaattacatatgaaagagcaagccagagacaacataccaatatacagaaaaaatagaggaaaaaaatactaaatttttcacctctgacttttcctccttttaaaaagaaaaaaatcagggctggcgcggtggctcccacctgtaatcccagcactttgggaggccgaggtgcgaggatggcttgagtccaggatttcaagaccaacctgggcaacaaagtgagaccctgcctctattaaaaataaaaaaattagccgggcatggtgctacatgcctatggtcccagctacttgggaagctgaggtggaaggattgcctgagcctaggagttcaaggttgcagtgagctgtgatcatgccactacacttcatcctgagcaacagagcgagattctgtctcaaaaagagaagaaaagaaaagatctaccagaagccttgggtccctgttttctggcaatatgctatgcatatttgcaaatatgtaaactgcatggataattttgctgtaacgaggaatgtcactttaccagactacaactttaatcagcattcctctgaacaaacttgctcatgatactaagcaacgcaaacatgcagccaaacaactggtgttttaatattctagcttctatttcttccacgtcataatttcctgtaataatctcactcatgcctgaactccacagacattcttatttatgtttttcaggtcagtatgccaatagcaagaagacttgttcttgaaaggttgagtttttcaaatgagtcctgaaagaattctaccacactgcctatttcccaagcagggatcatgggagaaaggaaattttgaagaaaatggttctaatgccattttgttaaaagtactgagagatttacaatgatcaagtaatatgccagttctttcaaaggatgccaacatctgatgccaacataattacaagttggaaaaatgtgtaatgaatcaggcggctcataatttcccttagaatatgtatgcacaacttattaaatgacataaaaagcaaagagtcacggcaaatgttgaaaccttaaatctgagtttcattgctttggggcattttcgtcaaactccatcatctggaagtacctaacaataagaaatattaggtcacaagctgttttagaaacacctgtaataccttcacctaatgaggccaataaacgagagcttcgtgttcctcatcaaataagaaaacttaatagtcaaatctgacataataagcccaaactcaaaccctgtagaaatggaaacactcacatggagagcattttctcctccaaattttcgattctgccaggtccctcccctaaagccacctggtggaaaaatgtgcccccagtgctaggtcagtgtgggtttcccagagtagggcttaattcatgtggtggtctttggaggctcagaaagaatagaatagagttttctcttgatggtcactgtcctcacctcctcctgctctcccccaaacacactacaacctaggtaaggagaaagaccctactgacatcttattcaaaacccccaatcccacccctttcaaggtacttgccagggaggtaaatggtggactctgcaggtttcctcctccaaaatcatttgtatactttgtctatggtcactgtctccccaaaagggctatactatcattttcttccaactagggctgtcagatttcacaaagaaaaatacagaatgcccatttaaatgtgaatttcagataaacaacagataatttcttagtatgtctcaaatcatgcatgggatatacttacactaaaaagctatctgttgtttatctgaaactcaaaatgaacagggcatcccggattttatctggcaaatttatgcaaaacattcataatatggggaatgagaaattaacacagttacctctttctggtagtccaggaagtagagaaaaggcagctctaagaaggggtagaggtgagaaaagggaaaatgtaaagagaaaataaagccttccttattttggtagaattccatgtggtcctttacaaactttaacgtgcatacaaatcacccagggacattgttaatttaacatgtgggttctgattggatagggtcgtggagtctggaattctccatttctaatccctctccaggcaatgctgatactgctggttcaaaattcgtttcactggtaacagaattccagcctcctttattccaggaattgcatggggtcaaaggcaagaagacccggtgcaatgggtggagaagcaggtggaggagtgggggccctgtgagggccagggaaggccatgtgagtgtgtggatgtgtggctgagggaaaggaggccagggatcaatgaagctttgctttttttttttttttttttgatggagtctcactctgtcacccaggctgggatgcagtggtgcaatctcggctctctgcaacctccgcctcctgggttcaagcaattctcctgcttcaggctcctgagtagctgggattacaggcatatgccaccacatcccactaatttttttgtatttttagtagagacggggtttcaccatgttggtcatgctggtctcgaactccagacctcaaatgatccacctgccttggccccccaaagtgctgggattgcaggcgtgagccactgcacctggcctcaatgaagcttttctaacagtgaaggtgaaatacaaagatttggtctcttctgaggtttcttctaattctgcactgtgagaaataaccactactgtcatccacactaagacatgagttttgagcaacaatagcaacaacaaaaaatgcacacacagcaaaagcagcaaacagttttagacattcatgcttctcatattattactgagaaacagagcagtacgcttaagaatccaacacaaatgccttgtcacatttggacaaatgagtaaagacgggggataggttgtgtagaattcatcaaattggtgcccctaaaaagtgaattgagatttcgggacctggccatggtttgacccttagtgatgtgtgtacctatatacacaccaaaacaggcactcgcttcactttccaaaagttatctggagaaaagttgttctagttcagagtgtttacatagaccaaggatggtcaactgagactccagggcaaatacatgagatttttaccggttcctggatacctttgactcaagacagaaaaaaagtcattaggaaaatggtaattattcttgtcattcatagaagcctacaattctcccacccaggaaattccactactcaattaattgattacatggaataggatgcctccactagtcatctagtcaaatgtggacactggtctgggttttaacttgtgggaaactgtttttctttaactcaggggactctaaagtacaatggctaagagtaccagagtcagactacttgtgctgaattctggctccaacactgtctccctgggttccatactactcttagcctcagtttttacatccataaaaagggatcaataaaagaatgtctgactggggcaacatagtgagaccccatctctataaaaaattttaaaaattagccaggccagacatggtgcatgcctgtagtcccagctcctcaggaggctggggtgggaggatcacttgagcctgggaggtcaaggctgcagtgagctgtgatcacaccactgcactccagcctgggtgacaaaggaagaccctatctcaaaaaaaaaaaaaatgtgactgtcactaggctgctgtaggggataaacttaataacgtatgtctaggaaatacacaggaggagttcagtaacgttgcctgttaataccttgtcactgtagttactgtttctttgctactttgcatgaagctctgaattgctcagtgttaccctgaagctggggactaaccatccttctctggattgccttctgccactcagccattctagtaatcaagctaagcctctactgaggtcccaggacacacagttgtatgggtaagccaatgcagccaatgaaatgtgttgtagatatagaaaatgagctatcggaaacgctgacttcaggaagtggagatacatggcacagctccaaaggcaagaagctcatagccaccacgaatctagtaagtcctccctgcttcttgccttacatccacaggtgtgagggaaattggtggtaaaaatttcctttcccatgactcgtaagcttctgagaaaagccttgtgatgatatactaagtacttcagcaaaggatcagaggagtcagctgtgagcactgctcagatcccagtaagactttcagtggccaagattaaagctggcttccctctgccacgccaagcaacccagcctggctacagtacagcaggctgctgcaggaacttttcagagcgaagagtaagcgttcgatgaagatgtagactcgattagagtggaagatggaagcagcagataacggatgcattacataccatactcttttcaaaatgaaaaagcaactaacatgcaatccttcaatataaaggtagattataaacatcggtattttttctttttactcgcacttggaattactttggttgtaaccatttacgtctttgctcagtctggatttaatcggtttctctgttcttccctgtaaaactgagtctttccaccaaatgaccctgcattcaccttaatttgattttctgggttttcgtcttttaaaagtcatcacagatcttatgccatagttgtgatcagttctccaacatttgtctgactatggctcaagattaaaaaacattttcttctaagatgtgagatctcctaattctccaacactcacctatcctccacccaccggcatttctctccctcaccctgctcctccgcctgcttcttcacccactgcactggggcttcttgcctttgacatcatgcaattcctggaataaaggagactggagttctgttaccagtgaaacgaactttacgttagagacatccaaactgtgtggatttggtataagcttctttcaaaaagtactactccattattgggaatgtttatgcctaaaaaagaagattctgtgttctattgtgtcagacgctttcaaagtgcaattgttcaatttgcaaactgcaattggttaaccaagctaaacttaattagtccaacgatcctacacatcaaaccctactgtttgatgtattctgcgagatgtccaagccgcctacagctggctaagggtcacaatgaaaaggcagccaggcttaggtctgggaactgaaatgagctgttctaagtggagcttttcttccattttctgaggctgcactgctctgaccttctccaaatcaatcctttgcggattaacatgtaaagcagtgtcgaattaatttcagaaagggaatatgagatcagcctaggatcatacaaaacatctaactcctaaatacactaatgcttctagccattcaatgagaagctgtcaataaagggaaaaaagtcggtgaggggggcggccagaaggatttgaaggttggagcaatctatcagactagttagcacattgcctacttctgtggcatggctaatgcattcctctagaagttaatcctatttctaaagaccctcccgcgaggagcacataggccgtgatgaatgagaactaaaatgcattaaaattctcaacaacttcaccaaaaggcacactattagattctgagtgtctaaaataagacggttcattaaaagtgcaggtcttaaagaacccgcttttgtccctacacactggggagagaggggccagtgtgtcacttgtgacacctgcagccaaaatatttttacattaggttgtccaagtaatcacatgagaaacactacatgaaacggcaagggaaggcctttttcacaagcgagcttaaatagcgttattatgtgcctacgctgggggaggatgtgtttccccagcattagccacacaacggtgtcattaaacccacttttaaaaaacagacatgaaagagcacttaatttcccttggaggagcggcggtatttgaacacttctctttttctctcattgtattttgcttgtactcaattaagagataatttagccatttatcaagatggagtcggggctgagcatttatacaggcatttactgcagctatccttacaggcgaaaatctgaaaccatctccagaagacagttcatagcggtgggcctaatattgactggaaattacaccttgacgagttagttttgagtctctgttaacagcacagggtatggctggatggccctcaagactgactgcgacaaattataaagcaacgtcgatgctaacgccagaaacaccaaggacgaaatgcttgagcccctacagaactggcaggaagcagcagcttaggaggctccgaaagatgaaaacacaaagacagaagcacacctagaaactggagggaatccacatggtgtgtttgttaaatgaatgaattaaagagagaataagtagactcagattgccacctggactcaggacatttatagcaacttaatgggctgaagttttgcaaaagttgatcctcagtgctaaacatcaggtccagcagaagggttccccagaggggtgtgggcatgggaggatgagagaggagcacgagggatgtatgatcctgcccactttgtttccacgcttcataatgaacacctgtgctgcatttactcttctgtatgaatcgaatattacactgaaaaaatctgaaagtaatacttcctctgacctttcgttttcacatcagcatctaccacttctttgtagggtcatcaatcctactataaacagtgttatcagtctaaactctgctatatctgaacattgtaataatcaagctatgatacggacagtatcatttacggaaagcttctaatacagcatctgttttacacacacactatctctaatcctcacaatcctttgggcaggtggcatctttgttttacagacagaacaactgaggctcagagagggcgagtcaggtgttaaaggccacacagctagcagccaccactgagaggattaaattgaggtctgctgggctcccaaatccatactctttccactttcccataaagaaacagtgcaggggaaaacataataccatgtatctaaaagaaagaaaaataactaagaagttgcacatctgaaagattgcaagttccctcaagcttaaagtaaaaatgcttgttaaatgatagggtcaaggattttatgaataaataaaaaagagccatcctacctaagccagataaagtgcactcacagggcagcaaaaataaaccagactcacgccatgtcagggtcccaccaaaagccaggctgtgcgacccatggagatgaccaccaaccagcacccctccctcagtgagaaggtgggtccttggccatcgggaatgaggcaaaggaaggggcagggcccagggagcagtggcctggcagccccttcccatgagttggggactagggggcaggtagtgatagtgaggccccgtgccagctgcagcggaggaggcatggttgaggctgcacctctacagagctggcaggaactgggaacaggtgagagccacgcccccttccgagttgaaggggctggagccccactctcccaggcgcagctgctgctgcccagccacggccgggccgccgactgggattcctcgcgctgtcagaggccccaggaagcccccctcccccacaggctcagaagtgcctgctcctgctgcagggcctgtccctgctcccggcacccactctgatttcagagcaaagttgtggccaagcccaggcactgtcatgacccagccaggtgtgcacatgctcagggcggcgctgacatgccagccccctgctgcctcagtccccactggactttgggcaccaacaagcacaggcttctgggatgccaagggggcgctgagggcagtttggcacaggcctgtacgcgcccttcagcatgaacagcctgggtgctgtgggcaccgtggatgtcaggttgatggctgcagaaggcagacaggctcctgggcagaaagtgggacgtccctggtgaagctccatcttcaagtcaaggacaacctgaagcatttcttggggctggatagcttttgtcttttcgatgaccccaaaagcacggaaaaaccagaagtcagctccgtgggtggtgaccccgtggaggggaaatataaaccagaaagtaggatgctgagtgcagactgggaggcgacttcatggtctggactagtgccagccctagcgcctgggacgtgagggtgcccggcaagagggtgtaaaaagacaaaccaatgagtgcgtgggaggcctgattctcatgtcaaaaagggtggaaggaaccacgtgttcatctgacagcatcgtcctcctgtttatttcctcagccaaggactggggactgggagacagtccacttgggtgacggcgaatttctttcaccccgagctgacaccaccttgggcagggggccacagtgagggctgagctggccactgtgtccaggggatcgtgccttgggcagatctgccttcatctccctgctcttcccctctgttttttgtgtatagtaggagcacacgagaattaggaagaacagaaaaaacaagcatctttcaaggttttattgaaccactgccaagaagatgtggaagagtgggttgactacaattgctagacatccgttcattcacttattcattcagttcactggcatccccagctaacacggccaccgtgtcacacttaccaaaaaatggttgggagatttatccttggccaactctgcagaaccctcctccccaaacctcctgctctgcgctttgctccggcagtgatctcaatgacaggattttaaaacgaggtttcagtacttctgcaacccaaatgttcacatcgttaccgcttaggaatctcagttatgtctatatgatatttaagcatgtgtttaaagacacaaaacactttccgcattttgtctgaatagactgaagacttgttgctgagttttcagtacaaaaaaacaccagcgattatcctgaaactgacaagtttgaagatgcaaagtctaggctgtaagaggaattttaaacgcacgcctttaaaatgagacttgtggctaaaatggagaaagggaagggagggaaggaaagagaagaagacgggaggggagaggaaagagggaagaagaggagaaactgacagctgacaggagggtcccatcacaggtacaggagacatcaggtggcctctgatgggaataggagagctgcagccagtcatcctcaccctcccacagctgctaatgagccattgtcaggccttgtaaaagtaagttaaattattgctgatatatcttccttgtaagtaagataaggtgacaaaaggtcactcctcggcgaggtgcagtggctcacacctgtaatcccagtactttgggaggctgaggcaggcgaatcacgaggtcaggagttcgaaaccagcctggccaacatggcaaaaccccgtctctactaaaaatacaaaaattagccaggcatggtggcgtgcacctgtaatcccagctacttgggaggctgaggcagaagaattgcttgaacccgggaggcagaggttgcagtgagccaagattgcagcactgtgtgacgcagtgacggagcctgggtgacggagcaagactctgtcttggaaaagaaaaaaaaagcatcaatcctctaatctaatggatgacacacagacttcataaagcatatttatctgacctgatgggttttttaaataaacttttattttggaataatttttcatttacattatttttaatgatagtaatcacggctctttcatgatgggcttagcacatgtgatgggcaccagcacatatacatatgccctttcaaatcaatcaacagcttgttcagggatgtatggagacagacagaaatgtagtatctggatcattactattaatgctaactattaattttacctctcctagtatttcaaaatatggttatgcaggccaattatccatgcatggaaaaattcccagaaaagggaagaacaagaacaagacaagatctagctagagcaggacagtgatttttaaagcaagataactaatttttaaaacctaccaataaatacagcatttaattcagagtagggttaaaagaaataaaaacaacaaagtaaaacttaaatgtatcactcactaaaattacctgttatattgattagggcataaccactcgggttttcttgacctgtgagcctggacttctcgtgtgtgttaaagcaccgccaaatacaacaatgactaatagcctttttaaatgaatctaagaccccgctgatggtagtatacatcccaatttcagaagtgttaaaatgtgtattttagaactgatcaaacagtaatacattaagctgaacccaatcaaaagtacatttcctgcttatttggataatgatgcacaatgcctggaagagaatgagaaccaggcaaatatttactgaatcaatggatagtctaagaggtgacagtcatctgtgaaatatggaattactcgcagtttgccgacacaccatcttctttcctctctacacttgcctgggacacccctctcttagcctttcattataaggaacagtcagttcaataatacaaataatacgaatctctcttcactatgcatgaagtgatcattccttgcaaactagaaacacgaacttgttaacctccttcaaggatgcaagacgactcaggaatccttccatgtactctgcattcacaaatacgtgtatgtgtgaacttagtctacgaggagactaacaacagcccatttaccagcttcaaacgtgcagggtgtgtgtgtgtgtgtgtgtgtgtgtgtgtgtgtgtgtacacatgtgcttcagggcaaggcatgtgctatataatttattttataagtttactaccaccagatgtacagtgtcagtatcacctgtgtaaattagacacaactgggttttgtattttgcattacctagataagtatttctctgcattagagctacatggaccaggcctatttagctacttccccctcccattcttggaggataaaaacaatttgttgtcctcataggttctctgagcatctaaccctatatatagcaccaagagaaaccaaacagagcactgatgccatgtttgctggaataccaacaaggagagtagaggacaatgagtagaattagtacaaaaataagccaggcatggtggctcacgcctgtaatcccagcactttgggaggccgaggcaggcggatcacctgaggtcaggagtttgagaccagcctggccaacatggtgaaaccctgtctctactaaaaatacaaaaaaagtgcacacatatgtttattgcaccactattcacaatggcaaagacatggaatcaatccaaatgcccattaatgatagactggataaagaaaatgtggcatatatacaccatgtaatactatgcggccataaaaaggaatgagttcatgtcctttgcaggcacatggatgaagctggacaccatcatcctcagcaaactaacacagaaagagaaaaccaaacaccacaagttctcactcacaagtaggagctcaacaatgagaacacatggacacagggaggggaataacacacactggggcctgtcagagaagggaaaaggggagggagagcatcagaacaaacagctaatgcatgtagggcttaatacccaagtgacggattaataggtgcagcaaaccaccatgacacacatttacctaacctgcacattctgcacatgtatcccagaacttaaagcaaaaaacaaacaaacaaacaaaactctgatgccatctctggcatctcaggcaatttctgctttttctaggttttgttttgtccatacacggtacagacttcctccacagagggattttacgagaactagaaccaacaggaaaaacttgggtgagaggtactaacataattaacaaaatgaagaacacgccaactttcctaaccagggaagaaacacaaaacaataaaggaagtcacatttccctccttttcccatcactgaagagacggcagccaaatggtcatgctcacatttggtgcatgaaagtgctctggcagtaatgatctacaggcagtcattggcatgcttatggtcactcacttgcgaccttgtttcttgagtttgtcctaaaacttctttttgaaagaaagaaagactttgacataaaaatgttcaatgtagcttcagaatcacaagaattagaaattacctcaatatctaatagcagggagaccactaaggaaattatagtatgaggccaggtgcagtggatcacaccctagaactttgggaaactgaggcaagaggactgcttgaggccaggaatttggaaccagcctggacaacatagtgagaggtcctgtctctataaaaaataaatacgaaactgatccaggtgtggtaggatgtgtctctggtcctggctacttgagcggctgaggcgggaggatcacttgagcctagaaggtcacagctgcagtaagtcaagatcacaccactgcactccagcctggacaacagagtgagactctatctcaattaaaataataataattgttattattattgtctttgtgttaacctattcttgagactggtttggttctggtgtgtgtgtgtatgtgtgtgtgtgtacacgtaaatatacatatatattgttctacgtgattaaaaaaatacacttcattcatcttccaagtaagttagccttcttgtttccattaaaatgcaggaggtgggtctggttctaccaaccttgctcgagatttatccccaggtcacccccgccccaggactctggcagagctagcgtaaggcagagcactggtggctgatcctgatgtcacctgcaggccacatatgcatctccaccatctccagacgtcggcaatgccacagcatgactctggggatacagcttctagacaataagcagcaagttagagactagaacaatttcacggataaaagacacctgctggtgatatatgacttcaaacaatgaagaggggactagaaggctggcattctgccaaccaacacctaagagggcaggggagccatagagtggggacagtaaagggcgggacactctctcccaacaaccaaggaatagacccacctggaaggcagagggagtttcttcactgggtacaaggaattagagtaagaagttattttttttttttaattagaaacaaatgaaagaatcccaccaacttcactctgtgaactatgattttaacgttaagagtaacaaagatgggaaatctatcaaaatcctcaattttgtattacactgcacactcgtgaaacagttcctaacaagcctagatgaatttcagttcttttaagccaacatttgaaatacaggtccccagtcccaccccttcctcagcagtggcccacttcggtggctgttttctaggagttgttcctggagttggtctggagtcagcacctccagccctcatactgatctcccagtgagatacgtggatctccagagttcagtactcgctacactgatggcactcagaagtttgtggaatgaatggacaaatgaatggatcgttatgcttcactggagcaggcaggatcaaccccctggaagggttaaagaaggtgctgaacgaaactctgcttttcttgccttcatgcttccttttttccaaaagggtaaaaagtagctgcattaaatccctttctgttcagatgtcctagaactgctacaaggcccaccacatatccccctcatctccaactagcacagggtaaatagtaacattctactgtaccacattttctagaatggctgtatatatgaagttacaattcacgctatgcactgctaatgaactttccacaatgccataaatgaaatatgtaatatcatgactcccattttacaaatgaggaagcttgtccaagtttacacagttaacagcggaactgggactccattctgctatactgcctcccagtaaaagtttacatggtgaatacagaacaaatattcaaaagagagaaagaggggaaacagaggtgacagaggatccagtgttggcttaataggtataaacatggtctgagcctgattataggcaaaagaaacaaagaagagcagaaaaaaaggagtcacatgcatggatagcagggtgctacaaggatgtctaataacacagacctgtggcggggagggtcacaggataatggcatgcttaaggcggcccaatagacacaggagaacactgatgcttgctggcaggctgggaaatagaggtgccttgaagaatccatggggagcttatactggaagtctgttttgggagtaaaaaaggatgaggagtgtaaagttaaagaaaaggactgaaggccattagatgttcttcagcgagcatactcagctgttaagtcaaaaatactgctgagctgaggccgggcacggtggctcacacttgtaatcccagcactttgggatgccaaggcgagcggatcacctgaggtcaggagttcaagaccagcctggccaacatggtgaaaccccgtctctactaaaaatacaaaaaaaaaattagccaggcatggtggcagatgcctgtaatcccagctactcgggaggctgaggcaggagaatcacttgaacctgggaggtggaggttgcagtgaaccaagatcgcgccactgcactccagcctgggcaagaaggtgagactccatctcaaaaaaaaaaaaaaaccaacaaaaaacaaaaacaataaaataaccaccgagctgaaagagatgggcatacaattcctacagcagaaggaaactcagttctccgggggcaatacttctcacttacaacttgagtgtgctcattgaagaaaccttggtgacctttagggattttctttaaattataccccctatccttttcgtacccccaaactcagtggtaagtatttttctttttctttctttcttttttttttttttgagacagagtctcactgggtcatccaggctggagtgcagtggcgtgatcttggctcactgcaagctccacctcccgggttcacaccattctcctgcctcagcctcccaagtagctgggactacaggctcccgccaccacacccagctaattttttgtatctttagtagagatggggtttcaccgtgttagccaggatggtcttgatctcctgacctcgtgatctgcctgccttggccccccaaagtgctgggattacaggtgtgagccaccatacctggcctcagtggcgagtatttttctacagttgtttcatgttctgagaaccaggagaaggatatttaatgttgttgggtgtgcaagttcaggtctgattcagcgggttcagaagtaactgaataacagcagggaaccagtatagggaatatcaacaagggagctgagctttgctaataggccataatttatttaaaaaaatttagtctcataactctagagttcagtacttggttcactgatggcattcagaagtgtgtggaatgaatgaatgaatgaatgaatgaatgaatgaatgagtgaataaatggttatacttcactggagtcggcaggatcaacaccctggaaacgttaataaggtgctgaacaaaactctttttttcctttattcttccttttttccaaaagaagaatagcctatgaagtaattcttcttttccctctaactgcaatagatacataataccatattttcactaacagcaaaaacaattcacattagaaggggttcttccattcaccagagttaattttttaagtggataagcaattaaagatgccaagtagattaaaattgatccctagcataaaagttgtgatcaataaaaaaacaatctgtaaatttgattgcataaatcctttttacttaagtccaccataagcataattttcaggatcactactttgatctcacttactggaaaataaaatgcaataaaaatattgctgcaaaacctagtttctagaaaataataaataaaacatccattttaaaatttttgaaccacccatgggagacaaatgcacaatgattagactatgctactactaatcaaggaaaatgcaggattaaaaagtcccttgggatctagccaagttcctaaactaacaggagaaatgctttctgaaatgcagcttgttttatttaactggttccaacggccccttactggttttcatggtttggcaactttacacattgtctttggattcttgctgttaggatctagctcacacatcatccatctctcctcctgctcacttacgcatctgttgtcagttctactggattcctgtgaaactccaaatagcgtacttcactgttttacctatgagatgtatgtcttgctgctcagtttgtatgagaagcacaaccacactcagcttttcagtccctttcccctcctctgcttccccgcccacctctgtcaccctttaccttgtcaaatgtagtaacattcacactctgttcagtagcaactgttatctttcatgatttgtctccagattcattaagttgacacattccaattttgtgtgtcatgacatataaacataatttacagtattaactatacagatgatacttattacaagagaatgcataatatacaggtattactataaatattgtcatattactagatattactgaatattaatatactatacagatatttgtaactatgcagacatttataatcctagtttgttaggattacatttccttctcaatgggttcacggtgccatccaatggaagatgtttctagtatcaaaataaaaaagaccctgtctcctccctcatgtaatttgcttttatttcaagatactaaaaaacctgagagatctccccactctattcccttcccagagaggacttacttaagttccagagtgaagccagcccctctccccggccctctcccgcagagggaaggaggggcaggcacgcagctacactatatgagctcacgtctgatggtttagggaccctctcctgtagtacaacccggctgcacatgcacagggttagaggctgaactgtgtccccctaaaaattcagatattgaagtcctcaacctcagcacctcaaaatggaactgtatttagagacagggtctttccagaggcgattaagttaacatgaggtaattcaggtgggtcctaatccagtatgactcgtgtccttgtaagaagaggacatttgaacacagacacacacacaggagaggtgacaggaacacacagggagacgacagcctctacaagccagagagaggggcccggaacagagcctctctcacggcctcagaaggagccagccctgctgacaccttatcctggacttctggccttcagagctgggagaaatgaatgtctgttgttgaagctaccccaggctgtggtactttgtcccagcagccctcgcaagataacacacagagtaacatcagccttttcccatccagtcctgtggtaacgggagcattaaaaagctctgcgaggaatgcgtgctttgttcttagactcagagatcccgtgtttcttgtcagaatatatctttctctgtatctgtagctacagacttagcagcagggagctctgtgtagcacatagggcttgtcaatagacaggtttcactttagtaaaagtggagacaggggccaggtgcggtggttcatgcctgtaatcccagcattttgggagactgaggtgggctgatcgcttgagcctaggggttcgagaccagcctgggcaacatgatgaaacccgaaaccttgtctctaaaaaaagtttaaaaaattagcagggcatggtggcacacatctgtagtctcaacaactctggacaagcccctggaagttgaggctgcagtgagccatgatgatgccactgtactccagcctgggcaacagagtgagaccctctctcaaaaaaaaaaaaaaaaaaaaaaaagggtagacacaggtgatccctacatccaggatgaggaggcttttactctgaggtatctaccctagttatccccagaaagccattccatttctttaaagggaggaatcaccctaaggcagcttcatcattgtcatcctccacctgcttttcatctccccaaattcggtttaaatcttatctgctgataaccacctttatttcctttgatgttgtagatgtttaactattagttttgtataatcttttcggagggttttaagaaggggagaagataaactcaacacgtgatcccatggccttattcaagtagaagctccaatctattttttttaacattgtttcctgatattaaatcaaataagagatgtagggttctcctgattacaattaactctctcatatggctaaataaggacatgacaagttatgcaaaacgtttctttaaagctctcttgaaagtgttcaaggaagtgggaagacatagaaatctttgagggtagccaaagggaaggaaataaattacatgtctcagaatatagaaataaagttactgggccggcatggtggctcacacctgtaatctcagcactttgggagggcgaggtgggcagatcactacaggtcaggagttcgagaccagcctggccaacatggtgaaaccctgtctctactaaaaatacaaaaaacattagccaggtgtggtggcatgcacctgtagtcccagctactcaggaggctgaggtaggagaatcacttgaacctgggaggtggaggttgcagtgagccaagatcatgccactgcacttcagcctgggcaacagagcaagactccaactctaaaacaataaatcaatcaaaataaagttattgtatcacagcagctatgtcatctggaaacaaaatattctatttaggtatggagtggtttagggttaggtctcctttatgagtagaagggaatatatttaaaattttttttaaatacaatttcctatatttcagtttcagaactggttctaaatcactggctctgagcaatttcgctagaaatgctccctaatgacctgccctgagctaatagcatcgagatcattgattagacacaagacaaggagcccaggacacagggcacagctaagctttcacagctcagattttcagcctttccatcaccacggtggaaggggaaaaaaaatcctttcagttccctgaaggatgtgttcttgcacataaattggcatttaggttcaattagatactgaaggcctggtcctttaaggccagccgggtgggttgcggctagatatgcctcggcgcctctcctctgtcctattactgggcaagtgtcctctggctgtatgtgctccaagttataacctaacgaaagggcaaaaaggtagaagagatggctgatgaggaggaagaggatggaaagaaaaggaagacaaagatttccctgactatgcacatagccagaatctcagcaggtgaaattacacagcacagagaatctcgatgaagattctaatatagatcacacaactctgaagcttttctctttaacatgagactcagttaagggttggaagggagctggtgagcaatgaaacagtaaagtacaagagggctccagcttcccgacctcactcacagtctaggctagattagcacatgccagacacagttctgttcactttacagccattgctcatttaatactcacaacaatgacactcacagtatcttcactttacagatagggaaaataaggcatagaaaggttaagtgacttgcccaaagtcacacagctagtccaaggcaaagcctcagctctgacatgggaggccattccctaactctttgttcactgttttctttaaaacatgatcttggaattactttctctcatttagcaatatcatgctaattcaagagtcagtaaaatgtgtccttgaaggtaggtacaaaaaaggatgttccctccaaaggcagccctcatcacagcctgaaccttcaaagggttgtaaggagcctcagatgcacagctgccttctctagcaccacacttttggttccactgcttagacaactaaggagaatgaagagcttgttccttattttccagcttctagaagggcaaaggaagggaataccatgagacagaggccacacagcacccaaaaatagaagaccattttttttttttaggcaaggtcacccaggctggtgtacagtggcacaatcagtccatagcagccttgacttcccaggctcaagtgatcctcccagctcagcttcccaacctgctgggactacaggcacatgccaccatgcctagctaaatttttttttttttaattttagtagagatgaggtctcactttgttgcccaggctggttcttgaactcctgggctcaagtgatcctcctacctaggcctcccaaagtgctaggattggccgggtgcaatggctcacacctgtaatctcagcactttgggaggccaaggtgggtggatcacttgaggtcaggagttcaagaccagcctggccaacatggtgaagccctgccactaataaaaatacaaaaataagccagatgtagtggcatgcacctgtaatcccagctactcgggaagctgaagcaggagaattgcttgaacctgggaggtggaggttgcagtgagccaagatcatgccactgcactccagcctgagggagagagttggagactgtctaaaaaaaaattatatatatatatatatatatttgatttggacactgactctgtatggagattttaatattcagtaaaggcagaataagttgtggaaatacctcaaataaacagaagaggataaggcatcagtcaaaccagggagggataaatcagataaaatgaagaagttcaaacataagcaagtggtaaaggagccaaagattcccaactaaaatgactactggaacaactgcagcttgaaaatatttcctgcgatcaaaatttgctcacgagctatggacgtgagttttgggaagagatgattctcctttacacaactgcccggattgaagaggatttgctagaatttagtacagtggacctgtgaatgacacaggttggaactgcatgggtccacttatacgtggattcttttccaaccaaacgcagactgaaaatatagtattggtgggacgcaaaacctgtaatgtacagagggctgacttttcctaggcgagggttccacagggctcactgccagacttgagtacgcacggactttggcgtacgccggggtcctggaaccaatccctcacagatactgaaggatagctgtatttatcccctgacacactgcagctcttcatgaatactgggagtcactatactcacctaagttctacacactgaggtaatgaggttccagattccaaatgtggaagtgaacttccttcttttctccttgtgagtgtgtgggagtctgtgggagtgtgcatgaggggagaaaagggaatgtcactgagcaccagcatgagcatgtccaagtgtgaccaagatgggccaagcattgaaagtagccaggtgggcgagtggccaagcgccagagaggccaatcccaagagtgactgagcccaggggtggccgagcctgacactgtctggctgctttcagtggtcccacagattgaggctgtgtatgaagagactcttccagcaaacacttttttttttgagacggagtctcactctgtcgccaggctggagtgcagtggcacgatcttggctcactgcaacctctgcctcctgggttcaagcgagtctcctgcctcagcctcctgtgtagctgggactacaggcacatgccagcatgcccagctaatttttgtatttttagtagagatggggtttcaccatgttggccaggatggtctcaatctcttgacctcgtgatccgcctgcctcggcctcccatagtgctgggattacaggcatgagccaccacacctggccccagcagacacttctaaggcatcctattctgaggtcaaaaatacatttttaggctgaaagatgagaataacttctttggagaaagcaatgagcagcaggaagtgtggggggtcaggagttaggctaagcactctgacacctgttagaagccttctcgagaacagaagattctcgagattcccaggtgagggtcttcagcctcatctcacccattccccaatgtcctggccggacaaaagccacaggctgggggaagagccatttctagcagagcaggcaactgcttctaagatttaaagtaaatgggggattccaagacgtctgattcagatgatcagtaaagtcactgatggtttagtctttcctaaatacagtcataaagattttaatttcacattatgtcaagagttttatggagccaaggatcttttcagtacgaatatgcctatacaaaccccacagaaatcaggcggcaaaagcaataatcataactatcaccttttgggtcaaaaacttgattaaagccaaatgacaactaaaatgtattttattagcagtaagatgaaatccagagcatatgtcaaagctggactatgaagtcataatttctctagatcacagttggaagcagtaattttatcactctgtccctccctagcctgtaaatccaaatatagttcagacagcagctctgggctgcagggtagtatcctactcactgtgagactctggggaggagctccactctcactggcccaggcaggccacacccagcctccctgctctcccgagtttatggccctgggcacctctcccaatccagggcagaatcagctgtcacaggagtaagatgctgccacacaccctggatcagctgtccccagtaggcatgccatggagtagtctaattagcctctgtgaagatgtcatgttttgtgagcaatgaggaggacctagacaattttagacatgagaacattccttcgggcatgtcagaggtgatgctctttccatgggcccttttgtgtgttcttaatacccacaaagacctgattcccatttttaaaatcaaaccaggagtcccctggcttagagtggccttctacaccccaccaccaccctgcccacaactaacacatcaccttacccaagaatgtcatgcaaatctgctcatggtctctccccactcctatccccagtgccacgtccgaaccttcattcttattacggtttgcttgtattcgtagcagagtcccacaaaagtcccccgagaaaatctcctagtcactgtgacaaaactattctggaacacggccccacttacacagctccatactggtaagggccgatgtccttccacagtcacctctcccactgcaagacaggagcaagagctacacttaccctggggctgcaacaggatgattatttgcttaccaggacagtgaaaatcctgagggaatttttttttattatactttaagttttagggtacatgtgcacaatgtgcaggttagttacatatgtatacatgtgacatgctggtgcgctgcacccactaactcgtcatctagcattaggtatatctcccaatgctatccctcccccctccccccaccccacaacagtccccagagtatgatgtttcccttcctgtgtccatgtgttctcattgttcaattccctgcacagcaaaagaaactaccatcagagtgaacaggcaacccacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactgctcatcagggaattttttttaaggcggtaagtgtcaaggcatgatctaagcttctttctcatgtagtcagaactggaccaaaattgcctgttgaatgtcaataaacatataaaaactgcacggcggctgggcacggtggttcacgcctgtaatccagcactttgggagactgaggcaggtggatcacctgaggtcatgagttcaagaccagcctggccaacatggtgaaaccccatgtctacaaaaatacaaaaattagccaggcgtggtggcatgtgcctgtaatcccagctactctggaggctgaggcagaagaatcgcttgaacctgggaggcggaggttgcagtgagccaagattgtgccactgcactccagcctgggcaacagagcaagagtccgtctcaaaaaacaaaacaaacaaataaaaaactgcatggcatttgacattcttggtattgggacctgacctgcttattgttcagaaagctatttataaaagttttgtgaaaacctgaagcattatacaaactatatgctatactgtaaagttttaataagtggggatccttttaaatagaaacttctgctaataggcaactcgaaatccccaactacacatcatctttctactttagacatttaaaaatacagcacacaaaaaacttcatcttggccatgtccacgtcaagtaggaaaaagtccaaacagaatgaaagtgtctgaattataaatccttgtgaaaatactattaatcaagagggaattaatgttaacttatctagtgggtactattatctataactctttaatatcaaactcacaaaattagcagcaggaatataattatacttaaaaaaattattttcttagtaaggttggcccatagaagaataaggattagtaagatgcacagtggtcaaacatgaagaaatgagtgaattttagggaaatttgcaagtcggctgcaatcatgaacattgtatcaagccaagtaatgaaagccactcctgcctgggtgggctcggtccagcccagcccctgttgatactctgatgcattctgcagctaaccaagttcttacagcggagaagggaagaaatggcaacaaaatacacattgaaaacaaaataaatatgtttcctgaagccaatatctgaataatccttaggtaatgaccatttatacacttgataagtttcccaagtttttctttcctctttcttaagtaaaagggaaatccaggccaatttttaagccggataatatttagaaactattttttttaggtcatttcatcccatttttggttgactagtgtaaccaaggcagcaactggatttcaaagcagcagaggaagacattctgagctcacctggagcccaacgctgggacgcagcctccaccctcccaggaaactagacacttacattcccttgccctcttgcccttctgcccttcctgccaccaggtagctggtcacaatgggagttttctttctttctgcagtggggtgaatgatcacacacacacacacacacacacacacacacccccacaaccaactcctagtacccacattctgtaaatgtttacttacttggaaaaagggtctttgcagatagaatagaattaaattacaatcttagccaggtgcagtggttcatgcctgtaatctcagcactttgggaggccgaggcgggcagatcacaaggtcaggagatcgagaccatcctggccaacacggtgaaactctgtctctactaaaaatacaaaaattagccgggagaggtgatgggtgcctgcagtcgcagctactcgggaggctgaggcaggagaatgacgtgaacccgggaggcagagcttgcagtgagccaagatcacgccactgcactccagcctgggcgacagagcgagactccgtctcaaaagaaaaaaaaaaaaaaagagagagacagaaaaggagaagacacacacacacacagaggagttcacatgaagacgggggtagagattgcagtgaaatagccacaagccaaggaatgcctaaagccacaagaagctggaaggggcaaggaacggggcctcccctggagcctccagagggagtgtggccctgctgacaccttgatttcagacttgtggcctccagaaccgacagagaattattttcagctgttttaagctgccagtttgcaggaatttgttacagcagcaccaagaaacgtacattccagatacacagatatattactctaatttttggagcagcaaaggagcatcacttaaacagttaacagggaccaacctcccgtctttagagcaatctaagcatttgttctctacaattagattaaatgggattaaacacaggcactgcttcacatatgaaattgctgtgcaaatacacacggctgaaaaatacgagaggtcaatggacagcattagcatgtccacttcatgaaaaaatgacacacttctccgtgttggtttagtggatactggatccagtccaacgtgaatggctcactttcagaaatgaatctgaaactgctgaccatcttctttggagtcacatgctaggaggtagcctgggaagaggcctgactctgaaatgtctcacacacactgtaaccactcactatttttgcaagaacttgcttttctttctagatataaacataagtacgctttgctcactgatggagtgtaattcttgaaagaagggagacgggagaggtggtagcccagggaagaaaggactgagggagagcagatagcagcagatgacctgagaggggaccagatatatgccagaaggaagaacttcaaagccaacacacaaaatacaggcaaaagaaattaacaggcacatcacagaagacatcccaacagtcaaaaagttcttaagaagatggtccagctcactggcaatatcctacacacatgtttctgaaaattccaaaatgtcttcagacagaagaaccttcaaacccaaatatggatccctaagatcattttccaacccaactacattaacacaagtaaaactccagagagccacatgatgctgcctgtgaacttaaatgacaaattctaacgttaacatttatttcgctggaggccaagatgacgtaataacaaaagtgttatgtagcttataaatggcctacttgtaatttgttagcacaattttggaagtgctttccaaggagcaagaaaaacttcaaaacataaacaaactaatcttcactatggctccatcactcataataaaggttaaggatgtaccttaaatagctcacaaacaggaaaagcatgtgtggatttctttgagaagcttgtaacatcttgtaactttacttatcctagtagaagctttattgctaatttttacataatcatagaactacatgaaatagccatattgcctaacatttatacttggctttaaaaaaattactattcctaaatacaaaaataacctatcattagaaaaggtaggtgaatatttaaaaaaatttttttaaaataataattcagtctacctttagtgttgaagtactgccttcataactattgatggggactccaaaaatatcctctatggaaaaatattcaggtatctaaaaaaggattcatctgaagaaattttatagtaatggtttcctttgaaatatttttggacctcttatagtgaaatcatgagccacaaaaataataaatgtctcccatattttaaaactaagtagtgacatatcgtcattataaagattataaagtaatcttcctatatgatgagactaaattacaattttgcttttattttatttcaattaattaatttttttgagatggagttttttgctcttgttgcccaggctggagtgcaatggcgtgatcttggctcacttcaacctccgcctcccaggttcaagagattctgccgcctcagcctcccgaatagctgggattacaggcgcccaccaccacgcctggctaatttttatatttttagtagagatggggtttcaccatgttggccaggctggtcttgaactcttgacctcaggtgatctgcctgccttggcctcccaaagtgctgggattacaggtgtgagccacagcaccaggccacaatattgcttttagattaaatttgtaatcttcagtggaagaaaaatccatgaggatttttgttttttcaaagaggggtgggacaacaatataaagatgaaactgtttggggtgggtattttatagtatataaattatacctcaattaaaaaattaaaatgaccttaaattttaaaacgacagggacttaggcgtgaaaaaaccttttggaagcatttagttcttttccatcttacagccataaattaaaggtatttcttaatttgctaaaaatatttcaaccgaattggcttatatttaagttttaatgggtcaaatatgttaaccaaggatattcttttggcttttcggggaatttgtctgtcttcaaacaaaacaaacaaaactaaaccactgtccgaatagtagagacaatttacaatgtgtgtcaagatccagagttcatgaaatgcgataataaatagcccaaaccacgagtacattatttattattactgctctaagagtaaaatgctatggtcatgtgaggtctgtgtaaaggataggacgatggcctctgccacgtgatctagaagccacataacgcaacttttgtggaaagcaagaggattcaatctgtgtgtgaagatggcaagggctagggctgcacaacgtggtggctaagagcacgggagtcaaaatcctaggctgggaaacagtatcatcttgggcaaaacactatcatcttcaggcaggcttctcatctgtaaaatggggataatgcaacgtacgattcttgtgaactaatcttgtgaaagcagtaggcaaacgcctggcttcacaggcaactaagacgtgagctatgttcctcaactggctgggctctgttctgcagccacagggtaggcctggcatcccagaaatgcttgtcattgataacacggggacatcaagtcagagaattcgaatgtcactcctgaaagtctaatgaccctcagctgtcatccacagctcattggaaaactgctaggtaggacccactaaggctgacatatgcatacctcacaacccagcaattctactcctgggtatacactcaacaaaaatgcttacatatgttcaccaaaagaatcagatggttcataacagcatgattcataatagccccaaaccagaaacaacccaaatgcccgttaatagtagaagataaacaaattgtgggatactcacccaaagaagtattttatggcaatgagaatgaacaaactatagcaacaacacagatgacaagtcagaatgcaagaggccatggtgtatgtttccatcggtataaaatataaaaccaggcaaaactaagatagcgtcagaaatcaggacagtgttccccaaagggaggatgcagatgggaagggacctgaaggtgcctctgactgctggaacccatttcttgatctggctacatgtgagagagtttaggccgtaaaaattcaaatgctgcaccctcaggatgtgtgcacttttctggaggcatattatacttcaataaaacttctaagaaactctctggccaggcacagtggctcatccctataatcccagcacttcgggaggccaaggtgggcagatcacatgaggccaggagttcgagaccagcctggccaacaatgcaaaacctcatttctactaaaaatacaaaagaagttggctgggtgtggtgacgcacgcctgtaatgccagctacttgggaggctgaggcacgagaattgcttgaacccgggaggtggaggttgcagtaagccaagattgtgccactgcactccaccctgggcaacagagcaagactcagtctcaaaaaaacaaacaacaaccaaaaaaactatctttattattgataaaacaattcaaggccacgaatccagggtagcccacaccaccctactctgaggccctgaaaaattctgcagacctacgtcagcctaaccagcaggatgaggggccccgggccagggagcaacatcctctctcaccaatgatctctttacatttctaagcctggcatctctctgttgctttgcacatgtctgaaactgagcagttcttcctgccatgtcttatcttctagactttggtggccatctgtatggaaggaatcttcaggtaaaagacacgccacaggatactaagctgaaatgggacccaacttcttttaattaaacacatcttgcctcaggcaagttatttaaaagaaatatctgttaagatactagaaagaatggtggctcacatctgcaatcctaacactttggaaggccaatgtaggaggatagcttgagtccaggagttcaagaccagcctgggaaacatggcaagaccctgtctccacaaaaaataaaaaattagccaggtgtggtggcatgtccctgtagtcccagctacttgggaggctgaggtagggcgatcacatgagcccaggaagtcgagactccagtgagccatgatcgtgccacagcactctagcctgggcgacagagagagaccctgtcctccccgcccaccccacccccgaaaaaagaaacaaagaaagaaaaagaagtatctgttgagatattaaagatacatcttttaagaaactacaaaagaataatttgtacaaaatttaaatgaacactagtaatgtacagaattttctaattaggcatacatcatatcctactaatcttagtgaattcaaagttactagtgtgcgcaaagttattttaaaatataaagcatgctggaaaacaaaagtttctgaaattctgtacattcacttctaaaatgtcaaactaggctgagtgcagtggctcatgcctgtaatcccaacacttaaggaggtcgagaggtaggaggcctgcttcaagcccaggagttcaagaccagcctgggcaacaaagagagaccccgtcactatgaaatattctaaaaaattacctgggtttggtggcatgcacttgtagtaccagctgttgggaaggctgaggcaggaggatcactagagcccaggagattgaggctgcagtgagccatgatcataccactgcactctagcctgtgtgacagagcaagacactgtctctgaaagataaaatgtcaaaatgactacttatttggatcactatgcatgagaaatagtttcttctcaaagtaaacacatgctcatatgagaatatttcagtcaataatgctccctctctccggtgcagcacagggaatgtttagggcacagaaactataaaatagtgtaaaggtggatacgtatcactatacatttggcaacacccatagaactccgcagcacgaggaatgagccatcgtggaactgatggacttcaacaacaatttatgaatagaagctcgtcaattgtaataaatgtaccacactaatgaaagatgttaataatagggggaaacggagggggattcggcgggcgagacagaaggacagggagggagtatatgggaactctatactctgttcaatttttctgttaaccttaaactgctctaagaagtgaagtctattgattaaaatataaataaataaataaataatgcttcctcccgccttctaagatgcccacattttacctttgatcatttctgcaggaaacacctagtttagaatacacaggccacaggaaagaacaaaagctttcactattttcagggttttgtgcttgtatgtgtgaacatctttgtcactcacggtcagtgatttatacagacatgatcttaacaattcagtatggagaacgactatcttttttttttttttgtacttggctggatactgtcctgtgtaagaaaatatattggaaaatgtattcaaataaaagcaagaataagggtcgactttaataccgtggggagaaatccgatcgattgggtccataaggaaagatgtatgcattcggtgctccctaattacaactgctttggtgggcagcagcagtggtgaaacagatgttggagacctattaaagacggggtttcaaacatctgcttacaattttaaggcaattgtaaatacagcagagaaggtcaattgggccaattaaggccgatgtgcaaatccaccactgcaggtttcttttcaagcttacatggacttgattttttatgctttcattttctacaaccacaatttttttttaaacccaggaaatgggtttaataacttttgtccatttttgattgttattcttcttaaatggaagaaaactttctgttcaaagaagtcactgcacaccttttgcctcacgatgactcattttccttccctcccctcccatgctcacagccggccactcggccccgatcaaagcgggttccatattaccagggaggtgaggaatcccgaatactgggcttcctttctaagccataatgaacatgggcaagtgtcaccttcagaaacttccgtgccgcggcacacaacagtgctcccagctgtacggatgggactgctgggagcatttgctgcttctaccctaggcaccttcaccagcctttattagaaaatcatgagtttcatgaaccgtaaatacaacggcaaactgcactatccctcttctaagtaggtaaaactgaaattctcatggtatgcaaggctcattcatgtcagaggcagtagcagggacacgctcccagttaattccaggccagtgctacaaagtctaaggcccacttgctgctcaaaaattggcccccagtggtggagcgggacttagagactgagggtcggcaaagaggcagagcagtccagctcaacattactaggtcatttctcttaaagctgcacgtgtaatcgttacttgtgctaagtaggtaaaaaaaagtccaagtatcacaggcatcaaaatggcctcctctgggagagtaagaaataagcctggcctatcttccttcctatgagctctgtgatggccaccggagtatattatgccacctcttcttggtggcccagaccactcaactgctctctttatatagagaaaaaaaccaaggttgggcaaacctagattcaaattctgcacttcttagctgagtgacctcgaagcctctgtttcctcatctataaaatgggaatattgccatttctagagctctaaaagttgatacaaagtaggtactcaataaatgttgagttcctaaaggtgatacacagtaggtactccataaatgttggtttcctaaaagtgatacatagtagacactccataaatttagtttcctaaagttgatgtgtggtgggcactcagtaaatgttggctttgtaaagttggtacatagtaggcacataataaatgttgcttcctaaagttgatacctagcggcagtcaataaatgttggtttcctaaagaaaatacacagtaggcactcaataaatgttggtttcctaaagttcctatacattaggcactcaataaatgtcgaggtcctctgtcctcctgagacctttgggacctccaccaagacatttccaaggggcctagactggtgtttccaaccaggcagggcagttcccctgaatgtttctatttgtttattttcggggggaggtatatccagtttttgtgctgttgttgatattgttgttgttattatttgctttgtttttggcgaaacaaagagtggataatgaaactacaaaaaaattctaaaagaagaatccttgaggcagcagaatgggaagaaatagttttcagaacaaagaaaattctgaaggaaagtcaatataccgcacagaaatctaggttgagaaagaactgtttttcccttacatctcctttttacttttcaaccttgaggctcagctcactcaggtctgagcaagaataaagagtcctgcttgtctaaacaactgctaaatctgaaggcaaacagctcaactccatgtggttcttcagcaacattcctgtcaacaaaccccgtcttggctcgattggtccaacaataccagatttagagccatccgctcatccttcttccaggatgcaaggggattttcaaaaggccattccaggaacagctctcacaatttttgtagccttttcaaaaacacaaaaaatctaattcatttgctgcactgcttcagccatccagcttaaactaattttaaaatctctccttttgtaaatagagatgttagaaacgccaccacagccacaatataaaatgatggtatctttctcttttgtaatcaaattaccatcatttattataaagcttcagacagaaacctgagagatgggcaagacgacctggcgttcagaagagagagatggcatttttgacattgaaataaaggcttggagggcataaatccttttttaaaaatcaagtatttagcacaggatttggtataaacactgatcaataaataagagccagcagtcatagcagcacgctagaatcaacatcatctgagttctagcacagactcgtttctatgaatcattgaaaaggaatttcatggtgccagcagcatcagtacagaaagtcagaataagcacttagacagtaataccagcaacttatttactatcctacgttagagtcagtttgctggattttatataaggtaagtaatggatatctaaggtactgtcaattaaaaaaagttctccaaagtaatttttatttaaagttgcatatgataaactgtaaaaccaaaataacatttgggtcaaaactccaaagagttgggctatcactaagctagaaagagaaaaacagcagaaagaggattttcttgctgatatgccaaaaacgtgactctatttctttcaacagggtttattgttttcttcctgttttacaacagcaatacatataagaattttttttaattcagaaaattgcagagataaggggaaatttctcccctaattctattccccaaagagaactgcctttcatgtattctggcaaaattctctcatcttctttcaatgcatgcagaaaccttttgtttatttacttttcgaaaacaaaattgggtcatacaataggtattgttttctgatctgcttttctaatttttaaatgctgtgcaacagttaatcaaacggatatacaattaacctcccattattaaacaccaagaacagcttctatttttctgtattataaatggcaaagcgacgaacatccacatatataaaactttgcatcacttcatctacttgggttaaattcctacaaactgaattgttgggtcaaaatacacgcacattttaaggtatgtgatatacaagacatgccagaaaaattgtgttaattctgcacaatgtatgagagtactcttttctccataactttgcccacataattgttgttttttttttttttttgaaacagagtctagctctgtcacccaggctgaagtgcagtggcataatctcggctcactgcaacctctgcctcccgagttcaagcaattctcctgcctcagcctccggagtagctgggattacaggcacgccccaccacgcccagctaatttttgtattttagtagagaggggattttaccatgttggccaggctgatcttgaactcttgacctcaaacgatctgcctgcctcagcctccaaagtgctgggattacaggcttgagccaccgcgcccagcctcaactgtaaagctttttgtatactgaaaatattaaacttttatgattatattccaactatttttcctccattagtaacctgtttcatagtgctgcttaatgcagagaattttattattgtagaccaatcaatctgcctttttcttttatcattttcccttggatttataagcttagaaaggcctttcctatcctaagagcaaatacaaaatctgctttacatattgaactaatattgggatggtactgatttttattgcaatatttgagaaggcaaaacagagtttaaggaaagaaaaaagaaatcccaaaggatggggaaagaggtgagaaggcttctaaaaataacatttggcagacaccggctcaatgcaagtctaatttgcttcttagttaatgaaggagaaaatggagatggcgaagaaataaaaggtccattctagaatggcaataataaaatcccctgtgaagacaataacaacattcttgttatacatggaaatctaatcctaaaataataacgcatatattgatataacagcactgtgaataaattccatttaagctatgttattttaacaatgacccagaaaatgttaaactaaagaagtttgttacatgcctagtttggcccacttagagagccacaggttctcagaaacatatctggaaaaggcctttttgtctgcaatcaatgcatccatcatggtgcaccaactggctgactacaaagagcttacacataaatatatgtgcatatacatatagattttacttgcatcaaaaggtaaaaatagaatttggtttattttgtaaagccattcaacgtaatcataatctcattaggatccagcagaaaagaatgactctggcagctttttgctgggaccctggtacctccttctgcgggtagaaaaggagcccctgggggcatctgggtggaaggaaggctcggaggctggagacttgcttgcctggatgccagccagtgtggcaaagatgtccagggcagcctagagtttctgctgggggcaggggtaggggtggtcagggcacagccaagtaccgggcagtatccaccccagcccccactgaactgccagcatccggctctgcctgtctttggcttctggcttgctttcctagcctgattctctgaccttcccctcggcattgagagctctccaacattcatccttccagtgcatttcttttctgcttaagtggcccaggtcaatttctgttgtttgcaatcatgaaccttgactggacaaactcttattagcttccggcagatattaaaagatgcatgagctcactttgatgcaaaagggcctcagcatggatgcacgccttatctatgagaaagctcctctgcttcctctcctggcctccttgtacttatctcatggtttatacttgattttgttcctttcaactttcttcttttcatgcccaactcccctccctaaaatgggtctggtggcagaggtgaaggcagagagcagaggtgagaagaaaataggaaagtgagtaacttttggatattacttttcagaaaacattctgtgtggcagtggccactttcctgtcaaaggcttaacatttttttcctataaatacattaaaagtgagtcagacttggatttgcaccttaacattattgccaacactttaaataactatatgttctctacaaatgttctctactaaagaagggactcggagaatggagggagcaaaaaggagaatggggaggcaactccggggcagctcacctgtctggccctgtgtggggtttcctctttagaattcagcaggctgtagggaaggtgaacactgggtactaggtaacccctgacctggtcagggagtctgagaaaatcggagagactgctctctatcctgcacccccaagccccaagctccacaggcttgcagggttgtcttgggaagcccctcccagaggccagccccaattcagcagggtgacggggcatggaccacacacgcatgcctgtccttagcgccttgagtccggagacccctgttcctcccagttcccttccttgtggaatggcgaagggagaggtgtccccagggagggttttggaccgtagccacctcttaagattctggggtcgggggacaagtcctgagtccaagggaatagcagggtgacactggtcaacaggtatgtgagtcctggttgaattcttgccctcaaatgttcatgctacattttctgtgtcccttccaccctcaatctacagcgaggagctcccctatcctgggccagtcggggtctacaagccagccagggaagcaaagggagagagggagaggccttcgaggacactacccctgctggaggggtgaggcgaggatatgccattgttgaggggctgtagcctacggccacaggtgatgggcagggtgggttaggaactgtgtactccaaaactggttgtggtttctctcagcaaaagctttttgtacctcccctccctccatggaaaaacaaaaaggttatgagagagaaagatattaggttaagagccttctacatttcaatagagctaccatacaatccagcaatcccaatcctaggcatatacccaaaagaatggaaaccaggatactgaagagctatctgcactcccatgtttattgcagcctattcacagtagccaagacctgggagcaacctaagcgtccatcaacagatgactggacaaagaaaacgtgctgcagatacacaatggagcactatccagccacaaaaaagaatgcgatattgtcatttgcaacaacatggacggaactggaggtcattatgctcagtgaaataagccagacatcgaaagacaaacattgtatgtccttatttatgtgtgggagctaaaaattaaaacactgaactcatgttgatggatggtcatcagaggctgggaagggtagtggggggcagggaggtaggtggggatggttaatggggacaaaatagtagttagaaagaatggaaaaaacctaatatttgctagcacaacagggtgactacagtaaaaaatattttaattgtacatttttaaataactaaaagaatataattggattgtttgtaacacaaaggataaatgcttgaggtgatggacaccccatttaccctgaggtgattattacacattgcatgtctgtatcaaaatatcccatataccccataaaatatacacatactgtgtacccacaaaaataaaaaataaaaattttaaaaagcttaagagtcctccacatttcagaaacatatatttttaaacattaggaaaaaggtagaaaaacagtagtctatggccgtaagagcccgcaggcaccctgcttgtccgatcacggacgctaagcggggttgggcctggctagtacttgcatgggagaccatgtaggaatgccgggtgctctaggcttaaatttaagtaagtctaagtaatttaaagagatttttttaagacgacagattataagtcaaagtgccaccctgtggcacccatgactgttcctgctgcagagatgctctgaggatgccattcgttctcacatggaattctttcatgaagatcccaaagaaattcctgtctggtctcaccttccagaatacatctacttttttctaagcgtctctctaagtttaatctgtgacttgttgacttctttacatcagctgttagtaaatctaaagacaaattcctaactgatgagataagctggattacctgaacattaccatggagcccctctgggttatctaacacgggaagaccagaggctttctctcctggcagagaggaccatacccagcttcccaggggccctcaagtccatgcacagggcagctggatttcccagacaattctggtcagcagccaacaaacaccccaggtcctgctgcttggtgccaggccagctgctgccccactgacaaggggctctcacaattcctatgccaaatgaaagcagtaaggaaacagagttctttctccaaaacacattcacacttcatggccagcacagagcccagcacacctctcagaggggtaccagaaggatcagaggaccagatccttggtacatctgcctctaaagcctgatcgttaagccatattctaagaccttgaggaccccaccccaagtcctagtgcacaataggtacctcctgcaaagatgcaacctgcctgaaaccatccctcagacacaggaccccgctgaggacatcacttcctcatccctgccagtgcacatctctggtgcagcttctccttttgcccctcccaattttaattcaggacctgacagatttataaattgcctccagtaatttctggaacacagcagcacagaagaaggagaaggagggaaaccaaaagaaaaaacacaaattctctatctttcaatgcaagtataactttttgccatgggttttggcttcctatgactcagtgcacactatcacctcgagattctcatgatgaataggattgaaaatgtcctaaaatagagccaccttcaaactgcagtaaaacaccttcccaagagggcacacaggtacaaatggtcttaagggcaaaaaaatccacagagcctcactctcccatatgtgctttcctaaaacacgttatttcggagcgagcttggagttcaggcacacaaagctctatctttaaacctctccttaaacaactgcctttctcccatgtgacaaagaaagggagagcactcaccctccctgggtgtaactatggaaggaagtatcctggaagcgtaaaaacctccatggggcaacagacaggtcatacaaaattctgatgacagcaaaaaatgtgcagatcaaggtttttataacagtatgtttaaaacatgggataaaatacaagtttttttaagtatgttattgtattgatgaggtagtattaaaattaaccatttcaattttctcaaatagttttaagtacagcagattaaactaaatgtctttaactaaagcactaacaggtataatgataacaatttggtaagtcacagtaaagtctcttaactatccttcagatattaataaagtgaataactctaataaccagtaacagattctttcacaaatcaggtgggttccagttctttgctttcaacaaaactgaaggaggacctaactgagttattaagtcaataaaaataattactgatgagagtgcaatataatttttggcatataacttgtaaacatttcaaaaaaactgagtggcaatgctgtttttaaaaattaattccatccaaatggaattaacatttgtttttgttgtagaaaagcatcctggagtgattaataaaagacttttcaagcataaaaatgggttatattagtatattgttctatggggaagaatggaaatatgagttcaaaaatataaaataacgatgtgaaattttgactattaaaaaagagtctcatataacttttaatggataatggcaggcatcaaataggtatggcatttaaattcattggataaattttagaaagacatgagactctttgaacgtcaatatttgtcatatgttaaaaatcacatcctacaattaagcttttgatgagaactgttagatgtcagcttaaacacgtgtaaggggatttacagattttcaaaattattttaggggtacacaactaagaacactgaacaatcactgctataatggcaccctattactctaccacaggaacaaaagctcccggggttcccaccagagacaggcacatctggggcacggggaaggacgcttagagtgatgctcatttaaaaagctcattttaacagggaacagtaagacaagcatcaaaaggaagtgcagactgtacagatccttggagctctgcagggggagtgacttcttaggcgctggttttcctcctgtttatgagagtaggactaataatttgagcagttcaaggtggggaaaagcttaagtactgagtgcactgaggaagcagaggtcacaggaaggaccccatagcgaggtcctctgtgggtgcaggactgccccctaggggacatttcagaactctatttttctggttgtcataatgaccagaacgtactgctcagaggggccaaggattcacgatgtcttgcaacacacaaggtcagccctggacaacaagattctcccactattaaaacaaatttttaatattccactggacacacatttagatgaaatacttgttcacaatgatctgacttgagaatctgattctatttttgcgggtacacagcaagtactttctgtacagcggtattaaactctaaatattccaaagataggaccaccatgtaaatcaagggggagttgggtaaagtccatacaagcacaatctgtttcgcactctgagaccagatcatctcaggctacactattcatagtgtccaggctgcccaagaccttgcagccatcatattcatgttttttttttgtataggtgcatgtgtctatttcatcacatcttcttaacagtcagatatgagcacatattccgatgcatattattttctttaactttttatttctatattggtttttagaattatctgtatagatcgtttatataatgtataaatccaacttcaagaagttggccacgcatggtggctcacgcctgtaatcccagcactttgggaggccaaagcgggtggattgcctgaggtcaggagttcgagaccagtcttgtcaacatggtgaaaccctgtgtctactaaaaataaaaaaaaaaaaaattagctgggcctgatgatgtgtgcctgtaatcccagctactcgggaagctgaggcaggggaactgcttgaaccagggagatggaggttgcagtgagccgagatcacaccactgcactccagcctgggcaacagagcaagactccatctaaaaaaaaaaaaaaaaaaaaaaaaaaggttaaaggtggcagtacaaaatgtttgtttgtttgtagacaggatctcgctctattgtccaggctggaaatggcacaatcatggctaactgcaacctctgcctcccaggctcaggcgatactcccatctcagtctcccaagtagctgggaccacaggtgcacgccaccacacctggctaatttttgtatttttttgtagagatggggtttttctgtgtttcccaggctggtctcaaactcttgagctcaagtgatctgccctccttggcttcccaaagtgctgggattacaggtgtaagctcacacacctggcccaaaatatttgttataaaaagagatatggacatgctacaacatgggtgaatcttgaaaatattatgctagatcaaagaagccagaggtgaaaggccgcatgttatatgattccatagctatgaaatgtccagaacaggcaaatccatagaaacagaaagtagatggtgacacccagggctggtgggtggggggcagggggaaggggagtgactgctaatgggtacagggtttctttttggggtgattttaaaaagttctaaatttgagtgtggtgatgaccatacaagtgagaatataattttaaaaaccaccgaattaattgtatgctttaagtggttgaattgtatgggatgtggtttatatttcaaaaagcttttttaaagtattggtcaaatttggttgaaaagcgctactccagacttgctcacatggaagagaactggaggggaaaaaggtaggccagaacatctaggtgggacccctacagggttaaaacagctatgaagtatcagaacacttctgctatttagactgcggaaggctttcattttaaaggacatacaaatggcaatgaacataggtgagactttccaaaatagaatctatctcagattgcaaataaataccacggcttctatgggtcgaaaagacataaataacacacaccaccgccaatagtagtcctttgaaaccctccagacccaattaacacactaagaaagcataaaaacataaactgttctaggaagtatatcatcaggtaaggtaacacagtccccccagcaacaaaaagaaaaatagaaggaaggaaaaaaaaatgaatgtccaaatagcacccaccaccaataatcacctagttaagagaaaaccacatctagggatcaagttccctcacctcaagttatgaggcgggtatgagccagtgcatgaaacagctaatgtattctgaaatcagaaaaccagagcaaaggaactaagatttactagcacgtaaaaccacacacacacacagacatacatacaaggtaatttctccaggcagcatcttactttgattaccttaaattagtaatttgctaatgcaggcagttctcactttgcatggtcccacattaactgaaagtcacgcatgtccattgcaaacagtgtaaagtgaggacactgttctgatatgcacaaatttcagtttacatggcgccatgcaaagcaataaatgcctctaccaaaataggtcaaacaacatgtttaaaagtcttctctaatatggaggtctgtttgaaaacccgtatcaggattgcttatctcttgttcaacattgccgtttcaaaacccaagccacaccaggtattcattccagttccaggtcagttgcttcagcgatattcccaaaggagaacatgaacaaaccctcaagatcctttcttcttccctttctttaacctttctgtttgttcgatccgattccaaagctgtaggtggaatggcagaaggcaggagtggggtaggagagatacagagaacctccgtctccttgctagactctcctcactagtcctattccgaagaggttcacaagaattcatgctgtttggtctttcatttgtgtactactggaggaagtccagctaggttaccaatgataccagcagtcttagcaaggcttggtaagaagatgagctgtcatgccaatgtcctcacatcgatcctcctttgttcacccaccccaaacctccagggccctcgctggggctcctgctcagagctcccactcctaggatggcatttcagtggcccaagttctggtggcttcatccaagctcccctcaacaaagcagagtgatcctgttttccccataaaagcccagtttttagctggccatcatttaatttaggatcttggttttttgttttttgttgttgttgttttttgagatggagtctcactctgttacccaggctgaagtgcagtggtgcaatctcggctcaatgcaacctctccctcccaggttcaagtgattctcctgcctcagcctcccgagtagctgggactacagacgtgaggcaccacacccggctaatttttgtatttttaatagagacaaggtttcaccatattggccaggctggtcttgaactcctgacctaatgatccacccgcctcaacctcccaaagtgctgggattacaggtgtgagccactgcgcctggccaggatcttgtttattttttattatattttaaacattttcattagatatttaaagtcatcaagattttataaaaaatttctttcactgcccttaaacttaagaaatcttatctcatcaagagcatgactaaatatccactttatcctctcctcctcattcatattttaatatttaattcactcatttatctggagtcctttttgatacatctctaaaagacagataattccacaatgagttgctagctaaacattacttgaaatttcaggatgggactctgtcctcaccaccaagctttgtttccaagagatgccatgactgataaaactgaggttggaaagatcaatgtcttacagaaaacagaagattggggggaaacgattgaaacagcactgaatatgtttatgaaatgcatccactcactcaacaaatatttaccgtgcctctgtgtcatccaagttccagggatacagcagtgagcaaagttcctgactttgtaaggtttaagtgatagagacagagacagatgttaaataacgcagtacatcaagggctgaggaggccttgaagaatagtggatggagggtgcctgcagtgaggtggtggctgctgttgtcaggctgggagggagcccgccctgccatgaggacctctgggcatctgcaggagacagggagcaggccatgcagctgtgcggggcaagtgccttccaggtgaagaggaagcccatgcacaacgcaccagaggctaaatgacccaaatttgcagagtgagccagttcccaaatgctcctcgtgcatcatcccctccccaggcttgggacatctacaacaggctgggaaccactggggcaggacttcctaccaggtttgtcatctacaggctacacctcttctgaggcccctaagtcacccaatgtttggcttggagttttttgttttttgttttgttttgagatggagtctcactctgtcgcccaggctggattgcagtggtgagatcctggctcactgtaacctccacctcccgagttcaagcgattctcctgcctcagcctcctgagtagctgggattacaggcgtgtgccaccaagcccagctaattgttgtatttttagtagagacggggtttcaccatgttggtcaggctggtctcaaactcctgacctcgtgatctgccccgcttggcctcccaaagtgctgggattacaggcgtgagccaccatgcctggccagcttggagttttttgtcttttgtcctggcattcttcctttcctgacttggttctcctagaacctccctggcttctcacaaatggtttctaagctgaagaatccattgttctgagtctgaccttgcaccctcagctctccccactctgcaaactccactgggacccccacagggtccacaagaggagaggggagcaggacaactgtagtcttgttcttttgcgtaagtggactgagttttgcagaggtaggaagatggaagattttcatcttttagtttcaaaagtctgtctcaaacccacagctggagtggccttgctgcacagagcagtgactttcatacaagttgtcttgtggttaaagggcatccaactccaaacccaggagtatccctcaaccttttgaatttcgtttaaaataaaactgtaggatttcaacaaggaatagaagtggtcccaaggtgggcttcacaaaccaccattcccagacatgtttgtggggaagccttcagcagcaatgctgctcaggtgggcattcaggcacagtgacaaggagatggggaagaagacggtttcgcaataatcaattacaccactggaggctcctggctgcctaagggcacactggccctgaccccatcctgaaattgttccttgcaggtcgcatatttactcaatcaatattcatgcagagtccactctacagcaggctctaggtcagaattagctggatgagaatgctcgggttccctgcatgtgtgcacacacgaaccctatatatagtacattttgcagtgggaggggttacttttaattgagcacctgctttggtgtgtctaatatagtgtttgatttcaaccttattctgagtaggcattactattcctttttttcaaatgaggaaactaagcagagacagatcacataacctcccccaaggtcagccagctagttagtggcggggcgggactcaagccagggtgatcagactccaaagccatgccccctccaggaagtcacacccctccaggaagccacacccctccaggaagccacacccgccaggaagtcaggctaattccccaaactagccactaaaagtggccaggactggtcagatcaacatgcagagaaagctgctgatgttttattgttaataaggtcccaagttcaagttttatttggagatgttcaaattttaattattacttttaattgaaatgcactgtaatttaatattaatttttgtgtaagtcaaatgaattaggctaaattgcaactttcattttattttggaaggaggagaggctgaagaaaaaaagcaataaataaaaaggaaaaattatttctcttagaaattcacctgatagagagggattactgcattttctaaaccatgtctagtttagacacggcacatctggtatgatagatgctgtgtatgaatggaaacaagtttagggtaataaatgtttcccagtgttaaaataaacgcctcagcggttcagattttggccaggcagtttctccacagtaggaggcacttatctactttaacactttgctacttagaaattatcactcaatcaattaccgtccacctgggtttatttttacagagagcttcaataaaatgagtgtgaaaataagttaaacacattctattcattttctcaatttttcacctctcccaatggtggttatgttgacagaaaaattacttcattttatttcaacagacatttatggaatgctgaccaggttctgtgctaagggctgggagacaggatatgaccaagtggaatgaaatgtggtccctctcattacagagcatatataacctaccttttagcacaggcggtgtctctacagcccaaatgaaggcaaccacgagaaaaattctggaccctacaatctccacagccctccccttcctcccctaccacaagagactgccctttgcccaggtaacgtccctgtggtgtttacctatgtggtccgtcaagctctcaggtgcttccagatatggaaatactctttcaccaaaagatgtttgttatactttcttttttctttttaaacttttcttttaggttcaggggtacatgtgcaggtttgtttaatataggcaaactcgtgtcagaggtttggtgtacagaccatcttgtcacccaggtactaagcctagtacccaatagattttttcctgatcctctccctcctttcaccctctaccctccagtaggccacagggcccattgttcccctctttgtgctcattggttctcattatttagctcccacttgtaagtgagaacacacagtatttggttttctgttactgtgttcgtttgcttatactttcttttaaaagagtacctccctcttacatcacttctgacgtaagctttagaatttctgtaccatctgtctttttaaaaataatagctttactgagacataattcaaataccataaatccaccctttcaaagtataagactcaacggtcttgatactttcacaaagttgtataaccatttccactatctaattccagattcatcacccccaaaagaaatccctcacacattagcagccactccccattcctctctcctccacccccctcaaccaatctcctggcaaccactgatctattatacttactatccccatggatttgcctatcctaggcatttcctataaatgaaatcacacaacatgtggtcttcttctgtgtctgacttctttcattttagcataatgttttcaaggttcatccatggtacagcatgcatcagtactgcattcctttttatggctcaataatattccatcatatgactagacattttatttatccattcatccactgatggacatttgggttgttcccaccttttggctatcatgaagcgtgatgccatgaatatccacatgcaagtttttgtgtggacctctgttttcatctctcttgggtaggtgtctaggagcagagttgctgtatcacatggttaactctgtatttaaccttgcaaggcgctgcctgttttccaaagcagctgccccattttacattcccatcaacagtgtggaagagttccagtgtctccacatccttgcgaatacttgttactgccttttttctgacagccccaggtgtgaggtggtatctcattgtggttttgattggcatctccctgatggctactgatgttgggcatcttttcatgtgcttaataataaatctattttcctttacaaaattttcttaggttttttgggtattctttcgaatttcacattttgacctacaagttcagaacctctccgcatccgttcctctcaccctcctgtaatgtggtgtggtcgcctgtctttcagctcctacagtcggggcctgggccaccatcgctgctctcgcatggctgatgagccttatagagcctacatcacatctcttggacctggaaggggaaggaagaggaaaggcctggagactcaccaaaaggaaggaattcagcaatggcagaagtgagccccgaagtcccaaagtctctggattattctttccaccaagccatgttacgcccctaattcaacacttgtcatttctctttctctctttttttttttttttttaaagcgacggggtctcattatgttgctcaggcctcaagcgatcctcccacttcagcttcccgaatagctgggactacatcgcgccactgagcctggcttcaccatttcttaattgctacaaattccccaaatcccatgagacagaaatgtatgttcagtcataaatatgagtgcacattattctcccaggcatgacatggaacaagtaaaacagtaatcctgctttctgggtgcagagtcagtgaagaaacataaaaacagtcgcatagaatgatgcacagagatttagaaatagcaccataaaagctctaaacagggagattccacctggagacatcagcaaggcttgcagaggagagagaactgaccatcgccgatccactgagaaggaatcagatggaaaatgtgggggtggggaataatcagggatgggaacagcacattcaaagatccagtttcaggaaatagcaggtgtttagtgaaactaaaacagaaagcatgagggtcacaggcggggtcacagaaagggtcaaggctggaaagagaggctggggccagtgcttgtcagtcttccctgccatgctcagggttgggattttgtaggttctgaaatgcaaagcctgtgagtttttgagaaaggaaggaacgtgattagatttgcacttaaagacctcactgcagcaaccacatctctggatatcatacagatagatcttttcagcatagtaatgaaaactgaaaattactgcaaaatgcctaaacttgttcaagattctctttgtatcatttcttcttggcaaagttccgctgctcaagacccaacaattcatctcaaccactcaccacaaggttaagaaatgctctgatgctgtggtgttggaactcagctatgttgccacaaagtagtgggcttcaaacctttggcttaaatgtcccctagtagaattacaaaaaaaactatgaaagccctgcatatttttaagttcacataaaagttttccgtctaagctaggacagttgcaaaggatgcaatttctggtttgggatcaatattgacatttaaatgaaactattatatcactcttgtaagtgtgttcaaaggaatcaaattatcataaaaatgtgttatccaccatcatctaaagtgcatgaacaggctgggtttcgtggctcatgcctgtaattccagcactttgggaggctgaggcgggcggatcacttgaggtcaggagtttgagaccagcctggccaacatggtgaaaccttgtctctactaaaaatacaaaaattagctgggcatggtggcgtgtgcctgtaattccagctacttgggaggctgaggcaggagaatcacttgaacctgggagatggaggctgcagtgagccgaggttgtgccactgcactccagcctgggcaacaaagactacgtctcaaaaaaaaaaaaaagtacatgaacaaacatttcctttagtcaaaaatttgcattccctttcctccttcaagaaaattctacttcaccccaattccatcctaatcctgcttaaaagtcttacttctctgttttatctacaataaaaatacacatcaaaaaattgtagtttttatttcctgtaaccattaagctctaagtgttaagttttcatattatgaattgattcagttacaattaccaatagtacagaatggatcaaaatataaatgttttaaattttaataaaagtattatgtataacttgaaatccattggaaatccatcttttaaaaagatgaatgggcctttttatcctttctatagatgaatattacttatggctagaataagacaaggttaacatcaattctatttctactttccattttttatagatgttaacactgagaaaccttgtccatatacctaagtacagggaaataaaggagttttattatagcaatgctgctcaattctttaaactgcttccaacatatttgtcaaaaatcatgccttatctatcattaaaaagtgttttttaaaatcttgtcttttgctttctgacaccaatatttcatgttgccctgtctgccaccctagaggctgctccgtctcagacaggctccatccatagcaagattatggatgggtgagaaaagtcagttgtggggcggggcagggtggggtgcgtggcagtgggtgggagaagaaaacaggctgatacccccaccactgacatctgctcgggcggatcaatctcaggcaagagtccacgtggaggctaagggtctgaaaactccaccactccccacttatgtgccccagaatgcgcgccagtttaaaggaatggctctgaggcaggtttgtagactcctgggtctcctactccggttaaaccttgaaacagaagctctgttcctggggaccccgagaaaggagatgcaagcaggaaagaagcaaagatggaaaaagatgaaaaatgttagaaaatggcataaaaacaaacaataaagtgtttttcagaaaaacagagaaaagctctataaattagaactctgtggcttgccccacacaaagccatcagattagggagcagaccctcttcggctttctcctccccagctcctgcctctcctaaacatacccagagaacctcttcagtctttgtaccgttttgttattgttatttttaagcagagggtcatcatttcaaccctggttgttccaaacgaatagtaaactgtgatagaaaattctgaacattccaccaccagtgacccttactattctgatatggtctaataactcagaattattccctatcatacatactttatataacatcagctaccacacaagtttttaatacacagtaagcaggtggccccagcaatttctcttatatctcacatctggtattgtactccatataaggtgctgagtccgattttttaataaaaacatggcctgagcttgtaaaagctcaagtaaaatatgcctttaaaactgctgtatttaatttccagtcatgaaagtctaaaattattgtaaaataatactcaacttttttcacagatccattcaatgaagcttaaaagtactttcctttcagaaaggtaaagagcttcataactaacagtttcttgaattcacatgtgctgtcttacttttgtgagcgtgaattgtatacattttatacctttcaatctggaccaaattagttggttagtagcaccaaagtaatatacatgtatgtttcggggcagaggtgggggaagggaatggtaagggaagggcagaaatgctggaaattaaaccaataacttgagacttggaggaattcattattttttcaaaaaggaaattgaagacataaactgaagatacacactaggtaggaaacatcaacaaatgtgacatgattatgaatattatcttataattagggaaatagccattttgacggtcattacactttatgtgaggttagtgtacaatgtggcgtaaaagactggtgtaaaaatgagatggatttctgcaagttcaaacttaaaatcgtgcatctgactagatataagctgttgcgagtgcattacatctcccactccagtctaggaaaggtggagtccctttcatttacacgactattttcatgactgggcaaattcacagaggaaacacagggatcacattccttcgatcataaagtcctcaaaagcaatcttgctccatgtcagctggtgctaaatcaaaaggtaactttcatttcctttaaataattcagtttcatctctaactatcatcttcaaccacagattttaaattgatgctaaattgggtaactaagtagaaataaattagtagtagatgatgctggctataaaaccaagccaagaatttgagtagtttttttttttttttttaaaggttctgctctactgaatctatccgataatatttctccaaagaacttttatgctagtgctcattttttcccttttgggggatgatggaaagggggcagttaccctcccttgttatcacaagtaaaatgcaaaaatcagcccacagatggttgcagagaaaaaggtcctctcaaaccccaaaggcccaagtgtaaactgatattaatagatctgctcagtttgtaggcagtttaacaatagctatccagactaaagacacatgcttgatgacccagttcccataaaagagaaacatcacacatgtacatatatctggggggcagagttcctcgatgggcgttgcaacattggttctcagagaaaaacaacagaaatcagctaactatccattaggaaggaaacagctagcagctaaacaaagcgtagcatgctcttattgtggtataatgtacagtagtaaaaaggaatgagatagatcaattggctacaacatagctaaacctccagagtacatggctgaattatagagtaacacagcagcaaacacagatcaaaatccaaccaaatctactttccccttcttggcaacagaattttggctgcaaagtgcatctccctgactcccctcctttcagctaggcaggctaggaccaggttcttgccaatgaagcataccactccagcctcacacgtttaagagaaaatctctacccctctatttccactcctttgtcttatctgctgtgtggaaaagcaatgaccagatgactgacctagaaagtcacatgttaaagacggcagagcccctgtcagcctgggtctctgaatgactgcatggaacactgcagcccaatgacctacatacactacttattatgttctgtcacatgagggagaactacatgcccttcttttaaagccaaattactgtcaagtctcttactatagcaacttaatcttttatcccaacatagaaacatacagtaagatgaccaggtgcggtggctcacgcctgtaatcccaatacttttggaggccaaggtgggaggatctcttacggttgggaggatctcttgaggtcaggagttcgagatcagcctggccaacatggtgaaaccccatctctactaaaaatacaaaaattagccaggtgtggtggcacacgcctgtaatcccagctacttggaggctgaggcaggagaatcgtttgaatggggaggcagaggttgtaatgagccaagatcacaccactgcattccagcctgggccacagagcaagaccccatcacgaaagaaaggaaaaaagggaagggaaaagggaggggaaaaaggaagggaaaagggaagggaagggaaaaaagagagagaaagagaaagagaaagaaagaaagaaagagagaaggaaggaaggaaggaaagaaagaaagaaagaaaaagaaaaacagtaagaccccttctatattaacaccatatcaaaaagacttgaaaaagcagatcaatctcctgacagtgattatagaggtgggaatgagagaaaggaagggcacaggcaaaacaagacagatgggattagggaaaactttagatttcacttttaaatatatgaacagaaaatatatccatgtattactcatacaattgaaagctgataatctatagaacgtaacaattttaatgaccaattctattttttcctctaagtttttcattgaggtggcatttggattctaagtgattccagtcaatatatctttccataaaatataaagaaaatgatgaccaaaataaaaatagtcataaaaaaaaaaggcgtcatgagaacattgtctggcactcacactctggaaaggggaaaaaacaattggctggcacgacgactttgtccccacggagcgttgtaccgtacaagcattcttccaccaggctaccatgtgagtgtgggcagttgtccccatctcagggtctccggaacctgggagaagtccatccaccctagtctgggagacagcacaggctccaggagacgaagtgaaggctctgtcccctgccagccatcaggtatagtacaacctccctctctccaagggacagtttcttccaatgaaaaactgaggcaccgcacaggttgtgtctgagatacgactcctcgcattcaagtctcagctggaaggccctaaggaaacaactgcaactttttttcaatgacctgagtccatgcattaagcaaaagatgtttaatttatttatttatttatttatttatttatttatttatttattttgagacagagtctcgctctgtcacccaggctggagtgcagtggtgcgatctcggctcactgcaagctccgccttccaggttcacgccattctcccgcctcagcctccggagtagctgggactacaggcgcccgccaccacgcccggctaatcttctaatcttttgtatttttcgtagagacagggtttcaccgtgttagccaggatgatctcgatctcctgacctcgtgatccgcccacctcggcctcccaaagtgctggggttacaggcgtgagccaccgtgcccagcccaaacgatgtttaattttagatgagtttctttccccatctcagcatctaccagaaaagagattttcattttcaaacctcatttctttcctaaggattacccatgcaaactgcatttcatactttcaaaatgccctttgcttattaaaaagcactgtgagaacacagacatgcttaagaaatttcatgatacacggagaacaaaaaaattctacttttgatcattctcatctttaccagacttgcttagtacaattaaattatccaccctaaaataaattttcttctagataccatatccttattttgttaatcctccatcttaagtgtattgatgtccttaatcttgtgtttataacatctgggttaaaatcacagactcacagaacaaatccaacccccctacttaaagagaaagaacagaggtcttccacctagaatcattttatgaacaataggggaactttaacttctgggaaaaccctagattcctgctttggaatcctttaggagtgggaacaggaatatgaacaggagaaaaccacctttaaaataaaacccgtgaaccctagttatagcacctttgaattgcaaagaatctgagaagttgtttgccacgattttaaaattaattccacaccaaagcatgcatgtttttcatttaagagacttcagaaattgactctgaaggactgtcagcagcgaaacctggttgcttttgtgtctcgccccagtactgctattaggagtgcagcctctggccaccagtgacctggacacacacccagctacccctctgagaagctgcgtctggaccactgcatctccccgggaacctcattgacaccacaggcttattaccatgaaggggtggggggaggaagaaaagagaatacacctaagttctccttagcaggcctgatacggtcttaacagtcactctcatgattattagctattaattccttatttttcttagttattacttgcatgattttcacttatatgagcatatttcccccaccatttcttaaagtatcttcccatataattattaattttaaaactaggttatcaataaatagacctatatttctacctatgtcatcctccaacggttattgataaatttgctacctttgcagatatgaggattttcatctcagctttccagtgagaagtgattgtttcggaatcatagttacaagtttcccttaaagtaactggaagtcttaaaagggggcttcatgacaaaacatcacatgaggaaaaatatcttaaggactagttagcagtgagaattttcaataaaatcatgagctagagatatcaaggctaaaattcaaatactaagagaagaaaatgttcctaactcccacaggtctggtccaactgttttaaaagacctgggcagaagggtttggaaaatggcatctaagaaggaggaaaatttagcacctacaccccagccctggccccccactccaccttcaactggagccttagagaggctcttttgagcaattatagagtaaaattacatcagaatatacattaatgagagtattttcaataatgcaaacgctgctaattatatcttttctttttaacacgaggtagaacattttacagcaaccctgagaccggccgtgtgcccagcagggagcctcgtattccgcacacacttggaaaggccatgacagcaggctgcatgatatgaggtgtgagaaatgaaaactttatgtgcatacaaatttagatttttaaaatattttcactaggggcataaataaagagaaattagaccactgggatttcagaaaacgagaatacagactgtgatttttgttttaaattttggtacttagagtaccccaatacctaaagaagtaaataattcagcaagttaccaaaagtaacacttcacttttaactttatactttttatataatttgagctattttgttcaaggaaggagagaaaattgcacacatttaaataaaagaaaggagacaaggaaggaaaacaaagggacacaggcaccaccacagacggccctttatcaggctaccatgacacatccatgcaacaagggctaccaaaaacgctacgaaaatacaatttccatcaatttacactgatttttattataccatagcacttgaaaaaactgtccacagttatttgcccccattataaaaatattgacactttaccacaaggttggaatttagcatgaacatccacatacccaccacctagacaagtcacatactgggagttaatattcgcaaaacatatatctgaaaaaggactggtatctgagatatacaaagaacttctacaactcaataataaaatgacaagtaccccaacttcaaaatgggcaaaagatttgaacaacatttcacaaattaagaatgccagcagtgtaataggtacaataagtataatcatcctcaacaatatctgttttcaggaaaatgcagattgaaagcacagtgagatacaactgcacacccaccagaccagttgaaagtaaaagactgaccacaccaaatattggtgaagatgtagaggaccacctaccattaacattttcttatacttgctttagtacatatcaacctatgcatccagccattaattcatcttcttgctttatgcctttcaatgtaaattgcagatataccctttaatacttcagctgggctgggcgcggtggctcacacctgtaatcctagcactttgggaggctgaggcgggcggatcacaaggtcaggagatagagaccatcctggctaacatggtgaaaccccgtctctactaaaaatacaaaaaaattagccaggcgtggtggcgggcgcctgtagtcccagctactcgggaggcggagtttgcagtgagccgagatcgcaccagtgcactccagcctgggtgacagagcgagcctctgtctcaaaaaaaaaaaaaaaacttcagctgcataccattaactagagttcaatattttagtttttatgtaaaattggcctaccttgatatgctaagatctgctgggttttgacaaatgtgtacaccaccgccaatcccagaaacaaccattcttctaattttctcccaccatagattagatgtgtctgttcttcaatttcataaaatggaatagcacactatgtacttgttcatgggatgtttctttcactctgcataatgtttttgagattcgtgcaagctcattcctttttattgctaagtagtgtacctttgtataaatatgctacagtttatccattcatctgtcagtggacatctaggttgcttccaggttttggcaattacaaataagcttctatgaatacgacctacaagtctgcatagacatgtatttttgtttatcttgggtaaatatctagggatggggttacagggtaggcatatgtgtgcttttatttaaaaattgctccactattttttttcaaaatggtcgtatcattttatattcccaccaacgatgttcagaaattgcagttcctctacaacttcaccaatatttggtgtgtcagtcttttcattttcagctgatctgggggatatgcagtggtatctcactgtgcttttaatctgcattttcctgaaaacagatattgttaaggattattacacttattatactgctggcattcttctttttttttgtttgtttgagacagagtctcgctctgtcgccaggctggagtacagtggcacaatctcgactcactgcaacctccacctcccgggttgaagcgattctcctgcctcagcctccccagtagctgggactacaggcgtgtaccaccacaccaagctaatttttgtatttttagtagagacagggtttcaccatgttggccaggatggtctcgatctcttgaccttgtgatccgcctgcctcagcctcccaaagtgctgggatcacaagcgtgagccaccacacccagccattgctggcattcttaatttgtgaagtgttgttcaaatcttttgcccatttttaaattggagtatttgtcattttattactgagttgtagaagttctttgtatatgtcagatacgagtcctttgtcagacatatgttttgcaaatattaactcccagtgtgtgacttatctattcatttcctcatcagtacctcttgatgagcagaatttttctttttagagacagggtgtcactctgtcatccagcctgaagtgcagtggtgcaatcatatctcactgcagccctgaccttttaggttcaggcctcctgggcaactgggaccacaggcatgtgccaccacatccagctaattttaaaaatattttgtagagatggagtttcactatgttgcccaggctggtctcaaactcctaggatcaagctatcctcctgccttgacctctcaaaatgctgagattacaggaatgaaccactgcacctggctagaatttttaaatgaagtctaacatcatttttcttttatagttattgctttctgtcatcagtttaagaaatttcttcttagtcgcaagtcatgaagatattgttttcctttaaaactttacgatttttcacttctgtattaaggtctatgattcatctcaaatcaattttcctgtatgaggtgaagtacagcacaagattcccttcttttcctatatggagcacatatctacttactgtatcaccacttcttgaaaacacatttctttccccatcggattgctttaacacctgtctcaaaaatcaaaggccctaacacagtgaaaccccgtctctactaaaaatacaaaaaattagccaggtgttgtggtgggcgcctgtagtctcagctactcgggaggctgaggcaggagaatggcatgaacccaggaggtggagcttgcagtgagccgagatcgcgccactgcactccagcctgagcgacagagcgagactccgtctcaaaaaaataaaataaaataaaataaaataaaataaataaattaaaaagccaataaggtgcagatctatttccagggtattctgctctattgttctattttcttgttaatgccagtaccatatagctttgattattgtcattttatagtaagtcttaaagttaagtagtatgacttctccaccaactttgttctaaattactttctccattatagaacttttgcatttctatgtacatgttagaattagtgaggacgtggtggcccatctggagcagccactgtggggacaccagctgcaatgggggaggtgtggccagggctgctgcactccatggagctaacacaggccaggaatgggcgggagccctgccccctaccaagtcggctgggcaggagccccatgctcccaggtgcagctgcggccacccagccacggctctggacccaggcatccctgcactctcgggggtccaggaagcacccccggtccctgcaggcttggaagtgcctactcgcactccctggcctctccccgctcccggcacccacttcagtgcaaagttgtagccaagcgcgggtgctgtcatgacccagccaggtgtgcacatatgcagagtagccagcactcccctccccgactggtgcttcagccccctctagactttggtcaccaatgaacgcaggagggagaccagaggactaagcgtgactttgtacaggcctgtgggtgcccctcagcatagacagctgggcaccacggacagcatgttgatggcagcgggaggcagacaggctcctaagcaggaagaagccagttcctggtgaaaccacaccttcaagcctgaagcctgggctccaggctgccagttccaggtgaggtccacggcctggagtgagaatttcattgacaactgtttggccattcggatggtgctttttccaggaccagccagggacacccaaggaccagtcagcacacacttcctccattgtgacaacataaaaaccccagattcagccactcacactctcctctggaagaccccgctgagagctggacacatgtcgggacaacctgtctgcagaaaggagctacccaccatgggtctcctcttcgctgagagccagacagatgttgggataacatgtctgcggaaaggagctacacactacaggtctcctgtccactaagagctggacactcatcgggacgatctgcctgcaggaaggagctacccacttcaagtctcctgagagctgttctgccactcaatgaagcttctctctgccttgctcgccctccaattgtccacatacctccttcttcctggatgcaggacaagaacttgggacctgcccaatggtggaactaagagagctgtaacacaaacaggggcaacgtccccctgctcgccatgttgcaggtgatgaggagagaagagaggcagctcttcggggagccagacctaggggctccccaagccagggctgtgacaccctctttggggctctgcagttcctggtgtctccaagtttctggatgccaccacattccccttgtctaggtgctggtgcctgcagcagaagccacttgtggtacatctgatctagcctcagccttgcacggaggcagcacccgtgccagggcatggagctgcctgccccaccgcagcagccactgtgcactggcctgcctgtgcacagtggccagaccccaagcttgctcgttcacaacccctcgccagtgtgcgcctggctcacccgtggcaggcatgggatccaggctgagagtgcgagccaagtgcagcctgccagggctgaatgagcccagcaggcccgaacaaaactcaggcaaaggtaccaccagccacagaggtttctggctggaaaagcaatactctaaggatcctgtgacattttcgtatacatttccacaaaaatacctgccgtgattttgattgagcttgtaccaaattcgtacatcaacttacagcaaactggcattttaccagtactaactcttccaaaccatgatcatggtttctctacgtaggtcttatgcagtttcaaaacagttcgtactttcccttgtgatttcttgcttgaccaatggactatttagatgtgtgctgtttactttctaaatacttgtgggtttcctagatccatttttgttattgatttctaatttaattccatggtggacagggaatatactctgtgatttcaatcactttaggcttttggagacttgttttatgacccagcacatagtctaccttggtgaacataccaagcacacttgaaacaaggtgagtttggcaaggtatagtgttctggaagtattaggtatcaggaaggtgaaagtggttgagagtgttatccagattatctatgtttttcatgatttttggttagctgttccatcatgggctaagagagcattgctgaaatctccaactatgacggtggacttctctatttcttttattctgtccatttttgcatcatatactttaaagctctgttattaggtaaatacacatccatgagttgttatctgttctctatgaattacccctattgtcactgtgaaatatccctccccatcttttgtacttctttgtcttaaagtgaattttgtctgctgcttaaaaagtcactccaacctccttaggctgttaatgtggtatataatttcctatccttttacttctaacctgtgtctttataattgaagtgtgtcttgaagagaacatatactcaggtcttgctttttaaaaaatccattctaacattttctgccttttaataacagggcttagtctattatcatttaatgtaaatattgataaggttgaattgagttaaaccatttggttaatttttatttttttctctcttttttttgtgtgtgtttctagtcctcttttcctgacttcttttagattttttttttagaatggcattttatctattggcttttgaactgtatcttttgccttatgtgtttagtggttatcctagggattacaatgtacatccttaccttttatatcaacttagcattaatattgtaccatgtcagatcaaatgcagaaatgttacaatcttataggtccatttaccacccctttgttgttcctttttgctagagttgtcatatgtattctaccaatgaatgtaagactatgtaagatgatgctacaattttgctttaggtagatatatgtgtgttgggggagtattttaaatttacccagatatttgtccagagagcattccttcctaaagactcaagtttccctctagtgtttttcctttcaccttttgaaacttcctttggcatttccttccagcagacctgcactatgacacattatcttagtgttcttttacctggacatgtattttgccatcattattgaaacattttgttggatatggaattctgggttgacaagtttatcttccttgagccctctaaaaatattgttccactctcttctggctttaataatttctgagaaaaagtccacagacattcaaatcattgttcctcactgcatgaaatgctgttttcctcagattactttcagtacttgtttttttttttaatctttggtctgcagcagttggactataatatgcctagatgtattttcatcatattcatctggcttggagtttgctgaacttcttgagcctggaaatttatgtcttctgccaaactgagggaacatctggccatcattttttcaaattttttttccatctctcctacacatatattaaacattctgatattatccataggtccctgaggctctgtttattttttaaatctttttctctcttcttcagattagataattattactgtcttattttcaagttcatagaacctgagaacatgaagatgataaaattacattctctgtgggtaatcattgaagggtcattgtgaactagacagaagctagaagaaacatacaattctaattttaaaaggaaattgtactaaccagagatattctatcccaagtgaaattcaagtaaataaacgaaactactactactgagcacctattaaaggtcagaaattgtactggcactttcatacttaccattgtatttaatttagatcacagctcattaataaaggtattactgcccacaatatacacatagtagtacagaggaacaaaaaagtaacttgtcccactaattagctcaagagctgagactttaacttaggactcccgttatagctttaccactcatctcattgaaaaaataaaaaattaagagaattgtcaagagttagacatattagctagcctgattttcttttgtaataagattagtatacaagtagatattggaagtatggggaacatagtacattacgatttcagcaaagcatctgtcagaagtaatatagtattacaaactaacaattagggctcttaacacagataaaactcttaaatgctgcttctatcacttactctttatgtcactctgtccaagcatttaaactctctaagctatagcttcccccttatctctttaaaggggaaccatgatgatactatctcaccaggttttagttaagaccgaatggtaaaaatctacagaatgcatttagcatagtactgtcacatagtaaatggtaaattagtgttaactattattattaaggcatgatatctcttgaacaaaaataattggaatataacataattatgaatattcatgaagtattgtaaacaacagttattaaccccattcctattcaacttctgtcaatgtctgctttgttttataattcaccaagtatcttccagaaaagaaagattgtaatgggttcactacagaattatacagaactgctggctcaaaaagaaatatgattatttataataggaaatcaccagcaatgacaagaatgcattcacagaagattgcttaaataaattatgatagactaatcttgcacatgtagtgtaggaggaaataaaagactagaaggagatacaccagaagattaacatgattcatatctcttcaactaattaacaaacatattaaataccatttgggaaaagattacatttttttcaacagtatttggattcagatttccattttggaatggggtgggtttataaggagccattctgggagacagaactatctccaaggtgactggaaggggatgcctcaagttataagagctcaacagaccaagcacagtggctcacacctatagtcccagaactttgggaggccaggaattcaaaaccagccttgggcaaaaaagtgagaccttgtctctacaaaagctacgaaaagttagccaagcatggtggcacgcgcctgtagtcccagctactcaagaggctgaggtgggaggactgcttgagcccaggagttcgaggctgcagtgagccgagattgcaccactacactccagcctggatgacagagcaagatcccatctcttaaagaaaaaaaaaaaaaaaagagctcagtaaatatttgactgaacaaatggtaggaaattgcccagtatctggtgctcagacacatccacaacactgcagagggcattcaagccctctggcccctgaggtgcctgccagagtttggacagacatttgtttgtctgatttaaggttcagtagaagtcaaatccctcattcgtttccaatgatgacaacatggtgctggaaacatttggtgcacttcatgacaattttccaggtatcaacagtaaaaacagaaactgcctgtaatcttacaacggtgctctatctccactgcctggaacaaaggttccaagaaggcctcttagcagttaggaaacatgctcatattttgcaacagaaagaagggaagaggaggcaggagaaggaagaaaagagaacaagatctgaaacgaagctagagaaggcattttaattgagctaaaaaacaaaacaaaacaaaacaaaaacaaattctaaaagtagctccacatcagagattcacagcccaggtttgcaacatctaagtttcttgtattacctcaatgggcatcacagaatgcaaaaaaaaaaatcatattacatttcatcttgtttccatttataaaagagaagatgccataggttgtttccggaagtggaaagggtattgaaaatgagtagaaaggatgaaaataaaaaccaggaaagcagggagattgccacgacttgcagaatccacctcgaacactccaccaggattccaagcatatcagaccccacactccgattccacggcaggttctatactatgttagtaagtcaaataagctttaacaaaacatcgaaatccaaaatgtcagccacgacctcatccaagaccactccacatctgcccaaactccccttacccctcccagagcactccttagggcgtgggagccgaggggcattttccaccacagctgagttcttcacgccactgtatcatcccctcctgcgttctgggtgtttgggttggaagcgatgccagcagagagtttttgtttgtttgtttgtttgtttgtttgtttgttttgagatagagtctcactgtcacccaggctggagtgcagtggcgtgatctcggctcactgcaacctccacctcccagattcaagcaatctcctgcctcagcccctcaactagctgggactacaggtgtgcaccaccatgcccgactaatttttgtatttttagtagagatggggtttcaccatgttggccaggatggtctcaaactcctgacctcaagtgatccacctacctcggcctcccaaagtgctgggattacagacgtgagccaccacgcctggcccggcagagatttttcttctcggatatcactcagctgtaattggagacatctgaacacccacccggatcatcacccccactcccaccccaggagccactttgtctaacaggggcatggaactcattcgactttccctgggttccagaaggaaactccaattactcagccaccactactgttagcgtgggaagctgggaagcacggaatgaagccgagttatgaatcatgcacacacagacagctgtcgggggatgcatgccaaccagaggggccacacatattccgtgttgatgggacagcacctgcaggaggcagagagaacttgtaacagatcatatgaaatccccattgccgtaattcctttttggaacagggcagggcataaaaagaagtaatccagatgatcagccagacatgaaaagaaaagaactgtcctcaggccagctgggcctcagtgtccgtgttggaaggacacttccagctttggtggtcttgatgtccataccctgaggaacctggcctctgagaaggctcccaggacccatgtggacaggggggctctgcaccattttacttgaaagggggctttacaggcatggtggcacgtgccttaatcccagctactagggaggctgaggcaggaggatcacttgaatctgggaagcagaggttgcagtgaaccaagattgtgccactgcactccagcttgagcaagagtgagactccacgtcggccgggcatggtggctcacgcctgtaatcccagcattttgggaggccgaagcgggcggatcccaaggtcagatcatcgagatcatcctggctaacacggtgaaaccccgtctctactaaaaatacaaaaaattagccgggcgtggtggcaggtgcctgtagtcctagctactcgggaggctgaggcaggagaatggcatgaacccggaaggcggagcttgcagtgagccaggattgtgccactgcactccagcctgggtgacagagcgagacttcgtcttggaaaaaaaaaattaagccacagatctagtataaccctctaatctcacagatgagaaacagacccggagaggctgagtgattcaccaacatcgcacaagctgctgtgtcaaaatggcaggcaagaaagttacagtctgagattttggggtttttttgttttgttttgttttgtttttgaaatagagtctcactctgtcgcccaggctggagtgcagtgccgcaatctcagctcactgcaacctccacctcctgggttcaagcaattctcctgccttagcctcctgagtagctgggactataggtgcgtgtcaccacgcctggctaattttctttctttcttttttttttttttttttttttagtagagatggggtttctccatgttaaccaggatggcctcgatctcctgacctcgtgatccacccacctcggcctcccaaagtgttgggattacaggtgtgagccaccgtgcccggcccagtctgaggtttttgtatttcatttttaggtaaattctgtatgcacatattacccaattttaaactgaaaactctattagcatcaaggtgacctctggaaccaaagggcaaagaaagaggcaggtacagacttccccatcattcctccttctcatctccttgcccttccacaaccagggaaaatccttctccgccaggcaatgacttcatcgtttccttctcactaatttgaatactcttatgggagagccaaacaaaaaatgaaaatgatgaatgactccttgtgcaatgcagaaaaaatgtggcgtttgggatctcacagtgacggaatacccctcatgcagaaacagaacatgcttctctccaaaacaaaaagcagaaacaacaaaggtatttcagagctcagaaggtgttttgccaaatggtaggtgtgtaaaagattttaaaggggcaggtgaaagcaaatcaactctcacctccaaagcaggtaactgttttatttgaaagaaaaacaaaagttccctctaaataagccacaaagctaagtcaggggagaaaaagaaatggaagagagggatgcctaacaagtaggaggaaaaatacctgctgggataactggcacatttattttaaacattgacagattttgactaaaacatatttttaagccggaactcaacctctatctgcacaccccatgtgtccaggtgactggtcagacctcaatcatgaacactaacgtctaagaatatctaaaaaagtttctacttagaaactactgttaaatcataatccaagtttgggcaatgctgctttcttatcatagatttcttactgcatcagaatcttgaaacatatgctcaggttttatttgcagtttccactgtcggtggctatcagcagcgctgtgtggggaaagcacctgtcttccttggtagctgaagaggagattaaaccaactcttggtggccaccccactccgtgtcagagactatgcaatgggctttccacagcaccacctgctctgaccttccccacatgaatggctgccaggtccgacccgcagaccatggctgaacaacggatgaacaaatgcactcagacacaagaatccagtgaaagagcaggctaggggacccggccacccacagacaccaaggagggtgctgtaatgagtcagcagccacagccccgaaaagccggcactgtgggcatttattcagtatagatttaatgacaaaggccttgagtcaacacatttgtgggcaattcacatggtcacccagacccggagagagtagttctgtgcgtggatgcttaagggcgaggttccaaggcctaagtaaactaacttacctagatcagtttatttatatccccttgttatctaacgtaagctttcaggcaccagataaaagaatctggctgccttcagccaaatccttttccgaagcttttgtaaaaccttccagccttccaagaaggtttgcatcttctgcaatttttcccaccacccttaccaatctcctacaaatggcattaccatgagtgggcattattgcagcttgtccattttaagatgagatgtcatggaatttgccccaggccagtagccaatgaagctccagagcctgccctgctttcagcatcccatgcagccttgcccagtgggaaaccagacttctaataaactcaggctggttattccaaggtcatgtctttggcccttctgctaaagaataactcctttacaatctaaagactagagtggaagcagttccaaccctcagcagattcagctcactactaaactaaaatcaacacatttggatttttctctaaggtaaacctgaactggggggaaaagagcatagagaagtccctgtcaccctctttattgattatcttttctaaccctaaaccttgccttattaccttttgtggtcttttattgcttgtttaaataaaacagaggcatttgacaaaatgaatattaaatgtagttacaatcaagcaattctgcagagtaataaacatctggggttttttttagagcttaaagagaatgtagtaatgtcaggtgcacgtgtttctgactgtcatggaaggttcaggggtctcaggaaggtgtgggtgatgcacaaggcatatccaagggactgcgaaaatgttcaaaccactgcagatttggctcttttgaaatgactgtgaattacctgtgaaaatgataactaaagggttaagatttcaaaaaaagagaaggttcaatgaaaaagagacttgcttcacatataagagaaacacaaacatggacaactgactatgttttctcatctttcaaaaaaagttggactaaaatatttttggcacaacagtaaccagcaacaaacaattggttctagtatgagaaaaaaactgtcgaaatcttcaaacaaaaactccattccaagaaaacacctaccacaccaggcacggtggctcatgcctataatcccagcactttgggaggccaaggtgggaggatcgcttaaattcaacagttcaaggccaacctgggtaacatagtgggacccctgtctctacaaaaaatttaaaaattatccaggcatggtggctcacgcctgtggtcccagctactcgggacgctgaggtgggaggatcacttgggcccaggaagttgagactgcagtgagccatgatcagaccactgtactccagcctgggtgacagagcaagatcctgtctcaaaaaaaaaaaaaaaaagatacacatatcacagtcctgaacacagaccacaccaatctgtttcatggacgtccacagcactgctgctgaaggatgcgttataaaggctaaaaagaattgcacacaaagtttaaataataatgagagttccataaatattatctatgtactaagagtctgctgacatattatctcggcgcatcctcaccctatccagtgaggcaccctgaaggagggccccacatcttctctattccccatgggtcccagagcctcacacaggatcttgcacacagctggtgtgccagagaaagtagttaagtaattaaactttttatttttaagtagactattaccagctacatgacacagataaggaaatagaggcataaaaggttactgattttcccaagtttactcgtctaataaattgggattccaaaccagggccagcaggaccccatcccaagatctaagtaatgtaaaatgaatgaaccacgggctgatatgcaatttctgcaaatactttctaccccagcttttctaccatgttatctacttttttttttttcctaaaagtctcatacaccctcaaaagatgaagactgccaccattgagaacattcaaaagataggtgctgttggccaggcaccgtggctcaggcctgtaatcccagcactttgggaggccgagacgggcggatcacgaggtcaggaaatcgagaccatcctggtgaacacggtgaaaccccgtctctactaaaaatacaaaaaaaattagccgggcgtggtagcaggtgtctgtagtctcagctacttgggaggctgaggcagaagaatggcgtgaacccggaaggcagagcttgcagcgagctgatatcgcaccaccgcactccagcctgagcaacagagcgagactccatctcaaaaaaaaaaaaaaaaaaaaaaagatgggtgctatgggtttgaaagagcttcagcagaatccctgccatggctgggcagcttgccctaccctgaaggaggccatgttcgctccactccaggtgacattcactcctgctgttctgcgcagtcaaatttgggatgcttcaagttgtccaatagtaaaatgatactcaactgcaatggattgaatgtttgtgttccctccccaaccctctgtcaaaattcatgtgttgaaatcccagcccccaatgtgatggtaatcacttttgcaggtgattaagtcatgagggtggagccctaactaatgggattaatgcccttctatctgaggaccgttgagagctctctcaccctctttctgccatgtgcggatacaagaagtcagcagtcagcagggtctggtggctcatgcctgtaatcccagcactttgaaaggccgaggcaggaggatcatttgaggtcaggggttcgagaccagactggccaacatggtgaaaccctgtctctactaaaaatacaaaaaaaattagctgggtgtggtggcacatgcctgtaatcccagctgcgcaggaggctggggcaggataattgcttgatccccggagacagaggttgcagtgagccaagatcctgccactgcactccagcctgggccacagagtgagattctgtctcaaaaaaaaaaaaaaaagtcagcagtctacaatctagaagataatttgaccaagccgggtagcaccttgatctcagacttctagcctccagaacggtgagaaacaaatttctgttgtttataggccattcagtggatgccactttgttactgcaccccggaatgatgaagacatcaacatcaacgctgagaggacactgggacggctcagttctaatgaaaatgcacctaaatagaacacattatcactatcacaaaatggtaaacatcaaaataactctaccatacttgaaaaatcggtgacaaaatatgaaaataaacaaccaagaacactaaaaattaatgtagaagcttctctgaaaaataccaggccacagaataattcaacttcaggagcttggcatgtgaaaggttaacttattcaggtgttgaattggaacaacaaaaaaaatttgatggagaatttgccagaataacccttcagtcacaaccgttgccaaagtcaaaggccaaagttatattttaaattttagaagtaaacattaaaatgaaggtttcttaaaattctccaataattttcacttttaaagtaccaaactgacacataaaaaaattcgtgctaattatcccaagcaatcaacttctttaaaaccctttatttcacaattacgctaatatcccattaatttgggacacttaccaatgtatttattctttgctcattacctatgtgcacattaagagtacaccaataacacaatacaggcattaatatgtaaaacatcaacaaaagccatctggaaagctaatgaataatcaagggatttcaaattaaactacagaattttcccttagaatctttaggacaacactgtcaagctcaatctattcacttcgcctccagaatcaatttttcaaactttatgacaggtctaatcgcttccacctgtgtctccagcttgactcttgactggcatgctaccagccagggtggaaatgtagacaaagacccctattaggatccggctgtttctctactgtgaggtcactcagccattaaattagttccagcccaatttctgtcctctcgggcctcgacttcaggggaggagggtgcagagttgagtcagttagcagcacagacccagaagggaagaaaagggggaaaagatgtttgggactgactaggtaggtgtgcacaaagctgaaaagctggagttggtcccaaactctgaaatcgaaatactatctttcttaaatgactgcagctattctccccaatgcgatcctgcccccttcccatttaaaaaaaaaaaaaatatatatatatatatatatatatatatatatatatatatatatatatatatttatttatttattttatgggattgtgtttccttttcttctccttcatttgtagaaagtcaactgtctcccacacaacatttcctcaactcacatgaggctgattcacaaaactagctcagcaacctaaaagcgccagaagtcactgagagataaaaggctggttggtggaggctctggcgtgggcgcatcaccaggtcaaaggaggtgagctgaagatgcctggagagcatctagtgttccaacgcccctgatctcacagctgaagacagtaaggctcagggaggagagactgtcaaggtcacagagctagtgaatgacaaagtcttggttccagcattttccctactagattacgagctctacagcatcagaaacaaggcccaacacacagtaactgcaaaaacaaaaacaaaacaccacacatcgctcctatatcactgtgcccacctcctttctgcccaaagccccaatgatcagaccaagaacggtgtacacaactttacaaactggcacaggcactaggatctccttctgcaaacgcaccgtcaggcatggacgctgcctgagccgccaggacacctctccagtgcctaacacagtgcctggcatacaggagttgctccagaactgcttatcccatgaggcaaagaagtcaaatctaagcctgaaacatcaagggactcaaacggtgacaaatgagaaatcagcttatttaataagaaaatctaaaatattctttacaaatacaaaacgtccaaccttggacaacttattcaggatgcacaagtatacgaaggaaattggcgtaagcaagtttatgcccatctgctcaccacacactgcggtttcacgtcatttcactctctgatggagacttggtataagtcaatcaaaaaagacgctattggccaaataaaagatgattccaaaaatagcacaatgactcagttaccccaagctcctatgtttcacagtctagcctcatgctgtctccagagggttgactatcatttatcaggagattaaatggaatgtgccacacacccactacgtcaaggcagactgaactctgggaggggcttttcctgcagtgacaatggatttgcagtggctggtccacacccacttccctagaccccatcaccaccaatagctcacattttgcaaagggattcctgagctgtagctgtgggatgtgagcctggaacacggagaagttcactgtcccagacacagacacagacacagactggacccatgtccctgggactctacttaactggctgagctaactgctcacagggaaacctactaggaaatagcacagaaaaataaaggtctctggcgtgaaacaaaactggcaatacacacagcatggtgatatggttatgccctgtgcccccacacaaatctcatcttgaattataatccctgtaatccccataatccccaggtgccaagggagagactgggtggaggtaatcggatcatgggggttgtttctcccatgctgtccttgtgatggtgagttctcatgagatctgatggttttgtaagtgtttggtagttcctcctgtgttcattctcctgcctgccgccttgtgaagaaggtgccttgcttcccttcaccttccgccacgattgtaagtctcctgaggcctccccagccgtgctgaactgtgagtcagttaaacctctttcctttgtaaattacccagtcttgggcagtactttatagcaatgtggaaacagactaatacacatggcatccagaaggtgttaccctgacaatagtgtggaaaagcaattcatggtcgggaagacatgtcagagaaaatgactggagcccaggataaaggatgaaatcacgttttctaagcaaatgagttgggtggcacagccaagtcagattcctggggaaagcgcatcactaacggggttttgagtttttactctgggggtggaggggactcagtcatcagcaagcggcacccacattgccctgtgctacttcctctccccagagtgctctcccctctattcaatcacaaacacacttccaaatttgtggggtggagacacaaggtgaaggcggtggggggttcatgctctaagacaagccactcacatgcccagagagatcaaaagaaagctctctacaccagtaccatggtagctcagctggtactgaaataccagccctcaaaaaataccacaccctcaaaaatctgtcagaaatctccaaatcctcctagatgtgtaaacacctaaaaaaaattcctctaattaccttgagtaagcactgaaacaaaagcagtgttataagtcaaataattatcttcacctgtgatcctaaatctggtagaccctggcactatcagaaggtatactactttcagggcctccaagtatttttcttggtagtctgaaaaactgaaagtacatgcctgaggcagaattctaattgtcttccaatgtctaccaatgtctaccctcctttcctccttagtgatagaagcctggtttccagttagatccatggttgcctactataaagaccacatttatttcccagccttgtttgtaggtcacgtgactaggtcctgttcataatacataaacaaaaaggccatgtgcaacttctgtcccttgaagaatggggatgtagcttctttaccccttcctcccacttactggctcaagtaagaacataaacactgggatcaccatcctggacatgtgctgaaggtggccgagcaactcagctgggtccttgacacgtgagccaacgcaccaatgctggacttcccatctcagcctatctcatttgcaggagagaaaagtaaacttccatcctgttcaagccacttctattttcagatatctgttgcacacagtgaaacctaatcttaattgacctaggaaccggtacctgaaccgggggtgctaggtctcagattttatgtatgccccagaaacaaggcctaaaaatgcagcctgatatggaggagatgggcagaggatcactggcaaagacacaggtctcacaggttctcgactgctgactgccgcagcaaaacctttgatcgagtcctgaccttctatatgttgggaggtagacctggtgtctgttagaagctgtatccttacaggaaacagctctgaaaattcaaaatgtcagtgcttgccagtccttgacactctcagcaaggttcaatcaagagaaatgatctccaactaaagctaactagtctcaagaaagtgggaaagaatacagatttgattagaaaggagctctgtgtcagcaaccagcaatctaagtgagcctatggggctgtccctgcagccccagcaggagataagacagatgctttaccacatagagcccagaagccttgtgccaaagatatgattaagggcctggccttccacccaagcccacggtttcatttggcccaagggagttgctattaaattgggagggaaaggaatggcagagcgctgaggcctttaaaagaccagagtttttaggctgaaaaactgtctagacaagatcttgatggttactcacatggaaccaatcagaagcaaacagactagagggctactaaagtcctgagagacttgtatctctacagaaaccttaaggctggcctataaaaagctgtgactattcagtcctcaaaacaacacccagaccccaaatcctcccagcaagcgggttttggaagcccatcctctccagcatccatctccgatgtggtgcagagaagaccctttcagaaggcaaagccatgactccaaaagatcccaggcaagagagttcccggagggcagaacgcgggttgccagacagcgacaaggaaacatagtggccgccagtgcagggggtgcagggagacttgatggtcgtgatttctactacagcagtgtggcacatggtgtgctgggggcagagagctcgtctgtttcagctaacagattgcaagacctcaacaggtacatccggccctaaaagagaaaacggcacatcatccagagatcctgaatctgatcaagtggaaggaaatgaatgtcataccagggccatcttccttgaggaagaggtgagagttttctatggaggggaagacaaatgcatgtggatatctgggacctcagcagaaactgctggctgttccccactgtgtccttccccgtcttccttaggaatacaactcccaattttcagctggtgcaggttccatgatggggaatggtagacggagaaaaagagattttgtaaatcatatgatcaagatctatatctaacataaatttcactcctacttcagcccattaggaaagagctgctcaattgctgaagaaatgatacacacagacgaagagagaaataagcattgagagaacccagtccatagttctgaaaattcttcttgttctatccaatagtttcatcaaagtgatagtctcatcatgttgcccaggctggtctcaaactccagggcttaagcaattctcctgcctcagcctcccaaagtgctgcaattacaggcatgagccacaaaaaaagtatcccacttttttttgagatgggagtcttgttcggtcacccaggctagagtgcaatggcgcgatcttggctcactgcaacctctgcctccaaagttcaagcaattctcctgcctcagcctcttgagtagctgggattacaggagtgcaccacaactgcctggctaatttttgtatttttagtagagacagggtttcactatattggtcaggctggtctcgaactcctgacctcaagtgatccacccacctcggcctcccaaaatgctgggattacaggtgtgagccaccgcgcctggccatatccaacattttttataaatattcagaaacaggaacaattccacacacagtaaattctgttacctagaattctacacactggtataatactagtgtttgacactgttccagtaacaactccaaagcactaaaacaacagtccccaacctttttggcaccagggtccggttttgtggaagacagtttgtccatggacagggggtttcgggatgaaactgctccacctcagatcacgaggcattagtcagattctcataaggagcacgcaatctagatccctcacatgcacagttcacaatagggtttgagctcctatgagaatctaatgctgccgctgatctgacagggggcggggctcagccagtaatgctcacttgcaccactcacctactgctgcgccgccccgttcctaacaggctgcagaccacagcccgggggtcggggatccctgcactaaaaaataatgtatgagattcgtggatttgtttaaagcacacaaaagcagcaactggaagagaacagctgccagtacacataacctattattactatcacaaatagactatgtttccataagtatagctcgttaacatggtttggatttgtgttcctgcccaaatctcatgtcaaattgtaatcagtgttggaggagggcctggtgggaggtgatttgatcgtagaggtggatattccccttgctgttctcatgatagtgagttctcatgagatctggttgtttaaaagtgtgtgacaccaccccctttgctctcttcctcctgctcccatcatgtaggacgtgcctgcttccccttcaccttctgcaacgattgtaagtttcctgcggcctccccagccatgcttcctgtacagcctgcagaactgtgagccaattaaacctcttttctttgtaaactacccagtctcagttctttatagcaatgcgagaacgaactgatacactcatgtaggatcaaatatagttttagaaatattttagtcttattcttagaatgtaacaggccatgtattttgtgcatccatctatctcgtggtccctctgacatcaagatgacctcttcaaatgtcttctccttaaaaaggcaactgcctccccgcgccaggaatttcttcccaggttcactgactcagtaggtttctgtgagtaacctcacttcgtagtgttaggaaggaaccctgggaacagcggatgcagggcatctggtaagctaaggccgccaacaaccattcatccagtatcagctctgcaccaagcaagggattcataattaataatcaaaccaaacaagaagagaaacaaagattcctaaacaccctcagaaaggccaaaatatttttcccctttgtaaaagtaaaaactcttaaccctatgggaggttccacctctagtgttggcaagctcagcttcaatgtctgtcaaacacttttacagacccaagtttcctaaggcagaggtttttttttttttaagtttaatatcaaaagtgaacttcctgatatccaagaatattaaggcaatatatttatacaggttcttttttcacccaaaaacacaggctggacagcgtgtggtgaagcccagccctctgcggatgtgcgggagcctcagcctgtccgcactctcagggcgtgtgctgccctcttggtgacgcgctgccctcttggtgacgcgctgccctcttggtgacacgctgcctggccacgagctccaggaccacacttccaaggttcccaggtggcaatgacacgaaatattcttcagtattctccacagaaacaacaaaaatggcctggaagtacccgtatttttctatctgaacttcacctccccaaatcttttgttcaataacttgtctcatttttttattcagaaaatgtaactatcgcgagttaccccttcgatataatgaagtcttcgcttgagtaacaaaggattattacagagtttgcaacaagcaagtgatgactgttccatctaaaagaacaggctttttccttttctactgggaatcaatggatgtcaggggtgaggtggaaacaggagagttaagaagcgctgaaaaatgaaagtacctatgacatcacaaattaactcagtacacaacaattactaatgaacacggctcacagctcccctcccagcctgcccccattgctctgataatcctcccaaacaactctgccaatgcctcctctaatacaacacacatactaacactgtcattctgatgactctaagtgtgacagtcaagaaaatgctaaagttggctcatcattttatatccatatagcattaaattccagaaactattatcaagaaaaaggccaaaatattcccatacattgaattatacatctgtctaatcatgtggtcccatgagtgaaatgcctagaaactatgaatccagttatttttggaatatttcacgccttaaattttaacaccgcactgagggaaggcacttttgttattccctccctctataaccaaattttttaaactaaaatagtattagtactattggggagttttaaaaaattcctttcatttgttttctatttttttaatctttaatcagagtctatgtaacagaaggaatcaaaaggaaaacctgcagtaagagtaaatttctaatatccaaatggggttatcaactgcttaaaaaaggtatgggggttgggaatgggtggctcacgcctaaaatcccagcactctgggaggctgactcagaaggatcacttgaacccaggagttcgaggccagcctgggcaacatggtgaaaccctgtctctactaaaaatacaaaacttagctgggcatagtggcgtgtgcctatagtcccagctacttgggaggctgaggcaggagcaacccttgagctcagaaggtcgaggctgcagtgagctgtgattgtaccactggactccagcctgggtgacagagcaagatcctatctcaatcaatcaatcaatgaataaatgtattggatagcaatgtaccaaaaacacttttcaaaatacaaagctctgacctttttcaatttacacagcttaggtgtcattcaaacttcctattcaaatgcccctgaaaaacatcctgtattaaatgtctaacactgattgtaactgcacaaaagaagaatgataacctgagcaataatgccaccggttaaacatcttttttcataatattcgtttatcaaagaacattctgagggcctgattcaaagaagcaagacacaaagcacaaccaccttccattcccataaaaaacaaacctgtgatcaaagaacttcaatttcctttcccacgatttaactcttctaggacaagagtacttccaccttgctaataggtctggtcaaacgtattcctctacaactctatcccctccccgtctattggtaagagaggatgatcaatggaacaggactcctctgagcagatgcagacctgctcacaccttacccatccaggagacgcatcgttgtgggggtcacttcggcaaacaaaattactttccccaactgcttggtctgcagattttggcgatagatctctaagttgaaatgttctgatgagaaggcctccatgttggtcaccacaggtatacaagatggggttatttctacttcagacacgtaggatgaaacaaatctaagagagagctggccggattttatttctccctcggagtccacatgtttcccaagccactgcataagaggatccctgatttcctgtgtcataaagaaagaaatgagatggtcgtaatttggcattacattagatcatggtagcttttccttataatgccattttggtaatatgagtacttcctaattcatgaccaagaaaagctagattaacatattccatacatctaaacgattagacaatatgataatcatatacttagtatacttatactataaaataagctcttcagaaaccaggatccaagaaaatcagttcagttcatgattatacttcctatcttacatcttacattctctcatgattttcaagattcccctccagtccagagttcataagtagttctccagtcctccgttcattttacggaaaacttttatctttttgccccacaaagaaattcattatcctatttgcaaaaacaacaacagaaaaccctgggtgaaagaagtcacagaacacaaagcactcaaatacaagaacactcggtctcagcctcacatcttagagaatctccgcttcctcttgtaaagacaaggcaagttgatcaccaacaaagaagacaataatcttcacaaagggaaagtggggtaccccaaagctgctttctgtttgccccaaatggaggtacaaggaggagaaggaaggcaaaacctagaagagacgttgtccaatccaggcacagagctctctactctatccccaaaaccacaaggctggaggaggttcccccacgccagaccttagaggtcccagaggccttcctccagggtggtttatcaggaactgagggctgagggaagtcatcatctcaagaggcctgtacaaaacttactaagatctcagtaaacacagatccaggctcttaggccatcctcctgcaaacaccaggccctttacgtcccaaagctccctgtggctacagagtagtggcatcagagatgaaacttaattcaactaatttcaattgatcaacctttaaaactcacatctagtttgcagataatacagaggagaagagaacgagtcaaatgacttcagaagaaagcattcaggtccgcgcgcagtggttcacacctgtaatcccagcactttgggaggcccaggcgggcagatcacctcaggtcagtagttcaagaccagcctgaccaacatggtgaaactccgtctctactaaaaatacaaaaacttgccaggcatggtggcgggtgcctgtaatcccagctactcaggaggctgagacaggagaatcgcttgaacctgggaggcagaggctgcagtgagccaagatcactccactgcactccagcctggcaacaaagagtgaaactccatctcaaaaaaaaaaaaaaaaaaaagacaagaaaagaaagcattcagaagaaatccaggggataaaacattttacagaacagccgggctggaatcttcaactagtcaatgtcacggtggagatggggtggggacacagaggtggagagggagaccccgtctagattagaaggggcttaaaagacataatgaaacacaatgggtggttctttattggatcccaacttgaacaaactagctggaaaggacaattaggaaatctgaatgtgaacagtatgcattagacagcaaactggaattactgtcagttttaataggtgtgacaagggtactgtgggggccaggcgcagtggctcacacctgtaatcccagcactttgggaggctgaggcaggcgaattgcttgagctcaagagtctgagaccagcctgggcaacatggtgaaaccctgtctctcctaaaaatacaaaaattagccgggcatggtggcgtgcaactgtagtcccagatactcaggtggcagcggtggaaagattgcttgagcccaagaagcagaggctgcagtgagccaagatggcgccactgcactccagcctgagtgacagaaccaaaccctgtctcaagaaaaaaaggaagtactgtggtgacataggaaaagtccttaatttttaaaaatgtatatacgtcatgaaatctgtaaaatttacccccaaaatacataaagtaaggcaaaatgttgataattattcaactatgttgataattattaaatctagatgatgggtatttggggtatgtgttacagtattctctctattcttttccatgtttgagaactgtcataattaagagtaaaaaaaagtggtgaaataaacataagctatttaaaaataataaattcaggccgggcacagtggttcacgcctgtaatcccaacactttgggaggctgaagagggtggatcacttgaggccaggagttcaagactaacctgggcaacatggtgagaccccgtctctaataaaaatacaaaaattaactgggcatggtggcatgcacctataatcccagctactcaggaggctgaggcaggaaaatctcttgaacccaggtggcggaggttgcagtgagccgagatcacgccatcacactccagcctggagacagagcaaaactgcatctcaaataataataataatgaattcaattgaccatacactggcaacctattccctctgtcatccattcaacaaatgttacgggatatctcccatatggcaggcagtctcacaggctctgaggacggagcaatgatcaaaggggtcaaaattcctgtctttggagggttaatgctataatgtgggagtcagaaagttaaaaaagtccgggcgcagtggctcaggcctgtaatcccagcactttgagaggctaaggaaggcggatcactcgaggtcaggagtttgagaccagcctggccaacatgacaaaactccatctctactaaaaatacaaaaaattagccatgcatcgtggtgggtgcctgtaatcccggctacttgggaggctgaggcacaagaatcacttgaacccaggaggcagaggttgcagtgagccaagattgcgccactgcactccagactgggtgatagagtgagactcagtctcgaaaaaaaacaaaaaacaaaaaacaacaaaaaaaacaaagttaaaaaacagtaaacacaatacacagaatgttagagagtaacacgtacaaaggagggacaagaaagcacagaagagagggaggccacttcagaccagacagatggaggacctgctaagaaggcaacgcttaaggaaaggcctggagcaagtgaaggaggatgctgggacaaaatccacagaactatgtttttatatttatttataaagggattccagcaagtgcagaggctcccggagcagggaaagagcctgatcagggcacagcatttgagcagagtgagcctgggcagaaggtggagtgccggggccagaaaggcagagggggtggtgagagccaccgtccacatcgcggagggcctcaaaggccacagtaaggacggggctttcactcgaggagcaacagggagccccagaaggttctggggaaggtcgtgggatgtcctacctctgttggagcaggatcaccccactctgactcctgtgttgagaagagcctgaaggggaacaaacaagcagagaaactagttataaagtcacctaaatgagctaggagtgagactactgcctggaccagcatgcagcagacatggtgagaaaggataggattcacagtagactctgaagtacaggctacaagatttgctaacaagtcatatctgagatgttagagaaaacaggggctcaaaaaagagcccaagatttctggcctaaacatctggaaggacagatctgctgctggaaatactataggaagagcaggtttggagaggaagaggcaggaggtgagccctgggtgtgctaagcttgagatatctattaaaaatcccacgggggctgggcgcggtggctcacacctgtaatcccagcactttgggaggcccaggcagtcaaatcacttgaggtcaggagttcaagaccagcctggccaacatggtgaaaccccacctctactaaaaatacaaaaattagctgggcatggtggtgggcatctgtagtcccagctacctgggaggctgaactcaggaggtggaggttgcagtgagctgagatcatgccactgcattccagcctgagcaacagagaaagactcggtctcaaaattttttttaaaaaaggaaaaaaaaaatcccttgaaaacaatgaattggcagtagaacatgtgagtccagaatccaggggagaggtctgcaccatggatatcaatttgagaattgtcagactatgggtgatcatttaaagccaagaaagaggataagatccatgaaaagagtgactgtagttaaaaagaggatgcaaagtagggctgctgtcacaaaggactacaaaccgggtggcttgagatgccagaaatctattcttacagttttggaggacagaagtcaaaaatgaacacgtcaacggggccgtgcctcctgggaaggctctggggaaactagtgttcacgcctttgcttctggtgccgctggcactccatggtgcccctcggcttgtacacacatcacccccatctctgtggccatcatcacatggcgttctcctctttaagtgtcccgattctgtgtgtcctctagtcttctgaggacagcagtcgtactggattagggatccaccctaatgacctcatcttcacttgattacatctgcaaagacccagcttccaaataaggtcatattcacaggctccagggctggggctttcacatatctttttgggggacacaactcaaccaacaatagcagtccatgcttaggtttcagggagatcaaaaagagtgtgcaaaagagattgagaaagggagagaaaaatcaagtgtgtctgtggacagcagtggggggcggtggttgcgggagtctcctgactccagtttggaaggttggaagacgatgacagtgccgtggggagagggctgagaagtcaccgctggccttggtgccacagagcccagactctgatgagagcagtttgagaggcgtgatggaggccaaagtcagatgggagtagtgaaaagagaaaaactgcagactccaggataaaactctggcaaagggtctcctttaaagggtagagaggaatggggcagtggctagagggaggaatggggtgaaagcaggttttgtttggtttagaggggagaaacagcagcattttcagattgatgtgaaaggtcccctagagaaaagaatccaaagggccaagtggggtgggacctagcacagaagcagaaaggtcagccttgggagcagagacagctcacccatagggatgggggtggctcaggttcccctctgcggacacctggtcttatgaccccactggctgcagaactcccttggcccttgccggttgcacagccatacgggacagcctggtaactgaaattcgctgctcccaccctgctccacagctgcagggaggtgggaatcctggtgctggcagccggtagaagtcatcttatgattgcttctatgttctcaataaataggaagcaagatcatcggctaagagagaaaagaaggaaggaggtgttgaagtttggggagggaggaacgaacatgacaacagggagaatgagaagacgaatgcagtggggagaatcttctgagcagcgccttccccagggcagctggaagcatttgagcaccacggaaggtcagcgactctgaactgagagtgagaagtccgcatgattttgtgtttttatcctgccacagtcagctatccagccatgtgggcttagcagagaggaggcagtgagctgaaggtgtacagaaagcagtaactgagactaaccgaccacaaatgagacactgctggagacaggaagataaatatgagtgatcctgttggggaggagagtgagaggaatgccccaggaccaaaaagcttaggtcagcaccagagagagctcccagagaaggcatgcaaaataaggggtgatcctgcttgcaaagaaaccagaaaagttgttggaagaggtcaagctcaaatgagctaccaaaagctacatttgggtcctatcacagtactaattttcggttttcggactacagaataccaagatatatttcaaatggattattccctgttcatcattctttccttggtatatactctattggaagaagaagaagaaatgaataaataacatacaaaggtgatccccaaacctcaaatctggccattagttataaccaactctgcccctaaaactttggtcaatgcccttaaagcataaaatgcacagatctgaatttccatcactttccccagggcagctggatgtcaccaggtcaccacacaggctagagatacatataggtgaattaggttaaatcacaaaaacagaaagataaaactattatttaactcaagcagagagctaagaggttattcatcagatgatggtaatacaaatatcccattcaaagtcaatgaaaaccaggataaaatgaaaaagaaacaaccagcactaagtagaactttcagaacaggaataatgcaggaattatcctctaaagtgaatcatccagattgactatggtatacatcattcatttaagaaacatgtatggagtacccacggtgtctcaaacacagtaccatggtagaaagagaagaggaaggacagatattgctatagtttgaatctgtcctccaaatttcatgtgttggaaacataatcccccaattatatgttgatggtacttggaggtggggcctttgggaagaaattgagattgaatggggtcatcagggtagggcacctatggtgggattggtggctttataagaagagaaagaaagacctaagctggcacactcctgccctctcaccatgtgattcccttcccatgttataatgcagcaagaaggccctcactagatgctggcaccacactcttggattttccagtctccagaaccaagagctaaataaacgtctattctttctaaattgcccaatctcaggtattctgttatagcaacagaaaacggactaagagagatgcatacacataactacaagacaaaaattcactcaaactattcaaacatacacttctctttggcaaagtaagtcaacctgacttgccaaatttaatcatctattcttatgtgcatgcaagttgagagccatattctcaagaaattacatcatcattgttatgtctactaattactaaagtaacaatctaaattatttgtttttgaaagcaatacttagacacgtacaaatctgcaaaataaaactgataaaagcaaggcatgcaggtttttttcttatacttattttacataatctttcagggcttactcagaaccaagtgaattactcagaacaaagagaatctaaaaggtatcaaatgaaaccagggccctcttatgaaacataactatataccacccataattctcttaaatatttatattcactatagtcaaatacattttaagtaccataggaagcatttagcctcccccaaaactttctccccgctccaccattaaccctggacaacataaaaattctgaataaaattctggttgtaagaaataccaaaattactatctgtttgatataaatctgcctggcatgtcttctcaaatgcactcaaattatgattatgacttgagagttgcatatacagctgctaataatacatgtagggaaaaggaattaattcatgactcttgcctaaactctcctaatgaccatgcaatgtaaaaatgttactgaagaaaaaaggtttggatcatagacatcaagacaagtgggctgacatataagtagcactacccactctgcaatacgcaaatgcacctatttctttgaactcaactatcagaggatagctaaaacgtcacttctatagggaggatgtctctgacccacagccgttcacaaactttcgtaaacccttagttactttatagcacttatcacgactatacataatttgtataagtgcttattcaatgccacactgtcttattagaatataagttccataaagataatatacatatgttcctgttttgctcccaacggtatccatggaacctaggacaaaagtgcatgcttaataagcatttactgtataaatgcacattaaaaccttaccaaggaaaactctccaaataacagatagataggtaatcaagaggtaaaactcaaaaaagacaatgagagagtatggtcttgagatggctacgtaagcatcaaaaataatgcacagtctttgaaatcattacagctagttctattgacaacaaacaaccactatcagattccacttcaagggggtttataaaattctaattaatgttatttttctaacatttaatcttcaagaatttagtatttctcttcttctaggatttcaggttaattaaatatgatttgggtggaaccaacagctgaatgctttatagtcacataaatgtggcccttttaaatcagccacagcaccagtcattctcaagaaaggtgaatatattctttgtcttttattgggtcatgttgcacaggacatgaaaatccaaaggaatcttaaaaaaaaaaatagaactaataagtgagtttagcaaggttgtgggatacaaggtcaatatacaaaaattggctgggcacagtggctcacgtctgtaatcccagccctttgggaggccaaagtgggtggatcacttgaggtcaggagttcaagaccagcctggccaacatggtgaaaccccacttctacaaaaatacaaaattagccgggtgtggtggcacacacctataatctcaggtacttgggaggctgagacacgagaatcacttgaacctgggaggcagaggttgcagtgacctaagattgtaccattgcactccaggctgggcaacagagtgagactccatctcaaaaaaaaaaaaaaacaaaacaaaaattgggtgcatttccatatactaacaataaatatttggagcctgaacttctttaaaatatcattttaatggcatcaatagatctgaaatatttagggacatatttaacaaaatatgtgccagacctgtttactgaaaactacaaaacactcctgaattaaaaattaaagatgtctgagcatcataactcatactcgtaatcccagcactttggaaggctgagtatggaggatcacttgagcccaggaatttgacaccagcttgggcaacatggaaagacctcatgtctaaaaaaaagagtttttctttaattagctgggtgtggtggcatgcacctgtagtcccagctagtcaggaggctgaggtgagaggatcacttgagcccaggagctaggctgcaacaagccatgatggcaccactgcactccagtctaagcgacagagcgagaccccatctcaaaaacacaaaaagaaaattaaagaggctgtaaataactgaaaagatacaccatgttcatggatcagaagactaacactgttaagatgtcaattcttcaaattaatctatgggttcaatgtaatcccagtcaaaatcccagaaggctttttttttttttttttgtagaaattaacaagctgaaaatagaaactattttaaatggtcaaaacaattttgggaaggaacaaaaagttggaaaacctacattatctgctttcaagacttactataaagttgcagtatatcaagacggtgtggtattggcacacagagataggtatagattactggcacagaatagggtacagaaatagggccaaacatataagtgtgattgattttttttaatttttttgagacagcgtcttgcgctaccacccagtggggagtgcagtggtgtgattacagctcactgcagcctcaaattcctgagctcaagccaacctcccaccttggcctgtttgattgatttttgacaacagtgcccaagataactgacttgaaaaatgataatctttgcaatacatggtgctgaaacaaacattcatatgcaagaatatgaaaccttgatctctatctcacatgtatataaaaattaacttgaaataaatcatagacctaaatgtaaaactacaaaccttctaaaataaaatacaggagaaaacctttctgactttgggtaggtaaagtttttttcagatggaacaaaataagcatgaaccataaaaggaaaaaagtgataagctggactttataaaaattaagaatattaacaactgctgttcttgaagagataatgctggccagacatggtagcccacacctgtaatcccagaactttgggaggctgaggtgggtggatcacctgaggtcagcagtttgagaccagcctggccaacatggtgaaaccccatctctactaaaaatacaaaaattagccaggcatggtggcatgaacctgtaatcccagctacttaggaggctgaggcagcagaattgcttcaacccaggaggcggaggttgcagtaagttgagatcatgcgcactccagcctgggcgacagagcgagactccatctcaaaaaaaaagagagagaaagggaaagagagataatgctaagaacagtgaaaagacaaacaacaaactgggagaaattattctcaatacttatatcagacaaaggacttgtatccggaatataaaaaagaagtcttaaaattgtaagaaaacaaacaattcaacttaaagcctgagcaaaagagctgaatagacactgcccaaaagaaaatatcggatcgccaataagcacatgaagaaatgcttggcaccatttggcaacaggaaaatgcaaattaaaaccacaattagataccactatacatccacctgaatggttaaaattaaaaaactattttaagcccaggaatttgggcctgcaatgagctgtgagcacaccactgcattctagcctgaacaacagagcaagaccctgtctccaaaaaaaaagaaaaagaaaaaaaaaaacattctggccggccacagtggctcatatctgtaatcccagcattctgggaggctgaggcaagaggattgcttgagcccaggaatctgagaccagcctaagcaacacagtgacacccagtctctacaaaaaataaaaaaacaaaactagtcaagagtggtcgtacacacctatatcccagctattcaggaggttgaggtggcaggatcacttgagcccaggaattcaaggctgcagtgagccatgactgtgccactgcactgacagcctgggcaacagagcaagatcctgtctcttaaaaaaaaaaaaaaagaatctgacactttacaatggttggcaaagatgtggagtaactagaactctcatgccctactggtgggaatgtaaaatggtacaatggttttgaaaaacagttggcagtttcttgtaaagttaaacacacacttctcatatgaccgagaaattctactcctaggtatttacccaaaagaaatgaaaacacatgtccacacaaagacctgtatgtggatgttcatagcagctttactcaaaacagccataaatgacagcatatccatacaatggaatactactcaggaataaaaagtaatgggctacccacacatgcaataaggacaagtctcaaaaacataacactgatcaaaaaaaagaagggtatccagtacactatatgattccacttagatgacgtttcagaaaaggccaatctaatcatctagtgatagacagtatatcagtgatctcctgaggctccaggcttaggggtggatgagcgcatgagaactgattaagaaaagtaacaaaggcagtggctcacgcctgtaatcctagcactttgggaggctgaggcgggcggatcacaaggtcaggagatcgagaccatcctggctaacacggtgaaactccacctctaccaaaaaaagacaaaaaattagccgggcgtggtggcaggtgcctgtagtcccagctactgagggagactgaggcagcagaatggcatgaacctcggaagcggagtttgcagtgagcctagatcgcgccactgcactccagcctgggcaacagagcgagactccatctcaaaaaaaagaaaggtaacaaaggaatctttcggaatactggaaatgttctgtgtcttgattgtaaaggtagttacatgtaaaacatttatcaaactgtacactaaaatgggtgcattttcttgaatataaatcataactaaataaagttgattttttaaaaaagcaaacagcaacaaacctatgcaacattaaacaatactaaggcccaggagactccatattcactaacgtccaaataacaccaatatctccacttctaaagagagtgaatgcttgaatctgtatctagtgcaaattcacagaagtgactactctatggtgggtaaacatattgcagcatctgctacagacagagtgcaattaagatcagaaacccatgttatactgtgtctcgccactttatttattgattggaggcagcgtcttgctttgttgcccaggctggagtgcaatgacgtgatcatagatcactgtaaccttgaactcctgggctcaagcaatcctcccacctcagactcccaaagtgctgggtttacaggtgtgggccacatcactttagagcggttccacccctgttacttgtcttatctgctaaatttacccagctaacaagattcagtgttgaattcaaaatatttcttatgatctccatgtatgttttggagcttcttttcccaagaaacaccaaataattgatcttaacccataaaggttttctatctcagagacacatttgcctcattgcaaataataagattagttgtgcttcagtcataacatcgtaagttgctaggcagccagaagtgagttaatcagaaaatgaatcatcaaagacatggtacgcaatctccttttatgggtgtctcattcttaaaacactttcaaggaagcagaagcaaatatttgtctactcgtatggaatttatatgacgcaatccaattcttactattggtatttgacacgcaaaatactcacacgcaatttcatgttcgcttggtgtcttcactcacaggacaaagccagatggcacagcaaatctttataatcaaaagatggcactcctgggccgggcgcagtggctaatgcctgtaatcccggcactttgggaggctgaggtgggtggatcacctgaggtcaggagtttgagaccagcctggccaacatggtgaaaccccatctctactaaaaaatacaaaaattagccaggcgtggtgatggacacctgtagtcccagctacgtgggaggctgaggcaagagaatcgcttgaactccggaggtggagggtgcagtgagcagagatcgcgccactgcactccagcatgggggacagggcaagactctgtatggaaaaaaaaaaaaatggcgctcctgaaataggactatttttttttcctgacttcatctaaggcagggattgatcatctgacaacccttggggtgggcgtttattcagcgtgccagtaccaagcaaagcaaggctccatgcaggtttgcgaaatgcctgtctgggtgtctgcgtgtgtgcacctcctcaccagcctggtcccttatgcggcagcttctgtctagccacactggtcccctgtggtctaaccaacccctgcctgacctgtccaggttccacgctgcacggcactgcaccctggcatgagttcccaaaactgctgcttcctgcttcccaccctgtgttctgccactagccccaagcaccggcacacaaaagcgaacggctctgaagggcttccaccttccagtggcttactttgctgaaaccagtccattttcacaaacatccaggctgaccgtcacttagggacaccctcgggccaaaatgaatctggagatgtggtttatttagcccacattttgaaccagctgcaacacttaaaaattgagatatttcatatcaaatttcctgcctcttttgaagcagcagcaactctttccacacagcagtaatgggctacagccaagtagccaccctcatcccgtggagaacgcgctccagctggccctgtgtgtccccagcagccagctgcactctgcgctgcctctcctgccccctcccctggcctctgggttagagaccactcgtctcagccccagcagcaagcctggaacccatccagccatccttctctggggccctgatgatgcgtccttccagttaggtccattttaactccccagactgagtctagtgacactgactctcagaacagaaggggactattttggtagttcctcaaaaagttaaacaagaggccaggcacagtggctcatgcccgtaatctcagcactttgggaggctgaggcgggcggatcacaaggtaaggagatcgagaccatcctggctaacacggtgaaaccccgtatctactaaaaatacaaaaaaaaaaattaaccgggtgttgtggcaggtgcctgtagtcccagctacttgggaggctgaggcaggagaatggtgtggactcgggaggcggagcttgcagtgagccgagatcgcgccactgcactccagcctgggcgatagagcgagactccgtctcaaaaaaaaaaaaaaaaaaaaaaaacattaaacagagagggccgggcgcggtggctctcacctgtactcccaacactttgggaggggccgaggtgggtggatcacctgaggtcagaagtttgagaccagcctgaccaacatggtgaaaccctgtctctaccaaaaatacaaaaattagccaggcgtggtggtgagcacctgtaatctcagctacttgggaggcggagacagaagaatcgcttgaacccaggaggcggaggctatagtgagccaagatcatgccattgcactccagcctgggcaacaagagcaaaactccgtctcaaaaaaaaaaaaaaaaaattaaacagagaattaatacatgatccagcaattccactcccaggtataaacccaaaagaactgacagcagggacccagatatgtgtgtgccaatgatcatggcagcattattcacaacagccaaggctggaaataacccaggtgtccctcaatagacaaatggataaacaaaatgtggcatatacaattaaggggatattattcagccaaaaaaaaaaaacaaggtatgaagttctgatacatgttataacatggatggaccttgaaaacattacactaagttaaataaaagccagacacaaaaggacaaatattgtatgatgtcacttgtatgaaatatccagaataggaaaattcataaaaatggaaagtagaacagaggttaccaggagccacagggagaggggaaggggaattatttattcactgttacagagtttctatttaggacgcttaaaaaaaaagttttggaaatatagagtgaaaatggttgtaaaatagtgtgggtgtaatttacaccactgaatcggagacttaaaggtggttctaacagtaaacttattttatatatattttatcacattaaagagagaaagggagagagagaaggagtcaggatctcagttcctttactctcacaaagctccctgtcctctatgcaattagccaccccccccaacccctgccatcaattagccctgcagaccagggggagcaaagggacagcttgcacaggcaaccgaggggtctcgctgtgctctcctctgggtccctccttgctgtccctgagtatcactaagagaggccactcaaaggacctctcagaacaaaagtcatttccaaggtgactttccacccacttctccagctaaatgattttaagttctgcttaggcacccacttagctacaacaagagtatgaaagccaccactttctgcacatccatccactgccaagcactgctgggtgctgtggacccaagatccccagtcctttccaggcgacacctctgcatcattagcaccgtccacagcagaagaaatgggaccccagacagcattaacgactgcccaaaccacacaggcagtataccgcagagctggaatttgaacccatgaaaccaaatctgtctggctcccaaatccttgctctaattcctatcccacggtcctcacaaagagacctacctaacccaaaatgcagcaaattaggaaatgcctattttctataatcaaaatgctgatggtatcacaaagatataaactcaatatgcaactatgaataaacataaaatggatgtgtatggctcagagctgggggtggggtaggagggagaagggcagtgggcaggggtgggagcagagtgtttgataagaaaaacttcaatttggcggggtgtggtggctcacgctgtaatcccagcaatttgggaggcccaggcaggcagatcacctgaggccaggagtttgagaccagcctggccaacatcgtgaaactccgtctctactaaaaatacaaaaattagcagggcatggtggtgggtgcctgtagtcccagctacttgggaagctgaggcagaagattcacttaaacccaggaagtgaaggttgcagtgagccgagatggtgggccactgcaacactccagcctgggcaacaaagactccatcttaaaaaaaaagaaacttgaatgtgaaccttgaagctaccacccactagctgtgcctacttagacaaggctgtgagaggacactttcacaaagaaataaaggttttatcatgtaagtgagctactgctgacctcacccctatctggtttctgcaggaaagaggtgtcatattcacaagggttctgtaatggaaggactgtgggcagaggtaagagaacccaagaacaaggaaggggtgccaaagcacttggaaccagcaagggactgaaggagcaagagggggagctgctaatgggaaataatattaataccttgacctctctcaaatcctgcccatcaatctcctgccagtgcagccagtgatgagaaacatccagagttaggagcacgggagcccagggatgggccgacaggtgaacggtccaggggccagcacatctggctgggtgggcttgctggttatgcgtcccctctcacatccagccctgcacaactctgacttagtcccagcaacaacatgaacttctacacagcctgatctagcgatgagcccaaatcgattcagcaactccaaaggacttaggattgatgtcattggctatctaacccccaggaatatgagttcctccagggctgaacttgccacagggctttctagatccccaatgcctgggacacagtaggcactcaataaatgtctgttaagcggtcttccttttataatgtaaagtgatagctcaggctcagacgctgaaaggcccaggatttactgcatttttttgttacctgccaactagcgaagaccacaaaaggcttgagtagaacagtaaaagcagggagtgaataagtcatttctaataaggctggttttataggcatcacacctccaccaagccaaacaggctcactgtagaagcggaatctattctgcaagtgcagagaccaaagagaaagccagggttggctctaacggcgagggcggctctatggggcagctcagccactgcctccacaatgagagacgcgaacttccactcactggtctcgtgggtgcgggaccgacacccacaggagtctctggggccttcattaagcctgcccaaggaaaacgcccgccatttgtctcagcccaacacaaacaggcttctgacagagcaggcagcgtgggggtggagggcatggaaaacgctggggctgagccctgggggcccataggcagccctgcctggtgcacccagaggtgcccatcctagccgacatgcacaccaacgtgaccattcacacgttcccttccttctgatgctgacatgtccccccgccccaccatcctcagctatttgcctgttacctgccagccccacctgggcttcttgtgggggcaggggactctggcatgggatcctgccctcagctctgccaccatcagctgtgaggccgcaagaggcactccctgggctgaccgcagcttcttcatttttctaacgagaaaacgagaacatctctctctggtaaaacggagcttcaagattcaatgtttagcctccactgtttaattctcagttgaaattttaacatcatgttatgttaaaatatatgttacctggaaagagagaagcggccccatatcaagaggccaagagctttctgctccaggaccttatcttagcaaaggttcactggtccaactggctgtcaccatgacacttgggaacattcagagaatcccagggaataacacctggccaggcctggcaggagagaggggagcggcgtccaacactgccctacgtgtgcaaggagagggcgggtctaaccccacacactcaaggccacggtctaagaagctccggctcagaaggtgcattcgttcataggagaaaagcagagtttctactgaaaagtgtttttaataacacacaaaacaattccaacttttccctgaaactccatctggccagtttcctccggcatgcccacagctgattcttctagaaactgtttaacatgattgttaagaataacctaacaacctgttaggttatttatcctgctttcccagaatacagagctggactgtgcgggcagccgctcgggcagagagggctgtgcactgccggcctgtccctggggtctctgggggctctcggtgcacaggagccaaggaagcagctcccaatccattagggggaaaaaccaaaacactttgcaagtgtccaaataaaatgtgcttactaaatgtctactataagcaaaatactgggaaagggatacaaagattaacaacatatggtccttgctttcaaatcagcttgcatgacagtttaatggggaaaacagatatttatacaaataatacaacaatagcacttatacaaaccacctaaaaaaaatcttatggaagtgactagatctaaggttccaagtcacgatacttgggttaggaaattgcaagaaaaaattcaaatcctatacccgtgacatgatcatcagtggaattttcctagatcagaggggtagaatccctttgttgagtataaaagatcaactatctgtcctcatagcatccggctgtaagatttttttatgttctgtaatttaagacttttcttttaagagatagggtcttgcttgctcaacatgttcctcaggctggagtgcagtggcgcgatcacaaactcaactcccgggctcaagagaacctctcatctcagcctcccaagtagctgggattataggtgcacaccatcatgcctagctaatttttttttttttttttttttttttttatcttttgtagaggtggagtctcgctgtgttgcccaacctggtcttcaacacctggactcaagcgatcctcccacctcagcctcccgaagtgctgagattacgggcatgagccgctgcacctgaccaatttaaaacttaaaatcttactactctaagaactttatacacatgtgctttataaatgctggttcatatgaagatggaatatccccctcaaccctgtagggtgatacacagccatacggaaccatcacaaactagtaggctactgcttttacttcaaataaaacaaatactccccgggccaagtagaaactagagccgttctcctggaagcaaagatgtcaaagcctctcactcttagaaacaacccacaatagggtctgggctttgtggtttacttaaaggaagtaacatttgcatcttcaaaacaaaaacaaaaggccctctttatcaggaaaatgtggcaaaaggttcaccagtggtaaatctgggtgaaggctccacagggcttatagggttggtgtatgactcttttaccttttcttcagttccaattttttttaacaaaaaattgggggagaaataaaggattttccccagaagcttgaaaggccctgccagctcctacatgatctgtagatttttgttctgctgttaatcgtggaatcatcaaagaaacagccttcataaagaatcaaaaagcaaaacagcaatgaagaacaccttttagcttttgatctgaacaagccttcatgctgcctttgccggggaagggctgctgaaccattctgaggcaagaacacctccctgaaaaaccacagatttccatcctcatggagccatccctccacagacccagatcttgtacagcccaaatgcagggcgcactttccccgagtacaaaccccagtgcgtttcatgaagctgttcagtatatgcagaatcagtgcattaataacagcttattggcaccgaatgaaaaacacacaagtcttaatcttaggtcttgaattttgtccagttcctacgtcatacctggctgtaagggctacagccgtaagcatgcttggtgactggaggctgtgtagtgagacctgagttttgaaaccaggattggtagcttaacaaaatttactggttgtagaaaaagtaaacttgcctccggggaggtgagctcagcctcaccattctgacagcagcctctggtggccagtttagtaaaaagtgttggctctcatgctgaaagctcggaccttcccttcttaatgaaggtcgctgcaagcagacaggccattctaggtaacagctggaggtgactggggaagctgcagaaatccaaacgaaggtgtgactttggaccacgtaaatcaccaagtcattggatgatctgtctcttgcattaaaaaaaaaaaaaaatgaagtactctctttcaaaagtagaaaaataaataaagagaactgttttaaaagggctcaagtcacaaggcagataatacatactcagtttgaaagtaatctcattccttacttgcatagaaagcctttaaatattcaaggagcacagattcctgaacaaaataaagcccagcctgtctgctttcttacatagcaccccatggtacactaactcctatgtactgagtgccggaaattcttcctgcaaagtaaggaattgctccatatggcagaaacttctagaaaatgctgcaaccattcattcagagaacaaaattaaatattcaggattgtaggtgaggcctgatttctagtgccacagattcacaccatttcactggatataaatagaggaatgatcagaggctgacagttggcttcaaaggcagagagggtaagaaggagacgccatcagcttcaagccaacttcttcgtaaggtgcactctgtcctcagctgtcagagaacaatctggaaacaatctgctgagcagctgctctcatcaacaaactgtttattgtaagaaagtggctgggtcaaaggctaaacatcaacccgagctgaaagcatacagaacaaaaatcaataccgtccctgctaaagagacccaggacttagcatgcagaaaagagagggtgaggaactcatgtttagttctgaaagagtaagagttggaacaaaacccccatatttcaacattcagggttcttctgcatattattccaattggcgacttgctgctatttgcagaatggccttgtaatgggggctaaaatgtggcattcaacaaggacacagaaatcaactttgccctaaaagttacaggggttaacatcagttgtttctctctcacatttgttttgcaacaggaccaacgtgctcatcatacacatgtgcttattatacacaatgcacagatactacagtccatctttaaatatgtctaattggaaactggaaggctgactggacatgagattatatgaagagattgtttcattttaggtatgacggtggaattgtgattatgtttttaaacagagctcgcatctttcagagacacatactaaaatatttgcagatgagaaaactgaaacagtatctgggaattccttccaaataatactggcagagaagtgggtagaaagaagtgaaataagattggccataaatggataactgtgaaagagagtgatgagtacagaagaattcactcattatttatatttacttttgcatatttgaaattttctatgaaatgtttgcttttacttgtgtgtaaagttcaacagttactttgaaagaaaaaaagttttcttaaatataagagaagtattaacctaccgaggcaaattaattaagtcatatgccatggtattgctaggtatccaatttaacgtttttgagcaatgtccgagatatggttgttatgtcctgagttgaacgatggagaagtagaaagagatgctcaaagtgttcccactgcatacgtgctccagcaagccagaatgtgacacagaaacagataagacggtttcccatggtttaattgcagtatggggcaagaggacatacgtgagatgctaggaaaacccaactgtcataaataatggggaccaaattgttaaaagacaagttagcacacaaattttgaaaacacaatttctttgtaaatctgaggctgctatatagtgtattgataattcttaaattaacagtaaaattagagaattagcctgaaataaataaaaataaagcagatagcaaaacattatttcattgtgctgaaattaactgtgaagatgtatctatgattttaacttgttccaatataaagatgaaaatggtaataatcacaaattcttagaaaagaatgcattcaaaggaactgcttaaaaagttaaaaaaaattttttttagtctacttgctttgccaagaccagcataaatactgcagagagtcctgcaaaggatgagaaaggtcatcttgtctaccctccctcccaacagaacagagaagggtttggtcatgagaatttggtgacgcaccaggcacggtagctcatacctgtgaggccaagtactttgggaagctgaggcggaagaattgtctgagcccagaaatttgagaccagtttgggcaaaaagtaagactccatctctacaaaacacaaaagtaaaatagccaggtatggcgatatgtgcctgtagtccccgctgcttgggaggctgaggtgggagattacctgagctcaggagttcaaggctgcagtgagccatgatcatgccactgcactccaacctgagtgacagaacgagaccctgtctcaagaaaaaagaaaaaaaaaaaaagacacccaccctagtgggaaggtggggcagagatgggaatggttaatggatgcaaaaaataaaaataaataaaaagaacgaataagacctagtatttgatagcacaacagggtgactacagttaataataatttaactgtacatgctcaaataactaaaataatataatttgtttgtaatataaaggataaatgcttgagaagataggtaccccattttatatgatgtgattattatgcacagcacgcctgtatcaaagcatctcatgcatcccataaatgtatacacctactatgtacctattaaattaaaattaaaaaaaatttttaaagccgtctaccaagaaaaactcatttggccaatctgagacactacacctaaccccaacatcacagaaggaaaaaatacacagagcaaaaccttcaaaattatagacctttgacctttaaagcattttattaactaaaaagctacagaaaaacttaaatcctgaaatgcatcaaggttgcctatgaaaagtaatctagacaatcctaggcagagtctggctatccccccacccccaaattaaccatcattttttaatttatgaaactactgtttgatgtttcttttaaaaggtgtattttcttatttacggaaattaaaaacaggaagagggatcagtggtgccatcattcaatcactcttcagtgaactactctacgtaggattcatttttgttcagagaagagagcaacttaccaaatgtttacctagggcatacaaaagcaaactcagtaagttttctgagaagaatattcactttcagccgggcacagtggctcacgcctgtaatcccagcactttggggagccgaggcaggcggatcacaaggtcaggagtccaagaccagcctgaccaacatggtgaaaccccgtctctactaaaaatacaaaaactagctgggcgtggtggtgtgtgcctataattccagctactcaggaggctgaggcaggagaatcgcttgaacccgggaggtggaggttgcagtgagccgagatcgtgccactgcactccagcctgggtaagagtgagactctgtctcaaagaaaaagaaaaaagaatattcactttcaactttaattttaattttctaaacttttccttaatgcatgtaggaggcaggttgaattaaactaaaagtttttatagaccagtggctcaggaaagcctcatggtgggtgaaactgacaatggtcctatgatacgcatgttcaggacccagcgatctagctgactgctgatgggcaacgctgttctcctttcgctcacacctagaatctgaatctcagcctcggaggcgcagcagcacagtgccaaagcagccctcctcttcacccagagcccctgtcccctgcactcagacacacatgccagagacccaccagagacacaaacacctacacaacaaaattgtgctgtgaacctcgtgtcaagggaaagtgcatttcccttttaccagaaatctccagacccgctactctaagtcttctctcactctctgggagaaatgaccactccacaaaggcacgttctatctcagcaatcttaagtttttctgtagttctggttaaaacagacatatgcacttaaataaataaatatataaatgtatatgcatatatattatcataatatgtattcatatggttgaaattttaaaaactcaaatacccttaaaagtatcgattaaaagactctgtttttttaaattaaagccacgttcctcaattcacgaaataaaatttgagttatagaatttttttgtaaaggacagtagctccaatgatcaatgagaattgaaatcatagtctttaactccaatatctcctttttagaaaaaaatatttattttaattgacaagtaaaaagtatgtacatttctggtataccacatgatgctttgatatatgtgtatgttacggaacagaaactccaatattccttccactgattctattattaaaccaaagcctaaaaacattttaagaaagaaaagacccacgacaccagcagagggataatgtagaattgtactggaaacatggtagtacctggatagctgtgtggccaaactcggcatgctgtacctggggagacgcagccatacacaggcagctacaacaaaacaaacaaattaggaagatctctcagaaaaaaggagtcttcccttcttatctccaggagaaagtgcctgagggaccgacagacggactaaccttggctgagtcttcctgctttcacgaggaagcccgcaaaatcctcctggtgctgcccagcatcggccgagctccagcacaggagcgctctccttgcaccccaagttgtttctccccttaccactcaggtgggggaaatgggggattaaacaccactcaggtccacaaactgcctgtcagttttgaaacccccgaaacactataaacatttttccaagacagtcagtgcaaatctccaggcggcattctcaaatcattagcatgcatggaaacaaaatgtgctccccagctataattcacatcccaagaactgaaggagaacatttatcaaatgggattcgggtctcagaccccgacattcctgagctgacaccaccagctccgcggcccgggagcgccagactcaacggttccgtcatcgccgggcgccccaccgccgcacccaccgccagctctggtccttggccctgcacctgaccacaggagccctttgatcatgctctctaacccggcaccagtatgggcttattcctgggatgtgttttttgaactgggagacaaaaatccgcgtgtgagaatgttctaagcccttctggagacagcctccaccgacttccctgggaggtgaggccagaatccatacccgctcacacatggcagctattaggaagcccgggtaggagacaaaaagcatgtggtcttggaggattttttttattccaaaagaggccgtttcccatccacaagtttgtgactgcataaacggtggatataaatagacggaggaaagaaaaccacgcttcttagacgggatgctatcccaagaaggaaagtgctgagcgggaatgttccctcggcctcagagaccttatcaccccttcaccaggccagacagcaaagaccgcaacgcacagaagccagaatcatcacaaaactaattaaacgtggaaaacaacaaaagcgtttgtgcagatttcccacaagcacacatctctgccccgggtatttactctgcaggcgctgctttgaggcacacttgtggaaacaagattcaagtaaaaagacaggacacacagtagctgaaaagccttcttcccacaaaaataaaacattctaaagggagcacaggaaaaccccccaagtatgatttcttttgcaattcaacatcaaaacccatcatgtcaccttttgccatgggtattatgtttgataacaggaagtcagtcaaaatgaacaaaaaatttccagcgtaggtgaagggcgaaggaagaaagaaacgagagaaagaggtatatgaaagacccttaaaagcattcatagctataaaagcttttaaatgtttgctttaatctgctagctgcctttagccggtgccgtattgtaaaacagccgcacaagaccacagcagccacatgtcaaaagctattcaaggtgcacctggaattctgacttcctctctaatttggatctctaaaaattatttttaagctgtattttaaagttatgcccaaagcttcgccctatctatacattcgagactcagaactaggattaaaaataggagaaggggaggactccacatcaagtactatgttaaaaaatggcaggcaaagattttttttagtggagaattctaattaactcattagaaaaatacattaagccaggtgcagtggctcatgcctgtaatcccagcactttgcggggctgaggcaggtggatgacctgaggtcaggagtttgagaccagcctgactaacatggtgaaaccctgtctctactaaaaatacaaaaattagccaggcatggtgatgggcacctgtaaccccagctacttgggaggctgaggcaggagaatcgcttgaacccaggaagcagaggctgcagtgagcagagattgcaccactgcactccagcctaggcgacaagagcaagactccatctcaaaaagaaaaacaacagaaacgaaaaatacataagcctcttcactgtcctgtacgccagcttcctctcccgggggcaaggactccttccccgccctgccctacttatcagggtcactatgagacccaaatgagatggcgacacaggtaaaaaagcttggttaactagaacgcatgccacaaagacgaggaattatccctcgttttccagaaacttctgcagcaagggcttgtacttagtaggcacacagatgtttgctacatgaaggggccagttagagaaggaggaacaactgtgtggtatgtatgactgagtctaagtttcttcataaagctatcaacgtctgaaaagcagctccatctcagtatgttcatgtatatcaaatcatcatgctgcataccttaaatatatacaatttaaaaaaaagtaacataaaggacttcccggagtagaagggcctgtacccgttttttgatatgtttacaagtatctaaactatccttaccaacaaaacctgctttttatggggggaaaaagtttcacagtaaaaatttggggttaaatcaaaatgaaatgtcataactagtttctgtttttaagtacgtattacccattccataactccccactaccaaaatcacacaaacacacctcatggtgattttgcccgatcatttcagtaacaaacccagttgtcacttcttgtgacagctacatcttgatcccagctggacacaggacccctgctaagagtccagccggcttgtgtttctcaggtcacctacacactgttagccaccgttggccacgatgaacacccacaaggttcccaagctttttcattttggaaaaattcttgtgctccccagatcctaagcagatgtcccaggctacgggagcaatgcacaagctctctagttccccaaggtaaaggtgccgaccttcctgggggcagcacgtccagttccccaaggtaaaggtgccgaccttcctaggggtggcacatcccaccttcttctgcttcctctggactcactggggggaccaaaaggggtccactggcaggcaactctgcaggggtggagggtggggggctggctctgccccacacacagattcaggtcccagccggtcctaacccgccagctgcccctcccagtgagaccctgcagagcgtggcagcctgtgctttctttctgccattgctctggcagagataaaaaggaaaatggaacccagagaaacagaaacaaggcagctagcttctcaactgggaaagaattacattttctctagaacatcagattcgatagaaaataaaatctattaaaatgtttctataaaatataaaagaattatgttttttctggtgttctgtaagggaaaggattatgtttcttctataaaatcagtgtttctcaaaaacattcatgtcccagcacagtaaagatgtattgctgctgactgcctgtcacccactggtggcgggaagatgtggtggccaccaggtgatcgcaccccggacaccccacagtgagccatgtggtgtatcagtctctcacccaccaacatctgcagagaggaagccatggagaggtccccatatatatggtcttggagaaacagttcaaagggctctgccaagaaactggaacatccaagcaggggtagggcacccaggggtaccttccacccacagaagcaaagggacagcttcagctcggaggcccccacacaccaactcagagctcacagttaaccctggaagtcacagctgccacaggccatgaacaagagtcacgtgttttactatcagagcgaaccctttctaaataatatgtcaaatattaatattaaccaaagtatcaacacctatgagattccctgccttttaacattcaagtgtgaccatgtgtgagatgccttcaaagtccaatgacacgcagtcatttgtttttagtttttaataactaatttggctcattataaaataactcataacaaataaccaatttggctcattataaaataactaataactaatttggcttattatatatataatcattatagaaaatttggaaaatacagagaaagttttaaaagattattaaaatcacccttaagcactccaccacaaataagtcccatatataccagatttccttccagtcttgtttcctttttttttttttttttttgagacagggtctcactctgttgcccaggctggagtgcagtggcacaatcatagctcactacagcctcaacctccctggctcaggcaatcctcctgcctcagcctcccgagtagctaggactacaggtatgcgccaccatgcctggctaatttttgtatcttctgtaaagaatacgaaattctgccaggttgcccaggctggtctcgaattcctgggcttgagcgatccacctgcctcagcctcccaaggcattgggattacaggcttgagccactgcacctggcccagtcttctttctacggagataggtgtgtggtaaacgtgtgtttgtgtgtttgttttatggtttaactttttgtcattttgctgagacccaaatttcaatcctgctcctgggaggttcaattaaacgtgaaagccttggtcggaggaagcccagctcagccgcccacagcctgcatctcagccaagccctgcttcctcttggtatcgtgcacagtgacactgatggagccacacatgactgggttttatagtgggaatcacacgctaccatggtgtctgggtgtcgatgaaggtctccgagcacatccttcccaaatgccaagggctgaccgtcgctgaggcgagtgttttttctctttgggtcttgctactattctttccagttatatcacagtaacggagaagcacataaatcttctgcgctattcgtcataaagagcaagtgtcaaggcaccaaactgtgtaaacacagctggtacgcagtaaaactatttagataactagcatatttattttgttctttcatatcccatactataatagtacctaggacacagtaaacgttgaatgaaagatgaatattattaactgggacattgaaataatttctgcagacccaaaagaaagtgccaccaatataatggaaaactataaaattatactatgtgaaactgatatagacagaaaaaaattaaatctctgaagaacaactttatagttctagggtcctgtatgcgaggcagcctagctcagcagcgacaccctgtggtgagagatctttgactcccagcaacagagtgtcttgcagggcacaggaagcagaaagccagcccaggcatccaatccctaaggcaggcgatgagccaaatggacaggcaggatttagcagatgactgggtgccaagatcctctccatggaacttaattccgtgaggatgactgagatctgttaagtagggatgccagaaagaaaaccaaatacaaagcacaaacccaattccattcccagtctctgtggtccagatctataaatactgacccatagcacagtgactagatgcaggaggaattcagctgcctccggaaagaccacctcaggcagtgcatatccaccttcaaattcatttgcactataatcctttagagaacttgtattccaagaaaacatcatataaaaccttgacttctgccatttccttctacagcagattcaaggacacctaagcagagttaataaacattaagaggccgggagcgccatgcctgtaatcccaacactttggaaagccaaggcaggcagattgcttgaactcgggagttcaagaccagcctgggcaacatggcgaaaccctgtctctacaaaaagtattaaaaattagccaggcatggtgatgcacacctgtagtcccagctactcggggggctgaggtgggaggatcgcttgagcttgggaggtggaggctgcagtgagccatgattgcaccactacactccagcctgggcaacagagcaagaccctgcctcaaaaactaaaaataaacattaagaaatgaggatatgtacaacatacacgtactcattccattccttgggctcccaaagtaaagcagaattcagtcagaaataagcagctgagaggaaagtagtccacagcacagatatccaagaaaatcaacaaggccaagtggagggcccgcaatgggaagtgaacatttctgaaaataattattttccaaagttattatgtaataaggggcttagtagggagtgtccatgtatgtgtatacagagcaaatatttgctttaatcatgttcaagcatttcattcccaaagtttgtgaaaggggaaatcaatactccctcaattgatcaatgaacaggtgaaaaagtatcacctcccactgccccaggctgtttaaaaaactggaaggacaaaaatgtgaagcatctgttgtgtgcttgaatataagcagacacatgatacaaagccctgacatgggtatttcaggttatactcatcctaaatacaccagaaatgccaagagttccaaacttccactcacaagagaataacctggggcagggccactcttcctatccactactctgtccaagagtccggaggtcaagtccgaagaccagcatgatcagaactccgagaaagggcagggagctctgccaagggcaaggccaggccacctcactcccggacttccccagctgggagcctcagagcaggcactggctaaggtagccagccccagccctccatccccaggaaaaggcgacagagaaggtctaggggactggcagtgctctcagattttctatctgtcttctccaagtgagcccatcacacccagatagctcatagctctgctctcctccaaaaactaagggacacagtgtaacacaaaagaaagtgcctcctttttaaaaaatgttgggatgagaggtataatttgtttgtttcaagagaaagtaggtaagtttagtgtttaaagtcacctagactattgggtgtttgcagaaactacatggttatgtcattcaactcacaaatttgtctgttcagagaagacaacagaaatagacaaaataatttgtcacaatgactatgaaactgatagtatggccaagcagggggattagcaagaacctacacctggagaatctggcgacctgcccaaaaccaggtatcaatcacaggcagcaagtgcaggcatgggccaagagaattcccgaacacattcccagctccgtgggcattttcctgtcagacacgactcacagacgtgaaacccagagcgctgttgccacaagatggcagacattagcacaaatgtgattgttccaaagatttgctgaaagtggctcaagtcaaaacaaatgttttcaatcccaaatgaataaagttacagtctgaatatactcttgacacagggaccctcttccccctaacgtggaaagggccacacctgcagacttaacacctttctaaactctactagttggccctctcttatatataatcctcccccaacaaaatgaatatttgcacatcttgaagatgatttccaaacccgaagtcaaaacagaaatggaaaatcaaaaccaaccaaaataaaacaattaaagcaacgggtcgccactgtgaagagggccacgtcacagcgcgctctgcccagctgagcccacaactcacctccgcagctgacagcaagtaaagaggagttaaggcaggaacttgtttcatgtcacagctgaggccaagggttgtcagaatctctctaaggacttcgtatcttctaaaattgcttgacttgagcaagttaaaatcttctggagtttgcactatgttggagctgggaggtagttctaagtgcacctgaaggggaaagatagcactatgtaaactgagggcactcacaggcaatgagaaaaacagtttcttttttctttttctttttttttttaaatttagagacaggatctcattatgttgcccaggctggtcttgaactcctgggctcaaacgatcctcccacctcagcctcccaaagtgctgggattacatgtatgagccaccacatctggccaaaaaatttctttaccagttttcttctccaagtgagcacatcacacccagatagctcatagctttgctctcctctgaaaattaagggacacagtataacccacaagagaaaacttgaacatgaatttttctaattatcaatagcatataaactctgaagctgtatatctggaaagtcatggccaacaaaagaacgattccaaagagcctactcaaattttggttgtcaggctgagaggccacggtggaaatgaccctggacagtcatcatctctctccaggtactgatgttccacactcatcagtcatatgaccttccgcaagttacttaacttgattataggaacaaaatatctagggccgggagcggtggctcacgcctgtaatcccagcactttgggaagccaaggcgggcagatcacctgaggtcgggagttcaagaccagcctgaccaacatggagaaaccctgtctctactaaaaatacaaaattagccaggcgtggttgcatgagcctgtaatcccagctactcgggaagttgaggcaggagaatcgcttgaacccaggaggcggaagttgcggtgagctgagatagctccattgcactccaacctgggcaacaagagtgaaactccatcgcaaaaaaaaaaaaaaaaaaaaaaaaagacctagaaagacagttatgctgaaaacctaattgctagtgagttcagggaggcaaatgggtcatgctggaaacttccattttgcctattagccataactggaaaacaatacctaggaagagagcagcgttattcatcattttaagagcgtttgcaggaggctgggtataaaggctcacacctgtaatcccaacactttggaagaccaagatgggaggattgcttgagcctaggagtttcagaccagcctggacaacatagtgaaaccctgtctctacaaaaaatacaaaaattagccaggcgtgggtggtgcggctgtagtcccaactacttgggaggctgagctgggaggatcccttgaacccaggaggttgaggctgcagtcagccatgatcgtgccactgcactccagcctgggcaacaaagtgcgaccatttaaaaagaaaaaaaaaagagagagagagtttgcaggaattcaaaacagcaggtccttgaataatgttgtttcactcaaagtcattttgttatgatgttgatgaggggaaaaagaaatcacttcccagccggggccactgtctgtgggtccgtacgctctccccatgtctgcacgggttttctctgtttctccgttttccccccacatccccaagctgtgcacattaggtgaaccgatgcgtctacatggtcctgatctgagcaagtgtgagtacgggtgtgagtgtgccctgtgatgggagggcatcctggccagggctgactcccccaccagtagtaccctgagcttcctggatgagttccagccacgcggccacccaccatgctgaactgaaataatcaggtaaataattatctttgtttttattaatctttcttaaatgtacatataattcatatttatttcagtgtttcagtgttttggcctttatttagaagtctggtgatgtctttgtgaccagaaatacactatgggaactgacttcttgtttatatcaattagcctatggtaacattggtttcattgtttgtcatttcacttaagggtgcagtttccaagaatctatcaacaactttaagtgaggacttactgaggaaggcatacgatttcttggacaccagaaaggcctttcctcccaccctccttcccctgattgaattttaagatttggaacttcacctagttacttcaggctttgttgtctagttaaaattaaaatatctccacctatcagcagcctttgtctgggtatgaaggaacttactggaacctctagctcccctgagatcagattttaaatgagcattgaagcctggaggttgccagaacactgagtacccagaaaagcaaactgagctcgtctgccttattttgtttcagctttgcctactgtatgcaaagcttctagcctgatattatagaagtattatgaaaataaaaagcataatgccagctttcaggcgacttagaatctctcaattcctaccttaaccaagccaaatatactaaccaaatgttagaagttgaggcttagctgggtgtggtggctcacgcctataatcccagcactttggcaggccgaggcgggaggatcatttgaggccaggagtttgagaccagcctggacaacatggtgaaaccccactgccactaaaaatacaaaaatcagccaggcatggtggcgcacgcctgtaatcccagttacttgagaggctgaggcacaagaatcacttgaacctgggaggcagaggttgcagtgagctgagatggtgccagtgcactccagcctgggtgacagagtgagactccggctcaaaaaaataaaggttgaggccaatcagaaaaggtctgcagggcaccgtccaacatggtccccaaaccacagctgattggctgcaggctggctgcttcctccaagactgaggatgccaatcatgggacaacaggtcaggtgggcctgtttgtagacagccctggagaggggaagaggcagaaaagcaaaaccctctaaagaatccatatcctcacctgatgtcaggagttcgaaaccagcctgaccaacatggtgaaaccgtctctactaaaaatacaaaaaaaattagccgggcctgatagcgcatgcttgtaatcccagttacttgggaggctgaggcaggagaatcacttgaacccgggaagcagaggttgcagtgagccgagatcgtaccactgcactccatcctaggcagtaagaatgaaactccgtctcaaaaaaaaaaaaaaaaaaaaacaatctgtatcctactcagtgcacttctaccctaaatgtgtacctctcctctccggtggacaaagccatgccagtatagacaaacagcatagcggcgagacccgtttaattcacttgagcacacggctatcccggagattaacccttacaggtggcagaaatgaaataagtcaagttctgttcccactagagccgaagggatgagaggggtgctcgactgaatgcatgtggactcactggtcagggtgaatacacagagtagccaagatgcacacgcagtgaattgtatgaactcgttttcacatgagaacgatgccaggacggaaaacaggatggcgctacaagcgggcggagttcctggagacaagggggaagatggccgctgaaaccccgagaactgcttggcttcactgtcttagggtttcaagatgtaggtgcttctacaatggaaacaagaaaagaggccacctctggttctacgctcccaattagcagggagaaatggcacaccggagtgtgtgggtggtagatttgtactcctcgtccacagaggtactggactagaatctcattctctgagtgtaaccctgttaccataatgacaggtctatttctgtaacttggcttcttgtaaaaataagactttttagttggaccgaaaaccggaactaaaaaaatgtctccagccacaaatgcgtggagagggtgatactggcatccagtggggagagaccagggatgctattccgcagccgaaaatgcacaagactgttgttgccacgaagaattctctgacccaaaatgtcaatagtgccatggttgagaaactctgtcatcaaaggcgacccactgctgccatgtgctaagctaaacaagaaaacaaaatcttttaaaatcccttttaaagattttctgtggacaacttcatggcaaattcctggtccatttgacagtcaaatgtcagcattaatccacagccttaagttttccctgcaaacttgatcagtacagcgagcatacaaacatttcctctctttctttattattatgaatggcaaaggcatcaaatctgcagcttactcggctgggacaccagtgcctagggtgcagctgtgttctgcccttgaaatactttacctcctcttattgggttacatcattactagatttattacaaaggtgaagactatgaaattgaacagggaaagaggaaactaaccagcctgtgataatatttattttttgatctcagtaaggtatcacagagacacaggcctgtggagaaaacagtgaccctgtcacacagaagactggaagtcatttaaaatcaaaaatgacattctaatcctctgaatctgatttgtgaagctgcatcatattgccttttttttctagggcaatgcactgcagtatcaaattttatgatagtaatggggtcaatttaaatggtgcagcaagcagatttgctatgtaactcggagaaatggatcacaacagtgccaaatcaattttctagtacaagtctgtgctcaggggtggtaaaattcactcttcaaaactgaaatatggctctaggaagtcgggtttttaagtggattttctgagaatatgcagttactatagttacaatatttgcagagaaaaagataagaggaacatttattacgcctccaaaagctaattcatgtggcctgcagcactgcaggaaacctgcttgggctgtacgtgttcatctgtcctaatgtccaaattccttaattttaagcatctctgcttgagtattatcttaagaacaagtgagtcggctttagaatagtaaagaaacaaatatatactctggaaaaaaatgtttggccagaaaattcaagaaacttagcttccaggagaactggaaaaagacaaggcattacaaaatgaaaacaaaacaaaaaaggaaacaattctctatctcaataaaaagatccctataataaaacaaaatcgattacacttatcttgggaactcttctggacaaaatatctacatctgcgtagttttctcattagagcatcaaatcctttagggcaagtgaatgttcatctaactctaatgaaaaccttttcccctaaggattaaaagatttggagtcaatgacaaggaattctgaaatagtttatccgctaccgtttgcttaaacaaacaaaaagctaaaaggaaaaagaagatgagccaaaggatctcctacgcaagaaaaagaaactagcattttcctttcatcctctttccattttccccctacctatgtattagtatgccacaaatctaagtagcttcaatattctcttatttgaagtttttcttttcagcacttggaagagtgacaaaacataagaaaggaattgggaacctgaagatgttttcaacaccaactaccttggcaatcaactgcagtatttcatcgcagtggtcactgacgtctagaatcactaccctgatggtttcaacttcctaccttaaataaagactcaattatattaaccaaggggtgctctaaggcaagaaagcagaccgatgaatttgagaaagatcattactagtaaagaacaaaacgagaattttctgactaagcctcagttaaccagcaagctcatttaaccctgacagctgccttgttcctccctcacaagtcttttggttaaccagggtattcaagaaagccctgaactaaactaaactttctgctcactatcagcaaaagctcccagccaatagtcaaaaacagcccgcagcacacgaactcctgaaacttttaagcgtgtacctttaaaagacatattccctcgcaaaaatacccacagatacccaaagatcaccaaatccatgctgccctgagtacctggcaaagaacagcttctcccccgcgagttccaaaaggcacatgcacaatcatcctgtccttgtcctcattctccaggtggccctggagcctgccggggctgagccggacggggccttcctggtacctgcagccactgctcaagacgctgagcttcacctcgctctggtcagccttggagaaaaccaagttctggactgtcttgtgcagtgcacccttgcttgtcacctgaaagccaccaaaggtgaaggatgaagacaggcccaacaccttccctccctgagaaagataggccatgaacttctggtacaggtcttcgggaatggactccctggtagcaatgaccaacagcagacagttgtccgtccacgggtctctgagagcactgtcctccagcaggtggtagagaatataactgtcaatgtccacacagtcggccagcacagaccggacctcgtggaaccggccgagggcttcctgggagtcggagcccacatagaggaggatgttgggtgcctttcccgtgaggttgactctcctcccttctctttcgggggaggtctcatcagcaacactctccaaactgctgctataatcgtagggaaggtctggaatgttctcggcagacgcaaacttgactgactcaatggtgctgttctcaagttccagacactcgtggcaactagacagatggaggtgataatgctcaacggggccccctcccctgtcactgtccccagcaggctcactcccagaggcactgcctctcctttgtttgggttcttcaccaagagcctttgggtcatctctgccaacatgctccataccgtcctgctcaggcttaatctcaagagaaggttcaggcttcggctctaggatctgggcttgcttgtttgagacctgatccttaacttccttcagagtggagtcctgcaagtgcaccgctaaggcatgaataggagagagagacagaaaattaatcaacacttcttgtatgacacatagctcatctcaagaatctcatcaccctctctgcattctgggacttacattccaggacagcctctggcacggctcccacctgcatcccccctcaactcgggggcatcctttggaaacactaattgttcccacctgaagaccccaagtgaaatcagcagtttgcccaacatcttttatacctattggagaacctaagaccctcttacggaatggtgaagaaagtgagattcagagaggtgcctttgcctccttacttacagattctatttcttgggtgttattctccttcacaataatgaaactgagcaataaaaaggacacatatctagagtctaccccagcacgccccagtgaaatgtcactctcaagacatgccataggatcaatgggagaagattcttcccagtatcttgtctcaggactggaacataagttgacaatcactaattcaaaaacatttattgagcacttgctacatgtcggacatggtattagagacatgtacgaggtgattctggatattaagggatttacataaacttccaaagctgataagggacatttatttgcccatcagatgaaagaagacattcatagacataaaaagcctgcttttaagtctaattaaggaagaacagtttgtgtgtttcctgaaaaacgatttgtcccaagaaattgtgatacatatattttaagtaaaaagcggtttgatttagaacttcatagtaacactagctatgcttcccactcaatcagaactgtagtctagacactagttatactgtattaaactatgtgaaataaatattatatgggttctgaatttgaatgccacctcatgagcaatgcagtcatgaaaacttcttgtttaagaaatttaataagcactgaaaatgtaccctgcagccccccaaaaaaatcttgacacatgcatgaattgtatattattacagtaaaatcaaacctgtggactgaattaaactgaaaccaagcatagcctttatgtcataccagtaagagtgctcaacagtccttaagctaataacttatagtgtcccactatgataaaaacagggtctcactttgtcacccacatgggaatgcagtggcgtgatcatggctcactgtggcctcaacctcccagctcaagtgatcctcccatctcagcctcccaagtagccgggaccacaggcatgcaccaccacacccagctaatttttttgtttgtttgtttttttggagataggggtctatgctgctcaggctggtctcgaactcctgggctccaagcgatcctcctgcctcggccttccaaagtgctgggattacaggcatgagccactatgcctggccaataaaaacattttctaaagttacttacacacaatcttttggggtaccagtccattatccatgtggagtctatcttccatgaacgccacccccagcttgctgaagttgtccacacttgcttcagcaattagccgataaggatccccaggtctgcaagctaatggcaaacaacagtctgaccacttgacaatctgagaaaaagcaggagagggaggaggtgggaaaagacaggttgagatttttcttctctaaaataaccacatactttatttttcccttgaggctcctaccactaaattacagtcattaataacaaattactggatattacattttactaatatcagagttgttttgaattcagcattctcatctctacctgacaacagtgcttacgaaacactaaatataactctctcatttaaaagtaactgaagtctccacctttttaaggaattaaaagataaagggacattccccagacactggaaaaacaccatgctgccctttaaaaacagagaagaggagagaacaagaagtccacaatacccagttactttcaatgtaacctgtggacccgcttttctcaaagtgtggtccgagaccaagtgcaactgacctcccagggagcacatgagaccttcagagtcccgagcacaactccctccctatctggtgcactggactttctggagttgaagtccaggaatcaggatttaaaacatgcttcccctggggttcctgcactcgaactgtgagaacaatccaaaaagactctccagacagttcctccctgtaaggaggttcacgttcctaccacaagggggacagggagaaagagagcaggcaaaacacccggcttagccttccagttcttactacagaagaccgtgacactggggcctggaacacccatgctctctctgagggttcccatggagaagacagcctgtgaggtgaagagcccggcgctgcagtcaggggtctgaggccgagtcaaaggcaactaatcatcactgtctgtcctcgggcaagcttccgaccctcacagcatcctaatttgtaaaacaagaatactctactaaaaatacaaaaattagccgggcgtggtgtcgcacacctgtagtcccagctactcggggggctgaggcaggagaatcgcttgaacccaagaggcagaggttgcagtgagctgagatcgtgccactgcactccagcctgggtgacagagcaagactccatctcaaaaacataaataaataaatataatttaaaggttggttgtgttcatgagatcaaagagtatacgtaatgcccccagtaaaaagcttagattgactggaataaagtactcaattaccgacagctgcttttattagctgtcacaaatgtggctttaaaagcagcagtgagcagcacagtctttttctaagatgccatgaacgattgctctacttcctaaagataccttctcagggacacactgccccgaatttcataattatagataaataattttttattccatttttatttatttgtatttatttattttttgagatgagtactcgctctatcacccaggctggtcttgaactcctggccttgagtaattctcccgcctcagcctcccgagtagctgggacaacaggctcgggccaccacactgggcttgaattctattttagatattggtgggctaggattttagaactaactcctcctaaaaactattttttaaatgctagataaaataaatgaataaagcattaccttaaaagtctggaagaacagactagataatagtgaacttccaggccaagtgtgggataaatcctgaacctacagaggaaaggggtattcctgcaagacacgccacttctgcccccagggtccttgctcatccaagcaacttgggtttcaaaagtcatcgtccaactggcataagcatagacatatagagatatggtttggctgggtccccacccaaatttcatctcgaactgtaatccccatgtgtcaagggacggacctggtgggaggtgacaggatcctgggggcagtttcccccatgctgttctcgtgatagtgagttctcatgagatctgatacttttgaagtgtttgggctgggcgcggtggttcatacctgtaatcccagcattttgggaggccaaggtgggcaaatcacctgagctcaggagttcatgactagcctgggcaacatggtaaaaccccgtctctactaaaaacacaaaaattagccaggcgttgttgtgggtgcctataatcccagctattcaggaggctgaggcaggagaatcgcttaaacccaggagttggaggttgcagtaagccgagatcatgccattgcactccagcctgggtgaaagagcaagactctgtctcaatcaatcaatcaataaagtgtttggtagtttcctctctgtctctgtctctcacctgccaccatgtaagacataccttgcttccccctttgccttctgccatgatggtaaatttcctgaggcttctccagccatgaagaactgtgagtcaattaaacctctttcctttaaaaattacccagtcttgggcagttctttctagcagtgtgaaaacagactaacacatatagaccaagagaacagagctgacagtatagaaataaacagattcatggacaactgaatttggacaagggtgccaagacaactcaataaggaaataatagtcttttcaacgaatggtactggtacaactacatactgacgtgtaaaagaatgaacataggctgggcatggtggctcatgcctgtaatcccaacactttgggaggccgaggcaggtagaccaccaggagtttgagaccagcctgaccaacatggtgaaaccccatctctactaaaaatacaaaaattggctgggcgcggtgtctcacgcctgtaaccacagccctttgggaggccaaggcaggtggactgcctgaggtcaggagctcgagaccagcttggccaacatagtgaaaccttgtctctactaaaaaatacaaaaaattagctgggcgtgctggcgggtgcctgtaatcccagctactcaggaggctaaggcagaagaaccacttgaacccgggaggcagaggttgcagtgagccgagatcgcaccattgcactccagcctgggcaatgagagcgaaactgtctcaaaaaaaaaaatacaaaatttagctaggtgggagcaggcacctgtaatcccagctactcaggaggctgaagctaggagaattgcttcaactcaggaggcagaggttgcagtgagccaacactccagcctggcactccagcctgggcactccagcctggcgacagtctcaaaaaaaacctattaaactttaaaagactcagatttgcattaaattgatacagaaaaagaaaaaaaccacagatagagaagcgttaaagacctcttttagaaaaaggagaaactggccaggctcggaggctcacgcctgcaatcccacctgagaggtggaggttgtggtgagctgagattgcgccattgcagtccagcctgggcgacagagcaagactccgtctcaaaaaaaaaaaaaaaaaaaaaaaaaaaaagaatgaggataaacctcttcctcacatcatgcaaaccacgtacaaaaattaactcaaactggatcaaagacctcaatataagagctaaaactacaaaattcagagaaggaaaacacaggcataaattgtcatgacttttgatcaaccaatgacttcttagataagacaccaaaaacagaagcaacaaaagaagaaatagataaattgaacttcatcaaacattcttgtgcttcaaaagatatcaagaaaatgcaaagacaacacagaaaaataggagaaagtattggcaaatcatataagaactcctacaactcaacaataaaaagacaatccaatttaaaaatgggcaaaggatgtaaggcacccggcaaaggcacctgtagtcccagctactagggaggctgaggcaggagaatggcgtgaaccccggaggcagagcttgcagtgagccaagattgcaccactgcacgccagcctgggcgacagagcgagactccatcttaaaaaaaaaaagaaagaaaagaaaatatacaaacgcccaataagcacaagaaacactgctcaacatcagtcacgaaggaaatgcatctcaaaaccacagtgagacacaaagtcatacccactaggatggctggaatcaaaaaagataccaacaaggacaaggaaaaactggaactctaatacactgctggtagaaattaaggtgctgcagctgccttggaagactttgggagttcctcaaagagttaaacatagagttaccatatgatctagtaattctactccccagtatatacctaagataactggacctgaacatacgaacacatctagattaggctcagaggatcttcccaaaggcaagccccagaggccttcacaaaagaaacaaactacgttcactgagaaacaactggaagatctgaacttgttcaataagaacgtatacccaaaccccagccttcagaaagatatggtctccaaaatggaaatagatccaaaagtactgtaggtttggctcaaaaaccttggagcaaaactcaagaaagccaaatgcaagcatatttggcaaaaacaagaagctcaacaacagcaaatatctgagaatgaggctgggtgcggtggctcactcctgtaaatcccagcactttgcggggctgaggcagaaggatcaggaattcaagaccaacctgggcaacatggcaaaaccctgtctctatgaaaaactacaaaaaatagccaggagccaggtgtgttgatgggcacctgtagtccccgctactcaggaggctgaggtgggatgatcgcttgagcctgggaagttgaggctgcagtgagctgtgatcatgccactacactccagcctgggcaacagagtgagaccctgtctaaaaaaaaaaaaaaaatctgagggtagactcaagaccaatccttctcagggaaatatggacacactacccacatccccaaatgaggcccatcctagagtttacacagatcatcaggcaccctcattccaactaaacttaggccccagtggtagggaccctatagaccaccccagtggccccaaaatagttcattttggctgctgccaagatctgaacatatacggcttctagacacttcagaatcccaagttcattctccaagcttccattttaattcttttggttcctcatctctacaaaatagagacatcagacacaaaaggtcacatattgtaatggtttatgatgattctcatacaaaagaatacttttcagcaggaagaaacaaacttgagatatgcacaacatggatggatttcaaaaacattatgttgagtggagaaaaaagatgccaaaggatacatgctgtataattccatttctatgaattcctagaacaggagaaactaatttaccatgtcaaaaagattcgtggcccaagtagaaagaattgaatagaaagaggcgcaagacaaatgcattggggtgatggtaatgtttcatgtcttaatgacctaggcagttacctaggtgtataaattcatcaaaacacacagaactgtgcatctaaaatctgtgcattttattttatataaattatacctcaattaaaaattaatatacaacaaaactagtaaggacaatttctttattttttttcctgcttctttgttttgattttggttttggttttttaattgttgttgttgttccatttgttcagctaatgagatttagtcagcatcactaagtggacagttggcttatgtttctaaatcctgtttttgggtcacctccctccatcatcatacttgaatgacctcgtcaagctcccttcattcattttggctctccccaagacgttcttcacgtagtcaccagggtaatgttattattcctttaaaaatgttgcactattccttggcctggcacggtggctcacgcctgtaatcctaacactttgggaggctgaggcgggtggatcacgaggtcaggagatcgagaccatcctagttaacggtgaaaccctgtctctactaaaaatacaaaaaattagccaggcatggtgacaggcgcctgtagtcccaactactcaggaggctgaggcaggagaatggcgtgaacccaggaagcggaacttgcagtgagccaagatcacaccactgcactccagcctgggcaacagagcgagactctatctcaaaaaaataaaaatgttgcactattcctctgcttaaaatccttccatgaataagttctgaagatctactgtacgtcatggtgactacaggtttttttttggtttttttttgtctcaaagaaaaaaccacatcatatgttgtaccccataaatatatacaactaaaaaaatactttcatggccatttttcatcattcaggaaaaaaaaatatgcccacatataaagcttgtatgcagatgttcacagcagcattattcacaatagccaaaaggtagaaacaacccaaatgtccatcaacagatgaacagataaataaaatgtatatagctatacagaggactattattcaaccataaaaaggaatgagaatgaactactgatgcatgttacaacgtggacgaatctcgaatacattacattaagtgaaagaagccaacaactaaaggtcccatattctatgaggctatttacatgaagtatctaaaatagacaaatctagagtcagaaagtagattcgcggttgccaggagctgaggtgtcagggagcagacagtgaatgctgacaagtgtgtggtttctttctggtgtgctgaaaatgttttagaattagataatgctaatgattgcacaactttgtgaatatactaaaaactactgaattgtttttcaagggtgagtttcatgtgaattatatctcaattttttaaaacaaaaagaaaagagtccaggcagtttgtttgtctctacactcttccagcacagcctagtcagcccaacttcccaaacttcaatcctggctcccctggttaagagcgtgtgacctgagcaagctactcaaattccccatgcttcaatgtcctgtctgtaaggtagagataagagcacctaccttggaaggttactgggagcactaaaagggatcatccataaagtgcctgggccacaagggtgctcttatggttccaaaatataaagtcctttagagcaagtaacctcatgagaaaccacatcatccctagtgggcaaaaaccgaacctggcagggaatggggaggtgaaaaaaatcttagacattacaacagtttgtggccctccaaggctcaatcctatccctcaacttttttattttttatttttattttttttgagacagggtcttactttatcacccaggctggagtggtgcagtcatggctcattgcagcctcgacttcctgggctccagcaatcctcccaactcagcctcccgagtagctgggacgacaggcatgcaccactatgacgggctaatttttgtattttttgtagagacgagaattcgctatgttgcccaagctggtctcaaactcctgagctcaagcgaccctcctgcctcaacctcccaaagtgctgggattacaggtgtgagccaccatgtccggccccccacaacaaaatcttattccttagtagctcatttctcttctcagagtgaacgtgaatttaattattctcctcggaaaaacaatcatgaaaaaaaaaaacttgagaaacattgcgtttgaggggaaaagaataaacgcaggcctttatggccaactcactaacctgtgtagaatatttggacaaagagaaactccagaattttcatttagctctacttgtatctttccttccactttaccacctacttctcccacctcctcgcagacacacagccaagggaagcagaattcacctagagggtcaggcccacccaatgtttcagcagagttctacatttcagaaatgacatctttgattcaggacagagagttcgttgatttcagctttgggaatgggggaaaggacgtcagttcaggaagatgagaagataaactaacaccgtggcagggcagacttctgggatgaaggtgcgtgggaaacagggaaacgaacagggcaacctcccgcgggaagctaaaggcaccattgtcctcagagcaatcaaaggaggaggagaaccgctcagccaatggagactcaacccggaatttagctgtaaaaacattgatttagccccctgcggtagcaggcactggcagtgtaaaaggagccaatgatgaaattcccacacacctctgaagaggaatgaggcaggagataaacaaaggaagaggaaggaccggaagagcccaaagaatacatccacacatcccggatcaagtttctccactctgccaactgtttcctcacctaagtgcatttccgttttctaggagcgtggtccatgagccatggaccatgcaaacgccttcaagcagcgctgggtgctccgatcaaagcagaaccgcgctgtcactgatacgtcgtccagggtgtttgccttccagtggataaaggcaaacaggacactttaaatttgcacttcgagatggaaacaaaggcatggaaaagagaagggaagtcaagcaaaaggctcactcccaaagatcaaagctaaggaagccctggctgtccctaaacaaaggagtttcctcctataatagcagccagcagaaatctgttaagtaactaaagctcttgacttgatgttacaatgtatggcagcaggcaaggcatatcttctctgctcaacttaaaactcacatccaagaagcagtccgggagtgaaagaccccaggttaaactagcacaggtggccctgcccaacagggggcattggcaggcagcagctctgcagtgagtggggaacagaaatctcaacaacccactggtacccagagtcagatcacggatgctgctaatttttctgactcttgtttctcctcttccaaatcatcttaattcaacgtgaaattgttaaaaagctctagtaacaaattggatggagcaaggctggaaacgcagaggtaaagaatttgaaaatacagggccaggcgcggtggctcacacctgtaatcccagcactttgggaggccgagacaggtggatcacgaggtcaggagttcgaaaccagcctggatggcatggtgaaacccccgcctctactaaaaatacaaaaattagccgggcatggtagcgtgcacctgtagtcccagctactcgggatgctgaggcaggagaatcactggaacccagtaggcagaggttgtggtgagccgagaccacaccactgcactccagcctggacgacagaacgacactccgtctagaaaaaaaaaaaaaaaaaagaatttgaaaatacaagactaaagggaaaaagttatttttaacttttggctatccttgctgtcttttgtgtttggaaatagagaggataaaggagagctacaaaattgactttcacttgatattatgtaaaaagacaggccagatgcagtggctcatgcctgtaatcccagcacttggggaggccgaggcaggaaggatcgcttaagcccaggagttcaagaccagcctgggcaacaaggtgaaaccccatctctactaaaaacaaaagactagctgggtgtggtggcacacgcctgtattcccagctacttgggaagattaggtgggaggatggattgagcccaggaagtaaaggctgcagtgagccatgatcatgccactgcactccagcctggatgacagaatgagaccctgtctcaaaaaaaaaaaaaaaaaaaaaaaaaagacaatataccctatggcacttttaagggtattggaaaatcaagtaacagcgtaagagttatcacaaagtcactgcaagcaggagctgaaatagtcaactaacccagatggagctgaaaagaggaattgcgaaaccatgactgacaagatgctcagggaaagggcaggtctcgctgaataactgagaaaataatacaaatattatgagaataaatatctttgttgccacacagaagaatgttattattgtgttctgtagacagccgatacaccgccgaggcctgctaaggtgtgctgcattcacatccacagttacctcccacctcatccccccattccactgatgtaagctgaggaagaagaggagttttaagaggtatcccaagtggtttagttacccactcatgtgtaacaaaccaccccaaaattcagtggcttaaaactaatcatttattttgctcacaaatctcaatttggacaggactgggcaggaacagcttaactctgctccatgtggcatcaggtagagtgactaaaccagggctggatgacctactttcaagatgcctctgtcactgagctggagctgcctgtcagctgggagctcagccagggctgtccacgaagagccacatgtccttctacttcatgtggatctcgccacagggcagcttgagcttcctcacagtatgggagctggactcccagatggcatgttccaaaagcccagatggaggctccaaggtttctcatgatctggcctgagaattttcagaatgtcacttctaccatatcccaatggacacacaaatcactaaggtcagttcagattcaagggagggggaagtgactccacctctcaataggaggaaagaatttgcagccatcttcaatgcgctgcaacaagtttgtgccagcaattagtcttccccttctgcatgagaatgacatgtccctaaatgggcatgctcctttggcccaggaccctgcacaagagagatgtagagagcagagagctcaaagcagagtcacagctggaaacagcgcagcgaacctgctgagcatgagtaacatacccaagaaactaggattcactgttagaagccactgggattctaagcttatctgttacttcagcaatctgattaacacaatgtgcaaaactgcattcctgacaacagccttctaagcccttcctgctacattccccatctgcacaagtgacccaccatccacccacaggccatcacctcctaaccagtatggacatgtctctatctcagcgttcctactcccaacactcatcaagcccattatcttttcccatgtggccacaatctgttccaggtttgctcccctccaatcccttctgcaatctgcctgaattgtgaccttcctaaagtgcaaatctgatcattctgctttaaaaaaaaaaatagttttagcctactgtccctgggatcaagtccaaattcctggttaacacatataagccttgtttgatgtatatattatgtccaatttgagtatattcaattctgctacatagaaaacaagaaaaccaatagcatggatgaaactcatagtgagtcaaaagcttgtaagacacgctcaagacagacaaaataagtggaacatacgtgcattgaacatagataaaaaggacaaaaccagagtgttagtcctaggcagaaagtcacgggagaaccaatcttttttttttttagaggaagacagggtctcacagctttgtcacccagcctagagttcaatagcgcaatcaggactcattgcagcctcgacctcctgggctcaagcaatcctcccacctcagcctcccaagtagatgggaccaaaggcatacgctaccatgcctggctaaattttttttttttaatttcttgtagagacagcatcttgctatgctgcccaggctgaccagggccaatcttatcaaatcttaaatattagtaagacacaaactatgccacttgacagttatatcatccttaatttggccacccattttgaccccatttatatactgtctagaaacacatgaaaaaacacacacagcatcccagcaggtctctggtaagccacagctattgcagacatatatatccaaatatctccaacaaagcaccttccaccttctgggcccttgtgtaacttcagctctagtccttgtgctgacaccattggcagggaaggctgatgcagcagagagacaggactccatgtatgaacattgcatggcccaggattcaggttgtgctgcttccattccataggcacctgatcctaagtgttaaccaatcccagaactctccccttatttcttgctgcatgttttgaattgatgtgataaacaatgtgattcgagcgtcttaactcagcctatgagcctctctattctgtgactgctggaataggctgcttggccatgttcttggaagctaccaccatatcagggtaatttcccacacaacattccagcccctgctttcccctctggccttatctagggccattccccaactcaggtgaatgcagactccaaatgtactgagctgtgtgcaggggccaggtgcaaatgctttctgtgcatctgcacatgctgttctacctgggaagtcctttcctcctttcacctatttttaccttaaacctcagacatcatctaccctggaaagtccttcctgacctcacgcatctaagtaggtcccccccataatccctatccatgccttctatagtacttaacatggtgacctttaattgttcatttacttagctctctgctctcccacactgtgaactccttacaaacagggaatgtcatctctgaatgaatctttcatctccatgtaacacatgcctccaaccctacctagcacacaatctggcatataacaggcactcaataaaccttcaatgaatgccttgatcaagtacaaggaacataagcaaatttcctgtggaaaaaaagaattgtattaagttctttgggtcaacaattcttactaaatgcaattgctaatataagtatagaaaatattgaaaactgagctgaatctgccatcacttgttggtattactgcatcaagcaaaataagtgaaacgtagctgttcaataaatgttaatgaatgaataagcgaaaatatgagtatgtgaatgctacattttttaaaactgaattttaagatccatttatctgttgttggtaatctgtagaattaccacagatcaaagccatttgaaatatccaaaattcaaaaagatattttaaatatctttaagagttgtatagtcttaaagatgtgaaaaaatataagatcccatcaattcaaatgtccttcttccataatatatttttctatttaataccttaggaccctgttaaattcaaatggctgtgaagtcaggtagaacatacacacacagattcataagaaccccccaaaatgcaaaatcccatcaagcagtcaacccaaatgggaactgtcaacttggctagaagacagtgagctatgagatcaatccctttttaagttttgaatcctaatttataaaatggagctcggggtaacagccagagtggtcaacatgaatggctctggacgtctctagctcctggttgcaagacccactgatgtctctgatcataagtgaaattagttaactggactgtggcaatcctccttgttgggaaggcattctcctaccccagaaaattaagaattaagtaaccacggccgagcgcggtggctcacgcccgtaatcccagcactttgggaggccaaggcgggcagatcatgaggtcaggagatggagaccatcctggccaacatggtgaaactccgtctctactaaaaataaaaaattagctggttgtggtggtgcaggcctgcaactccaactacccgggaggctgaggcaggagaattgcttgaaccaggaagtcggaggttgcagtgagctgagatcgtgccactgcactccagcctggtgacagagtgagactccgtctcaaaaaaaaaaaaaaaaaaaaaaagaattaagtaaccaccattcagcaagaaggtcttaattaaatcttccttggaaagtcagttaactgaaatgatagctgtgacagagatgctaattatctcccaaaatctagcctttctttctcccttacaagaacagaactcccagtttctgctgaatccatgactgtccagctagggaatgcattttgcagactaccctgcacctaagtgaccaagggggctatgtgacaaagttctgtacaatgaaatgggagcagaagtcgccacgtgaaatttctgaatcacaacagtattttttttaatttactaattttttagagatgaggtttcactctaatacaatggcaatcaaagctcactgcaacctcaaacttctggcctaaagtgatcctcccaccccagcctctcaagtagctgggaccacaggcgggagccaccatgccaagatggatcacagttttaaagaggaaactggttgtctcccaaccttctctcttcccccactctgaaggctagatgaagctgacactggtggagtagcacgggagccagactctagcaagagagaaccactacctaggatagaggagggaagacaggagaaggaaccaaggaagaagatgaggaaaaaaatgggtccctggatggacttccaaagcaaaaccactgcccagagagagaaatttaacttctagcttgtttgagcccctgtagctctgggtcccactgttatacaacttagcctgtatcctacataatatagtaactatgttccttaagacgctgtacatcttttagccccataaagacatataattaacaatttaggaaattaaaagcacggcagtcattattttatgctaaaaaggaacctgaacatatttgatattttatataattgcaatattttggaaagtctgatcttggctttaagttgaaatcttactaaatttatatataatattagaatatataagaaaacttcaagcttaccatatttgtaaatttaatacagtcatgtaccacataatgtctcgcccaacgatggaccatatatatgatggctgtccctcataagattacaatggaggtaaaaaattcccatggtctaatgacattgtagtacagcacagtactcacgtatttctggtgatgccggtgtacacaaacctactgggctgtcagtcatataaaagtatagcacagacaaggccagacgcagtggctgatgcctgtaatcccagcactttgggaggccgaggagggtggatcacctgaggtcaagagatcgagaccatcctaggcaacatggtgaaaccccgcctctactaaaaatacaaaaattagccgggcatggtggctcgcgcctgtattcccagctactagggaggctgaggcaggagaatcacttgaacccgggaggcagaggttgcagtgagctatcacaccactgcactccagcctggcgacagagcgagattccatctcaaaaataaaataaaataaaataaaaagtataggccaggtgcagtggctcacacccataatctcagcactttgggaggctgaggcaggcagatcacgaggtcaggagatcgagaccatcctggctaacatggtgaaaccctgtctctactaaaaaaatacaaaaaattaaccaggcgtggtggcgggcgcctgtagtcccagctacttgggaggctgaggcaggagaatggcgtgaacctgggaggtggagcttgcagcgagccgagatgcgccactgcactccagcctgggcgacagagcaagactcagtctcaaaaaaagaaaaaaaagtatagcacagacaattacatacagtacacagtacctgataataaacaactgttactggtttatgtgttttctatgttttctattattttagagtgtactccttctacttattaaaaaaacaaaacaaaacaaaacaaaacaaaaaaaacagctgggtgtggtgcctcatgcctgtaatcccagcactttgggaggccgaggcggggggatcacttgaggtcaagggtttgagaccagtctggccaccatgtgaaacctcatctctgctaaaaatataaaaattagccaggtgtggtggcaggcacctgtaatcccagctacttgggaggctgaggcaggagaattgctggaacctggggccggaggttgcaatgagccaagatagtgccattgaactctagcctgggcagcagagtgagattctgtctcaaaaaaaacccaacaaaacagttaactgtaacagcctgaggcaggtccttcaggagctactgtgggggaaggcattgttatcacaggagttcactgctccatgcacgttactgcccgtgaagaccttccaggaggacacatgtgcagtgaaagtcagtgatactgatgatcctgaccctgggcagcctagactaatgtgtgtgtttctacgttagtttttagcaaaaaaagtttaaaaagtaagaaacaggctggacatggtggctcacaactataattccagtgcttggtgagggctgaggtgagaggactgcttgaagccaggagttggagatcagtctaggaaacatagcaatttgtatgttcacaaatttgtagagataaataaatgaaaataagaataaaattttaaaaacaaaatttttttttaaatatataaaatcttagaaaaaagcttttagaataaggatagaaagaaaatattttttacagctgtacaatgtgtttgttttaagctgttattacgaaagaatcaaaaattttaaaaaatcaagtttataaagtaaaaatatgatagtaagctaagattaatttattatcgaagaagaaggctgttataaattcagtgtagcctaagtgtacagtgtttataaagtctaaagtagtgactgttgtgtcctaggctttcacattcacacgccactcactcactgactcgccctgagccactttcagtcctgtaagctccattcatagcaagtgccctagacaggtgtactgttttttatcttttatactgtatctttactgtgccttttctatgtttagatacacaaatacttaccactgtgttacagctgcctacagtatccaatgcagtaacatgctgtacaggtttatagcctaggagcaataggctaccccataaatcccaggtgtaaagtaggctacagcatctagacttgtataagtacactctatgatgtttgcatgatgaaatcacctaaggacgcatttctcacaatgtgtatctgtcgtgaagcaacacattaactataatgtatacgaattatgtaagtgttcaaaaacgtggtgtctgttaatccagacaacttaaaaatctaaaaagaaactgggaggaggggtagggggagtcatgaggaaggagcaggagcaagtagatggactcagggggtggggaggcacgtgtagttctagcggtgagttcatgggtatttattgtattatttcaaatccacaggtgaatgagatccatgcataaaccaacgatgagagtacatttggaacaaggagtatggttaacccaattctgtgtacctagagtcctaaaatgaaatgaaatattttaagatatttgagtttgtaggccaggtgtggtggctcacacttgtaatcccagcactttgggaggccgaggtgggcaaatcacaaggtcaggagatcaagaccattctggctaacacggtgaaaccccatctctactaaacatacaaaaaaaattagccgggtgtggtggtgggcgcctgtagtcccagctactcgggaggctgaggcaggagaatggcatgaacccgggaggcagggttggcagtgagccgagatcgtgccactgcactctagcctaggcaacagagcgagactccgtctcaaaaataaataaataaataaaaaataaataaaagtccaaggagccagaatggtggctcatggctgtatcacagcacttcgggaggctgaggcgggcagatcacctgaggtcaggagttcaagacccaccctggccaacatggtaaaaccccgtctctactaaaaatacaaaaaattagccgggtatggtggcaggtgcctgtaattccagctacttgggaggctgaggcagaagaatcgcttgaacccaggaggtagatgttgcagtgagccaagattgcaccactgcagtccagcctggacaacagagccagactccgtctcaaaaaaaaaaaaaaaaaaagcccaaggaattggttactgatagaatctggaagtttgtcccctccaaatctcacgttgaaatgtaatccccagtggttgaggtggggcctgtgggggaagtgtttgggtaatgggaacagatccctcatgaatagtgtggtgctgtcctccctatagtgagtgagttctcacaagacctggttgtttaaaaatgtgtggcacctcccccagctcagtctcactctcattcttgccatgtgacacacctgcacctctgtcactttctgccatgactgttcctcaaggccctcaccagaagcacatgctggcaccactcttcctgtatggctcgcagaacctcttctttataaattatccagctccaggtatttctttatagcaatgcaagaactgcctaatacagttaccatatgacaaggcctctttgtagttcaaaaagaaaagccagatattagcaatttcatgtgatttgacctacttgattatttaatttatattttcaataaattcaaaatcatttttaaaataaaaataaagtttatgaatcgtcttttctgcatatgaaaattagccctgaattggctgggcgcagtggctcatgcctgtaatcccagcattttgggaggcagaggcaggcggatcacgaggtcaggaaatcatcccgactaacatggtgaaaccccgtctccactaaaaatacaaaaaattacctgggcgttgtggcacgcgcctgcagtcccagctactcgggaggctgaggaaggagaatggcatgaacccgggaggcagagcttgcagtgagccgagatcgcgccactgcacttcggcctgggcaactgagcaagactgcgtctcgaaaaaaaaaaaaaagaggccgggcgcggtggctcacgcctgtaatcccagcactttgggaggccgaggcaggtggatcccaaggtcaggagatcgaaaccatcctggctaacatggtgaaacaccgtctctactaaaaatacaataaataaataaataaataaattagccggatgtggcagcatgtgcctgtagtcccagctactcgggtggctgaggcaggaggatggcgtcaacctgggaggcggagcttgcagtgagccgagatcgcgccactgcactccagcctgggcgacagagtgagactgtctcaaaaaaaaaaaaaaaagaaagaaagaaagaaagaaaattagccctgagttcaccaaaaccgtcgtatcaacagctggtcgtcttctaccaaacataagagacacaagtactgtttgactggacctaggttaataaaagctttattttggaatctcaatgatctagatctctttaaaaccattaattcgttctctagttactagaaaggatagaagcattggttaaaatcttatctctcacttagcagctggttaaaaccttgtctaggccgggaacagtggctcacgcctgtaatcctagcactttgggagcctgaggcaggcagattgcctgagctcaggagttcgagaccagcctgggcaacacggtgaaacccggtctctgctaaaatacaaacaattagctgggcgtggcagcgtgcgcctgtagtcccagctacttgggagggtgaggcaggagaattgcttgaacccgggaggtggaggttgcagtgagctgagatcgcaccactgcactccagcctgggcaacacagcaagactccatctccaaaaaaaaaagaaagaaaactttgtctgtcacttagcaatgatattcctatcactttaggaatgtcatttaatcttataacctaagttttcttatcttcaaaatggcaataataataatgataatactttgtagagccgttaagtattagtgatgacagctgcagccagtctggagcagggtaggcgcggccagggatacgcgctctgtggaaccagggggagctgggagcaggcaggagcccttcccgcttctgagttggcagggcaggagcccagtgctcccaggcataactgcagcctcccagccacagctgcggacctgggcatccctgcactctcaggggtcccagaggcccccgcttccccacaggcttggaagtgcctgatcccgctgcctggcctcttcctgctccctgtgcccgctctgattctggagcaaaattgaagctgagcctgggcggtgtcgcaacccggccaggtgggtgctgctcaggatggcgctgacacaccagccccctgccacctcagcccccctctagactttaggagccactctggaccacgaggatgggagggaggccgaggaggggctgaggacggctggttgcaggcctgtaggcacccctcagcacaaacagcctgggcaccttggacaacatgactgacagcagaaggcagacaggctcataggtagaaaggggcgggtccctggtgacgccctgccttcaagccaagaccagcccaaaacctggggacctggctgtcagttccaggtgaagcctgtggcccagagtgagaacttagagtgctttttctggcccgcccatggctgcccatggaccaatcagcacgcgcttcctcccttctgagcccatgaaaacctcagacccagccagactcacacagaggctgggactaccagctgcagaaaggagctacccacttcaggtctcctgagagctgttctgccactcagtgaagttcctctctgccttgctcaccctccacatacctcattcttcctggatgcaggacaataactcaggacccaccgaatggcagtactaaaagagctgtaagacaaaccagggctgaaacatgtccccgtactcactacattgcaggcaacaagaaggagagaagaactgtggccctttaagaagccaagatctaggggctccccaagccaaggctgtaaacaccctctttggggctctgcggttcccagcgtctccatgcttccaggtgccaccatgttccccttgtccagacacaggtgcccacagcaaaagcctcattcagtacacctggtccagccacagccttgcatggagccacccaccccccccccccccgaccctgcacttctcacccacacaccccttgccgctctgcacccagcttgcccctggtaggtgtgcaatctgagctggtagaatgagctgagtgcagcctgccaggccaagtgggtggaataagaccagtgggcacaagcaatacttaggcagaaggcaccgctagccacagaggtttctgtctggtgaaacgacaccccaaggatcctgtgacattaggggtaacgtttataaaatacctagcaagggctcaataaatggcttattattatcataagtgtctacagggctaaacgaaacattacaaaccttcaggagagaacgtactgtcttaacacactgcactgctccaggcccatctgcctgatgctctgcccgctccagggcccccatcagaaagtctctcgctatcctatactatctgcacctgcctccccttattttggttcaccctgaattccagtcaattacttcttgtttacttccccatttttcttcttctctcaatacagcatcttacagataatcttcatgaaatgggaatccagtaaacatggctagcatcagcaaaatccccactggatgatctacatagcagggaacaatggcgggtgaggacccacaagtgaggggaaggaagctgcaagggtacactggggtcagacctccaggagcctcagggcatggactgcacctggagggatgacatccaccaaaagcttatgcaacactgtcccaactggatgtgggtccagaatgactaactctggccatcaagaggaatgcccaaagaagggacatgagacagggtattttcacagctcagacaaaagataatgaacatgaggatggaatgaggagcagtggagatgaaggagaggagctaacaatttagggagtgctgttacaactcataacttcacggaagcgaggaggaggtgcgaggaaaagccggctggcgtgttaatttgggattttctctctttgaagcagaagaatacaaacacaactcattttggacatgtggctgaggttgaagtattttcagaatactcaaggaaagacgtttaggacgtaggtggtgatataccccagccactcaggttgatttaggaagcaagaaattgtaggaatggatgagatgacctgagagagagtgctgctcaataaaaatataacgtgagccacaaatacaagccacacacgtggttttaactttcctagcagtgaccaggcgtggtggctaacatctctaatccaagtattttgggaggctgaggaggtaggatccctggagccctgagtttgaggcttcagtgagctataatgaccactgtactccagcctaggtgacacaataagaccctgtctgaaaaataataacaataaatttttctagcagccacattaaaaacataaaaagaaacaggtgaaaataattttactaatatatttaacccaaaatatccaaagagaaagggagccacaaaggctaggaaagagcactcataaaaagacaaatttgaggccgggcgtggtggctcacacctgtaatcccagcactttgggaggccgaggcaggtggatcacttgaggtcaggagttcaagaccagcctagccaacatggcaaaaccctgactctactaaaaatacaaaaattagcctggtgtggtggcacacgcctgtagtcctagctactctggaggctgaggcatgagaatcacttgaacccaggaggcggaggtcccagtgagccgagatcacaccactgcactccagcctgggtgacagagcaagactctgtctcaggaaaaaaaaaaaaaaagcaaatttggttttgactaagacacatcagttccttatgggacacaagtaaacatggtactcactgtttctgaagaggatgatctctgtaaattctcactttgtacccaaatgctctccgtcacaaatgctatgtgttctgcttcaagtataaaaggagacacaagaaatagggcccacttgttcaagtcttcaatggactgtatagagggaaagaaatataatgagattgtcacttcataccacaactgccataaatttcaaccccctctgaaacataccctcccctataattccaagtgacatggaaataagcttatctgatgctcctctgcaggccgcaggaaccgtgtgtttcttgtttagctgtgactgtttaagcacctgcaaaagcccatcgatgactcaggacagctttaatatctctagaccactgttttcaagccatgaattctgaaacggggcctatccccgccattcctcactgcttagcacacagtagctaaccgggaagtacatttaaagatgaggaggctggccggcacagtggctcacgcctgtaatcctagcactttgggaggccaaggtgggcagatcgcttgagcccaggagttcaagaccaccctggccaacatggtgaaaccttatctctacaaaaaacataccaaaaaaatgagttgggcatgggggtgggtgcctgtagtcccagctactcaggaggctgaggtgggaggatcactcgagcctgggagcccgaggttgcagtgagatgagatcatgccactgcactccagccttgggtgacagagtgagaccctatctcaaaaaaaaaaaaaaaaaaaaaagatgaggaggcctagaagtacgtacccaccaacagaagctccttactcacagaagcctgaagggctgttccttcattccctacagccatcacagcacagggcaccaggcagtttttctttacaccttccttatagtgaaatcaaccctgctcctctcccggagatctgggaagtgtgcaagtctctggatgctcacacagcagttaaatccagagagaaaagctatttcagggaaaggcatttaccatatgcagacgcaatcagacatactttaatggaatgtaaactccagtcaggagtgattgtagtttttcaaaaagaagattagaatcaagattggttagcaaatcagaaatacccagttatctctcgttttctttcctgaaatctctctaagaaaaacagcaaattgatttgaaaaggctttcacatacaggatatagccagagaagaaaaagatgaaatctgagcggggtatgcaggaggctttcaccatcacccagaacgaaggtaactaggcaggctccactgtgctgcatatcagttcaaatctgcttgataaaaacctattgaactaaataatgaatgaaaatttaggggagaatttgcccctccctcagtaaacataattatcaatatagtggttaaaaagtatgtccacttaggccgggcgcggtggctcacgcctgtaatcccagcactttgggaggctgaggcacctaaggttgggaattggagaccagcctgaccaacatgaagaaaccctgtctctactaaaaatacaaaattagccgggcatggtggtgcatgcctgtaatcccagctactcgggaggctaaggcaggagaatcatttgaacccgggaggcagaagttgcggggagccgagatcgtgccattgcactctagcctgggcaacaagagcaaaactccatctcaaaaaaaaagtatgtccactttatccaagcatagaatgtgtacattaaacagacaaaaagcttgatactgccaatttgtataaactgtctttggttaaacttatcaattgattgtagggcattcaattataaacacacatattcagtattcatgcatttgattttaagtgtataacatatgagaacacgccaggcttggtggctcacacctgtaatcccagcactttgggaggccaaggtgggcggatcacctgaggtcaggagtttgagaccagcctggccaacactttggtgaaaccctgtctctactaaaaatacaaaaattagccaggcgtggtggctcatgcctgtaatcccagctactcaggacgccaaaggaggagaatcacttgaacctgggaggtggagattgcagtgagcggagatcgcgccactgcactccagcctgggtgacagaatgagatccatctcaacatatgggcatgagattcaggtgtgtccttatttcagcccaagtagactgaggtatccctcaaaagtagacccaagcagactgagatatccaccaaatcatcaacctgatcatattttaaatctcaaaataacagtagccaaccacaaataaatggtcaagctttccacctgtagaccttcaacatcacagcttaaacccaacaactattaaatttactatttcaggtcaagctgctatgctaaacagtctcatttcctaataagaaaaagatacgaactagaataggaactgtgatttaaaggctacagggatgcagagcatggccatcccatctagtctggaaaactaggaaatgacgcagcaatatctaaccaaatctgtaggcaaagcttactgtgcagagtgacagagcagagttacagaatccatgaaagcaccaggccactcctactccggcctgcacaggtaggcaagggctgaaaatcactagttatggttagtgtagttaacagaaggccagcggagtcatgaaaatgttcaaaagtaaaactgtccaagaaaatcagacattcccatctccatgtttttatatgtccaaaatttctattctgacttaaatcctaaatgtaattgatccaatttggaaactactacaaaaagctcacccctcaattttttgccattttattgagttatctttctcaatcaggttaattcccaacgctctaagccatacattgtatgtaatgcatgaacttcttccccttttgtctgggtagtgtcagttatgtggaggtggtactagttatttgcataactagtaccttgggggacctgagaaaacagtcattcatattcagtgtgacataatacatatatggtactaacaagaaagagtattttttatttgctagtggcacaatttcaacccatatctaagcacagcctccaggcaatgttcaaacctgagataagattcaattccccacaggggctttacggtgtgacatatgcagaaaacgtcattttagtgctaaaagtgaggcaatattccagaaaacagaggaaagggacaagaaacagattaaaagcaaaacacgtttaaatattaatgagaacaatgctaccgatgtccatgaaattttgtgcagtactgcactgtgaagctaagcccatttccaaaaacagctgaatggaaagatctattgttccctttacagcaaggcagcagactttttacagagattaattgactggcccaagtcacaaggtaggtgacagagtgggctgaacacgtaaccaccatcctaagcactgggtcaaaaaaaacaaaggctgactgtcaactgaaatttaaaagacgcaaagaccatcagtcgggtgcccaagttggtgaatgatgcaaccaactgacagaagatggagagggaaaagggcagtttttgtaaatttggggacatctgacaaaaagctgatgacacaggtgggagttttttgtttgggatttttttttttttttcttaagacagggtcttgctttgtcacccagactggagtgcaatggctcaatcatagctcactgtagcttcaaactccggggctcaagtgaacctcccgggatcaagtgaccctcccgcctcaccctccagagtagctgggactacaggcgcgtgccaccacgccgacctaagtgttttttttgttttgttttttgtagagaggggtctagctatgttgcccaggctggtctccatctcctgggctcaaagctgtccttcctcctaggcctcccagagtgcagggattacaggcataagccaccgctcccggcccgccacagctgtctctcctggttcacggtcacccaaacgccggctcgaagtgtgggagaggaggttgggggcgaccccaggtgggcactgctggcgtccggctgtcaatccacagctcacgtcctcacaggtgcgcgcctagagtcacgcgtccagcaccgcccggctggccgggaagaggcgaccgggtccgtggtccgagtcccgcacctccggcctctctctgggccccggggcaacagcccctcccgggccgcacaggccgcactgagggcgccactccggggctcccgaactcccgggctcccggcggggacgaggcgcagggacgggggcacttccggctcgcggggcccgggtcgcccgcccgcccgacccgcccacctggctgtcgctgacgcagaagacgcggccgccacggctcaggcacacgcgggcgcccgggggctgcgcggccgcgccgcagaaggtgaaggaacagcgcgaggcacgcagccgccgcaccgtggcgcgcacgagctcagccggccggcgaccccagcgcgcccacaggtacaggtagcacagcgtgatgagcatggccgcgccgccggcagggcgagcccgccttgcccgcccgccccagcgccccaggcccggccccgccccggccggaagggccgcgccgcccccccgggccaggcggcgcgggggtggggacggcgggggaggcggggacccggaaggtgacgcgggcaactggaggctgcggcgggaggggcgggggggggtgaggccgcgcccggctgtgtgatggggagctccggaggccgcgcccagggctggtggcggcggcgaggggcagcgctggggcggggggtgtgcaccggggtcaggggacgccggggctgcacccggagagggggctcgagggagtggaggccggggtgcggggccgcgccagggctgaggagtgggatgggtatgttgtggatgcgggggaggggaggctccagtggctgcccgacctgtttaagccaagtccggcctcccttccttggaggggtgggaggcggattgaggagggggctctgcctatgttcatagctgccaaggccaacctttactaaccagcagcacaccgggagtcccagagcgctccacagccgctacccagtcgacttgggaaaataagataaggccgtttttattaaattatactaagccttcatgcaaaagattttaaggtcaatcacatacattcacgggatgcaataatgtttttttaaataaggacaggaaacagaaattgaagacagataagcaccaagaaggctgcctctaaaaaggctgtgccaggaaggctccctatggtgttcttgctacatgtgggtcaacagtttgactgtaagcatcctaacaccagtgggaaaaggaaaacatcaccatgatttggtgttcttgtctccaagggaagcataattagtcctgacacagaggcttctcccatagaacctcatttctttaaaaggcattatgtaaagaacgtgttctgaacagctgcgaagcacagcaaagaattccatccagtggcttcctattctggccctcgctgaaaataggtggcaagatgcagcaaaagcaatcatgtacaccacgtccatgtcttaatctaaggatagtttttgtttgtttgtttttgagacagtctctctctgtcacccaggctggagtgcagtggtgcaatctcggctcactgcaagctctgcctcctgggttcaagcgattctcctgcctcagcctcccgagtagctgggattacaggtgcccgtcaccatgcctggctaacttttgtatttttagtagagacagggtttcaccacgttggccagggtggtctcgaactcctgacctcaggtgatccacccgcctctgcctcccaaagtgctgggattacaggcgtgaaccaccgcgcccagctaggatagattttttttaagagacaaggtttcgttctgtcgcccaggctggagtgccgtggcataatcacagctctctgcagcttcgaactctgagctgaagtgatcttcctggccaccatgcccagctaattttttagaaattatttttcatagagacagggtctcgctgtgtcgcccaggctggtctcaaactcctggtctcgagcagtcaaactcctgcctggatctcccaaagtgctgggattacaagtttgagccatggcgcctagccataaagatagatttttaaagtaccttggccatttgttcatctgctttaatatagctgcatagaacacccactcccagaacttcagacttttggttagataacatagtatattttcccccttgcatatagcgatagatttttaaaagagagaaaatccaaaaagaaataactgggcttaaaagcaagcatctctgtggaccagaaatagaagaaaaacaaagtgataaacaggactaaagccatatcctacacttctctacaggacagtggcagccggaaagtgggttcctgcatggtaacaagaccttaaaattgtgtcactggagaaggacgtgcagttcccgctgaggagagacttggccactccaggacaacacaggactacaagtcaggaatttgaagatgaaaagtgctcaacagtgataaatcctaaatgtttcactgaacaacctttcagatagccttcttgaagtttgctgaattatggctataaggaccactccccacccctgctaggtatggagaggtcatctcctctatctgaaggtgaccaacatctccagtttttccaaattccctaagggttttgagaccacaccttcccacaggtactctaactccacctggccaataggaattttctaggtttacccttaggtgtttcgagatatggtctcagaatacatcatgggaaaattacattttggggtcaatcctgtataccaattctaggttaaaagcatggggaccaccatggttcaacatgagctgacccttgcattgaagagtactgataccattcatgcctggggaaggaatagagggaggaagatatgaagggcacagtgagaagtgaaacagtcacataacaagctctgtttatgatcccgccctaaaatgatttcattttgcaaaggtcaaggatagagttgagtttcatcacccctatataacaaaggaataggggaaggatgcaaaaataatacaccaagggatattaatgtgtatgcacctgatcctcatcctgtagtccctcactgctcaaagtgtggtccttagagcagcagcagcagcatcacttggaagctcgcaagaaaagcggaatcctaggccccacccaaccccaaatcagcgtctgcattttgacaaaatcccaggagactcacaaacacattaaagttagagaagcactgctaacatcttcctctgtcattccctgggtctgggctactctagactctaataagacatttccaaaatgatgtggaaaataagaccacagactagggatttttttttttttttttagatgaagtctcacttgcccaggttggagtgcagcgcgatctcagctcactgcaacgtccgcctcccaagttcaagtgattctcctgcctcagcctcccgagtagctgggattacaagcacatgccaccacacctggctaatttgtgtatttttagtagagatggggtttcaccatgttggccaggctggtctcaaactcctaacctcaggtgatcgtcccacctcagcctcccaacgtgctgggattacaggcgtgagccaccgcgcccggtcagactagggatttagaagcaagactttgtcatttataagaacactgcagaaaggaacaagaatgacccagctagccactgaagaccacctctgaaacccatcaacatgaccggctttctataggaaaagtctccacagactcaaaaagtctctagtttcttgcccttaggaaggcatgccctgggaataatagtttggggacaagagagagtagagtgtttactgtcctatcccccattaaatacatggcagaacttccccagggaaagcctatcatactgacattaactcagtacctgtttgaacttggagagcattcagaattctcatcagtcaaatggccagagctgagaaggatagcttgttttgtttgtttttgagacagggtcttgctatgtcacccaggctggagggcagtggtgcaatcccgactcactgcagcctcgacctcgtgggctcaagcaatcctccctcctcagtttcccaaagtgttgggattacaggcatgagccaccacacctggctaatttttgtattttttgtagagacaaggttttaccctgttgcccaggctggtttccaactcctgagctcaagccatctgcccaccttagcctcccaaagttgtgggattacaggcacatgccaccacacctggctaatttttatatttttttgtagagacaggattttgccatgttgcccaggcttgtctcgaactcctggattcaagcaatctacccgcctcggcctcccaaagtaccgggattacaagcgtgagccaccgtgcccagcctgggatactttctaagaaccaaggaactatgtagaaaatcttcgccgggcacagtggctcacgcctataatcccagcactttgggaggccaagatgggcagatcacgaggtcaggagatcgagaccatcctggctaacacagtgaaaccccgtctctattaaaaaatacaaaaaagttagccaggcgtggtggcgggcgcctgtaatcccagctactgaggaggctgaggcaggagaatggcgtgaacccaggaggcggagcttgtagtgagccaagattgcgccactgcactccagcctgggcgacagagcaagactccatctcaaaaaaaaaaaaagaaagaaaagaaaatcttgatctctattcagtaactttaatacgtatattaacatgttcttgtttttggaacaatcgtcaaatcaagcaaaaagtaattttattttgttaatcaaaataaagagaaaagtagacaatatttagagcatcaaaagaatttaaattagaacatctttaactattggaaatatgcatttgaactcatgtctttaagaggaaaataattatctttcctagctctttcactgagatggcctcagagtagccttaccccaagatgcacctgagtgctcagattcttgaatgggtgctcttctcctcattacaaggaactagaaatccttggagaaatcactgattctggtgttcaagagataccagataagctggaacatcttatgctaggaagcaggagaagcttcaaagaaaaataggtccaggcagaaggatgcaggagacaagctagaagtgccaaatcaggacgatttgagtatcaaattgaaatacacccaattatgaaggtacccaattttcaagagccggctgggcgcggtggctcacacctgtaatcctaccactctgggagactgaggcgggcagatcacctgaaatcaagagttcaagaccagcctgggcaacatggcgaaaccccatctctactaaaaatacaaaacttagccaggcgcagtggcatacacctgcagtcccacctactcaggaggctgagccaggagaatcacttgaacccaggagacagaggttgcagtgagccgagattgcaccactgcactcaagcctgggtgacagaaaaagactccatctcaaaaaaaaaaaaaaaaatgaagagccatgaaatccatggttatcctcaataaaatttaaatattcgaaaagaatgtaggataaaatgtgttactgctgagtctcgttatttggttatgtttgtattgattcatttgttgtattgataaagattagtaggtggcaaattcttcctttagaaggttgtttgtgacccaagagggcatcaatacaaagaccctaaagctgggattccgaagcacagagtcgcgggagagaaccaaagctcatcgcatctggtttaagactccttcagagttggatcagcctaaaaacaggacatggtacaagattttattcattccaaagattgtaaaaattaaattcatcctgagaatttatcagtctatgtgggagctacagacttctatgagcaagcagaggtaagtaatgttctaacttcaactaaaagaggctaagagatcatcttccttcttttgaatttaatttttttattattattttaaaagacagggtcttgccctaccacccaggctgctcttgaacccctaacctcaagctgtcctcctgcctcagcctcccaaagcattgggattacaggcatgtgtcgtgcctggcctcaccctccttgagatttcagaattgttgacagaatgacaataagtaggattcactgtctccttaaagactgaggaaagaaacccagtgaaacctctgatggacaatggcctcagttaactaggacagtaactgtacagtatccatctcctaatccagtaaaactgagttacatatagaaaggcttgaaagaagcaaagccatagatttatatttctgtattaataaggaatctatgcatatttttggtcttatatatacttgaagtgtgttagagtatgtggctgttttaagtacattcttataactaatttgaaatgggtacttctatattgaaatcttactgagtttatgaatagtattgaaacatctaagggaatattattaggtttgccatattaatatactgaatctgctagattgataagaattacataatcaggccactgaaatgtataaaaaggaaatttaatttaaaaaggacttgggggcagacacagtggctcatgcctgtaatcccaacagtttgggaggccaaagtgggaggatcatttgagtccagaagttcatgaccagcgtgggcaacacagggaaaccccatctctatgaaaaaaaaaacaaaacatttttttaaattagccaagcatggtggtgcatgcctgtggtgacagcttctcgggaggctgaggtaggaggatcacttgagcccagaaggtcaaggcttcagtgagctgtgatcgcaccactggtctccagcctcagcgacagagaaagaccctgtctttttttttttttttttttttttttagcagctctggaatgagaataggtatttgtaacacacataactgataaaggattcatatctagaatatacaaagaactccaaatcaatgaggaaaagtcagaaaaccaaaaaaggaggacagctaaagctgaaaaagcacttcaaaaacagactgtacccagctgtctgataaatatgaaaaagtatgcagtctcaaagtaggtccaaattaagaccttcatgagaattggtatacacccatcggtttggcagaaatccccttctcaagccctggaattctgggctctacccccattgctcaaagatctgaccattttccatttccatcccttccatctttctgcagtacctggcattcctgaccatgctatttctaccaatcaacaaaaactactagatactcagaggggatttaatacagagagctggctacaacatgacaaaacaccagacaagggagggcactgtggctcatgcctgtaatcccggcacttcgggaggccaaggcgggtggatcacctgaggtcaggagtttgagatcagctagccaacatggtgaaaccccgtctctactaaaaatacaaaaaattagccgggcatggtggcaggcacctgtaatcccagctacttgggaggctgaggcaggagaatcgcttgaacctgggaggcggaggttgcagtgagccaagatcatgcccttgcactccagcctgggcaacaagagtgaaactccgtctgaaataaataaataaataaacaaacggacacacaccacagaagggacagtgaggcaacccagggaatagaaagagcagaagccgcgaccctctgtagggctgagggcacacaacacaggtcaagttaccgtcgcccgggatccagggtcccctggtggaagctggaacccacagatcagtgctgtgggagatggagccacagagaaacaactgctgctggagacatcagcaggggaagaaggcggaaaaatactgtagccgctccacacctccagcccaacgccccatggcggaacttcactagaggccccacggcagaagagcctccaggaacctccttgtggaccagaggagagagatagagaggcggcaggaggcaagggtgtgtctaagacaaacaggccacagccagcccctggccttcctgaaactcctcccttgggttcttttaaaattcaatattctgcttctgttccagggttaatgggctgaactgtgtccccccaaattctaatgttgaagttctaacccccagtacctcagaatgggactgcatcaggagacaggtactttaaaatagtcattaaggtaaaatgaggtcaccacctaatctgttatgactggtatccttataaggataaaatagtcattaaggtgaaatgaggtcatcacctaatctgttatgactggtatccttataaggagaggagactagacacagacatgcacagggggacaatcctgtaaggacaaagggagaagacagccatctccaagccaaggagagaggcctcaggagaaaccaaccccgcccacaccttcatcttggacttctagcttccagaactggggaaatgaatttctgttgttgaagccccagtctgcaatacttagttatagcagcccttgcgaaccagcacatccaagttctccgtctctgtctctaacccctctctcaactgtcggccataagtgagcctctgcccccaacttctggcctcctctatgttctcttccttggtgacctctggcagtgacgctcagtcctcatggccagctctggcctctcccaggctctggcgccgcaatcatctcttccacttgtctctgcttggatagtctgtcagcatctcaaaggcaacatgaataaaaccaaatgcattttttcctcccacaaattatctctttatcctgatttctcttatctctgttcatgacttgttcaccttttcactaggacccagaattcatgcatcttggagtcccaacttctccagcccctgtgtcttgtttatttccatagcagttggtaggcgggacctctgcacagtctcacatggtcccttctttctagtccaggcccagctcagccctcaccagaacaggcactagcacgacagcctgctggatgattcccggtgcccgtcccctgtttcccacggttctgcctcatccagcacactctgcacttgactgcctaaagcacagcgctcatcccatcactcctgcttctcaaactcctgcagtgcctgcccccaccccagaaagtgcaggcagtcttgcctggcattcaagaccttccactgagcctaagcaacatagtgagaccccatctctacaaaaaatttaaaaattagccaggcatggtggcacgtgcctatagccccagctacttgggaggctgaggcgggagaactgctggagcccgggagttccaggatgtagtgatccatgttcataccactgcactccagcctgggcaacagaagagaccccatctctaaaaagaaaagaaaaagaccttccattggacccacctaaccgggtctccctcattggcagccattcacttattccacgttcattctgcacctcctgcacacgaggtgctatgccaattactggatacatttaatccctcaacaactctgcatggtgaccattattgtccccatcttgcaaaggaagaaactgaattttagaacagttgaattttagaacttgagctcccataattaggtggggaaactgatgtttgaatttgtgtccttttggccccaaagtccttctctggataaactaggcaaccaagagcaaagaatgctctatacccgacaaaaatagaaatgaaactcaagatccaagacgcaagagtggcagaaggttcaaggtgcaccactgccagccctgacagcctttgtatccaggtcagttgaacaggccgggattgtccccaacttggacacatctaaaaagctgcaggtgggatgtcatcaaaatcacctgggaaaacaacctgctctgaaaacagaggcatgatccaaaagacaaagaggtttgtgataccctttctgtacaatagctgactatcagtaagtcattactgttttaaggaagtcagtcacacacacacacacacgcatacacacacagaaaaatacaagttagctgggcgtggtggtgtgcacctgcaatcccagctactcgggaggctgaggcagcagaatcatttgaacccgggaggcagaggttgcagtgatccaagattgcatcactacactccagcctgggcaacagagccagactgtctcaaaaaataaataacaataataataataatgttgcaccaatgtcagttttggtaaatccatggttgtgtaagatgttagcattagaggaagctgggtgaagtttcaaagaactctctgtactatttctcttttgtaagcctaaaattatttcaaaataataggtgataaaaattagaaggtgacattccactgaatttcatcagcactccttttttcccctcttccgaaccagccatgtgatcttaagcaaattatctcatctctctaggtcacagtttttcaacttaggaaaaaaaaagagggacacaagccagatcatctctaacttcccctccatctctcaaattctgtggtcctcgtacatttacaatatgatgcaatctacaaacatttgatattggtgctctcttattcaccttcatatccctggtatttagcattgtgcctatacatagtaggtgctcactgaaagtttttgcaactacctcaaaaactgaggttcatacctcagtttgtaaagtgacgtagaactgctagctcttttacctagttgaccactagagagcgaagcggtcacaaattttttctctgttaaaagcaaatttatcttcgtccagcagaggggagtggtcctttatatttcaggcatgtaaaaatcaggtcctggttgggcgaagggagaaatctgtgagcagtttcctgcctatcagacaggccctccagaggggtgatcagtaccataagcttccaggtaagcacatggggccactgcccccaccctccaaaacaccctcaaaagtctaaaccacctcaatggatgggagattgctctgcaaatgggggagccccactcctaatatgttcatcattgtcttcctaacaatcgtgactcatttcttgaacaaatgtttcacttttaaagggtttgcacagaggcagctttaagaggtcaaataaatgaatgtggaaagaaattaaaacttttacaaccacatgaaaaaggcattagccagtcatcctgcccagcagcccaatattgagcctgtgtgagttgccgtttgtgtagtgaagcaatagaggccatggtctggaatcagaaaccctgggttcagatactgcctctgaccccccaactccccaacaaaatgcacacattcagtggccatgtgaccagggcaaatgcctctcgttccacagctccaatgcaggaataataatagcatccacctggtgtgggtgggcgggttcacagagaacagccacacaggctaagagtgcagactattgtgacccagcaactgcccacctgggcagagtgaacaggaagggaatagaagggcaacgcgctttcacttcatcctcatgagcgctcttcgtggggaaactattacacaaagtcggggtggggagttccttcccagtaaatcgagttgcctttttcaggcacggaaaagcccatctgcctgaattttcctcaactggtcaatcatggtgccagaaatcccaaccacttgaagtgctccttcaggttaagttactttatctgccaactgtgttagtttaaacaagtcagtttccaagtcctacgctgctgcttttatcatcccattaatttataaaactaagaataggggccaaacgcggtggttcatgcctgtaatcccagcactttgggagatcaaggcgggtggatcacctgaggtcaggagttcgagaccagcctggccaacatggtgaaaccccatctctactaaaaatacaaaaaattagccaggcatggtggtgcaacgtagtcccagctgctcaggaggctgaggcaagagaatcacttgaatccaggaaacagaggttgcagtgagccaagattgtgccactgcactccagcctgggcgacagagcaagactcccacctcaaacaaaaaaaaaaaaagaaaattaagaataggaccccacagtgtgggaaggaggctggaagcgtcctgattaaactgcagcctgaggactgctgggtgggatcctgtagagcacactgagccctgagaagggggcaagaagagccccagggtgcaaggccagagactagctggggcagagaagagtgcgaagctggcaggactgaagggtcgggagacccttaaagagaccctgtagcagacgccttgggaatgtacgtgtcaccgagcaaagcacatgaagagaactgttcaacagcggactcagctgggaactccagacactgcggcaaaaccagcacagatgcatcctctcctgtggctaaaagctccatgaggggccagtgagtcacatgacaaccgaatttctcctctgccaatctgaacatattctgggactgagacttccgtactcagggaaaaccaatcacactgcttaaaagaaaaaaaaattggccaggtgcggtggctcacgcctgtaatcccagcactttgggaggctgaggcgggcagatcatgaggtcaggagattgagaccatcctggctaacacagtgaaaccccgtctctactaaaaattcaaaaaaaaattagccgggcatgatggcgggcgcctgtagtcccagctactggggaggctgaggcaggagaatagcatgaacccaggaggcggagcttgcagtgagccaagatcgcgccactgccctccaggcctgggtgacagagcaagactcagtctcaaaaaaaaaaaaaaaagaaagaaagaaaaaaactacctattataaacccttgatgctataaatttaatggagctggaaataaattccctggaaagactatggtgggagaaggggggcattaccttcatccgtttacattctccagccatgggaactagctcctttgttttcactgaatttatgtttctatagaggcacccaggattgagtctcctataggggggtcccatgaagctgccatgcccctctgttgatacaccttgctttgcaggtcaatttgtgatttttaaaatggttttatgcaaacgacatgtttagcccaaatgcactgcaggtagctggtgataaaacagcaatacggaccaggcacagtggctcacacctataatgccagcactttgagaggccaaagcagaaggatcacttcaggccaggagtttgagaccggtctttgcaacatagggagactccatctgtacagaaaattaaaaattagccaggcggccaggtgtggtggctcacgcctgtaatcctaacactttgggaggcaaaagcgggcaaatcacttgaactcaagttcaagaccagcctgggcaacatggtgaaaccacatctctacaaaagtaaagaaaattagccaggcatggtgctgtgtgcctgtagttccagctactcctggggaggtcgaggctgcagtgagccgcaatcacgccacttgtactccagcctgggcgacagagcaagtccccatctcaaaaaaaaaaaaaaaaaaaaaaaaaaaaggctgggtgtggtggtcccagatactcagaggctgaaaagggaggattgcttgagcccaggagttcaaggctgcagtgagctgcgatcacatcaatgcactccatccagcctgagcaatggagtgagaccctgactatatttaaaaaaaaaaaaaataggaagaaacaactcaaccacagggctagtatgttactcggttataaaatgataaagccctaaacagagaattagcccgtttccagaagaggccaagaacagatgatacagctgaactgaactcctgcctgtacagctcgttttctacaagattccagacctggaagatgatggcatccagcccccattgaagcacctcgaacaagaaaaacgccgagtccgaagagccaggccttgaacacacgattcctgtctataaataactccccctggggaataaaaagcaggatccaaggcaggaaacccgagccgtggaatctggtaagttcttaggaaacccactcacgggcctgagtcccccgtggaagcggcgacttcggcacctggacacccgagtccccagagccccgggcggccgcgcgtccctacctgcaggcctgataccggccgcggagcgctcctggccccgctcccgccaggctccgggaccgctgaaacgcacccaggggggtgaaggcgtagtcgccaaggacagcgcagatggcagcggaggcatgggagccggaacctaccgtggcaaagggccaggtcgggacgcccctcggcgcagccccaaatcctgcccgcgccccagccccgctcaggccgcgcccctgccacctctggccacacgggctgagacgtctggctcctgcacagcgcacttcccgctgcccttctccactggctgctcaggccctgcctcgccagcacggcatccgcgggggatccctacctgtcctttagggcttgcctcataggtcaaacgtcacctcccagggaggtatggcctgccccctggccaggtgggccccttccacgctcgcctgcaacaccacccacccaccttgataactgcttgtaaaggttgtactgctttcccccttgagactgcaaaccttcaagggcaggaaatgggtctgttttcctggcaaaataatgaagttggcttaaggttttgctgaataaaatgagtgacagacaaaagtagccaaatttggcactcctgatgggttatttgatgaaggaggtgcaatgtatgggcttaactagttattctggatttctttccccatgttactcctccctaattctgatgaggaactgagagctgaatctattaatctattaactcttaaccttcctttttttttttttttttttttttgagacggagtctcactctgtcacccagcctggagtgcagtggcacgatcttggctcactataacctccgcctcccaggttcaagtgattctcctgcctcagcctcttaagtattgggattacaggcgcccgccaccatgtccagataatttttgtatttttagtagagacagtgtttcaccatgttggccaggctagtctcaaactcctgacctcaggtgatccacccacctcagcctcccaaagtgctggggttacagctgtaagccactgcatccggccttaaccttccttttctaaaggcactaccagacttctcctgctaccctaaggatggagtcctaattctgccactggaaccctgaatgcttcactttcagcacaaaaatttcaagcaaagacttgcagcctctccttctcagtttaggggaatgggggaattctttaatctgtggtgggacacacatgatgttaattagaatactctctcccaaagaggaggaaataaataggaaaatgaatcaagtctgatgcccgggaagtgtttatggatgttgtgcagaatagccctaccacaaagaaaatttcaaatgagacatcctatcactgctggggtttctcataacacaagagctgaggctaggtatggttgttttttttttcttgctttataagaatattattcaataagcagatttccaagccttgcattctttctattcaatgtttctaagattcacacatacaatttcgcaaagctgcattttattcatgttcactgctatctaatattctatttgtgatcatatcctactttgtttagccattctcctggggatcaacatggggttatctccagtttgtttcctctaacaaataatattgttctgaacatccactcgtctcctggagcccctgggcaagcatttctctgggtgtggacccattactacaccaggcatacgtccagcaagctaattaatgtgcagaattaagagataatgctaaactgttttccaaagcagttataccaatgtacactcccattaaaagtgacttttgtttttgactcggtatttttcaggtcaaacacattttcctttcaattttagatttatactgattttcacaaactgtcttggagaattatgaggtcctcaaacacaaagcttcatattgtggttcttagtcaagaaaatctcctagaggcaatgatccagctaattacagatcccctattgtccacgtctaaatttacgcattgtagctgggattagacccatgaatcctaggacaatgccaggggtgtcattaacttaaaaactctggcaggccaagtgcagtggatcacgcctgtaatcctagcactttgggagaccgaggcaggtggatcacgaggtcaggagttgaagaccagcctggccaagatggtgaaaccccatctctactaaaaatacaaaaattagccagccatggtggcacgcacctgtaatcccagctactcgggaagctgaggcagagaattgcttaaacccagaaggcggaggcggaggttgcagtgagccgagattgtgccaatgcactacagcctgggcgacacagcgagactccgtctcaaaaaaaaaacaaaaacaaaaacaaaaaaactctggcgtaagcatggtgtggagagtgtctgcagtgatatgagaatcctgggcacaacagcataagcagctgccttcagaatctaccgctcttgcctcccacggtccatacaacctcttttttattttcttcttttttaatgtttgtttatttatttatttaatgagacagagtctcactctgtcacccaagctggagtgcagaagcacgatcttggctcactgcaacccccgcctcctgggttcaagtgattctcctgcctcagcctccgaagtagctaggactacaggtgcccaccaccacacccagctaatttttgtatttttagtagagatggggtttcactatgttggccaggctggtctcgaacccctgacctcaagtgacccgcccacctcgacctcccaaagtgctaggattacaggcacgagccactgcgcccagcctgtgaaggctttaatagcaacaatccttataaaaatgatttttttggccgggcgcagtggctcacgcctgtaatcccaacactttgggaggctgaggcgggcagatcacgaggtcaggagatcgagaccatcctggttaacatggtgaaacccagtctctactaaaaatacaaaaaattagcccggcgtggtggcgggcacctgtagtcccaactactcaggaggctgaggcaggagaatggcgtgaacccgggaggcagagcttgcagtgagacgagatggtgtcactgcactcaagcctgggtgacgcagagagactccgtctcaaaaaaaaaaaaattttttttttttaagacagggtatatcacaggctggagtgcagtggtgctatcatagctcactgtagcctcaaactcctgtgcttaactgaccctcctgcctcagcctcccaagtagctgatactatatgcacaaaccaccattgcctgctaattatttttgtattttgtatagagatgggttcttgctatgttgcccaggctggtctcgaactcctggcctcaaacgatctaaccacctttgcctcacaaagccctagaatcatatacataagccaccacacctggccaagaatgatttttttaaattggaaaattttaaatgttcaataaggaacatattaagcaaactgtggtagagtagtccccccttatccacaagggtatgttccaagacccccagtggacgcctgaaccctatatatattgttttttcctattacttacctatgacaaagtttatacgttaggcacaataacaaattaacaactaataataaaatagggtaataataaactaataataaaattaaataaagtaagaatgactagaacacaagcactgtgataccacaacagtcgatctgatcaccaacagagctactaagtgacaaatgggagaatctgctggacaaagagatgattcgtgtcccaggtgagacagaacaggaaggtgtgagatttcatcgtgctgttccgaaccgcacacaatttaaaactcatgaattatgttctcacttctaagtgggagctcaataatgtgtacacatggacacagagagtggaataacaggcattggaggctcagaagggtggaaggggtgaacaatgagaaattacttaatgggtacaatgtacatgatcaggggtgatggctgcactcaaaatccagacttcaccacttcccaatatacccatgtaacaaaacaggggcacttgtaccctctaaatctatcaaaattaaataaacaaataaatcttatgaaatgttctggaatgttccattttatattttctttttcttgttttttttttttcatttaatattttcaaactgcagttggccacaggtaactgaaaccttggaaagcaacagcacagctaaggggacaattactatatatccattcagtggtacaaagtataactttctttccagaaccatttgagattaaattgcagaaaccatgacccttcaccctagtacttcaagctgtatttcctaagaacaagaatatttctccaacataaccacactgcaatgatcagatgcagaaaatttaacactgcaatattcagattcaggtatcagcatccatccaatgctaataactgctattcacatttagtcaattgtcccaaataacattcttgctagcagtattatttttcccaatgcaaggacacacatgtcatttagctgccatgtctctttattcccttttaatctggaatagttccttagtctttcatgaccttgacatcttttaaaagtcagccccggctgggcgcggtggctcacgcctgtaatcccagcactttgggaggccaaggcgggcggatcacttgaggtcaggagtttgagatcatcctggccaacatggtgaaaccccgtctctactaaaaatacaaaaattcgctgggcacggtggctcacgcctgtaatcccagcactttgggaggccgaggcgggcagatcacgagatcaagagatcgagaccatcctggccaaagtagtaaaaccccatctctactaaaaatacaaaaattagctgggcgtggtagtgcacacctgtagtcccaggtactcaggaggctgaggcaggagaatcgcttggacctgggaggtggaggttgcagtgagccaagatcgggccactgcactccagcctgggtgacagagtgagacttggtcttggggaaaaaaaaaaaaaaagttagccccattatattgcagctggtccctcaatttgtgtttgtctaatgtttcctaaatccaattcaggttatgcatttttggcacaggatgtcagttcaaattgatgacgctgactttgttcacatggttaaggtggtttccagaagaaccactataaaggttccttgtatatgtttgtaattcatacgtaatctgtggagtgaggctttggcatcttattccccagtgctatggtttgaatgtattccccaagtgcatgtgttggaaatgtaatccccagtgcaacagtgttgagaggtgggtgatttggtcataaaggctctgctgttattgcgggagtgggctcctgataaagggatgagtttggccccttcctttctctttcccttgctcaccctcttgcccttctgctttccaccatgagatgatgcagccagaaggccctcaccagatgtggctcctcaatcttggacttcccagcctccagaaccataaggcaaatacatttctgttcattataaattacccagtctcaggtattctgttacggaagcataaaacagaccaagacacccagtaagcgcccacctgaatgagtcatgactgtgttagttgcaatgtggtaacttttcgtttgttttttggtttttgagatggagtttcactcattgcccaggctggagtgcaatggtgcgatctcagctcaccacaacctccgcctcccgggttcaagtcattctcctgcctcagcctcctgagtagctgggattacaggcatgtaccaccatgcccagctaattttgtatttttagtagagacagggtttctccatgttggtcaggctcaggtgatccacccgacctcaggtgatccacccgccttggcctcccaaagtgctgggactacaggcatgagccactatacccggcctacaatgtggtaacgttttctgtatgattagtcaaatgcagtagtgagaagggggaaaagaataaaacaaagagttcaatctgtaactgaccatgaacaatcaattgagataacttgctaccttcagactagccaacttttccaactctgttgttccttcagcaatcattagctggcattctcctcttctacctctgtttatgtatttgttggtaagtttatttgctttttagtatgactctggactcatggattctcttttattcaacgtgataattcattattgccattattaattttgatattcaaattgttccaggtttggccactggagccccatcaagctgacccctgtgtccttctgacctgtctctatcattctttgagcacctccttgtgttttgaacaagccgctcctgactcatcgttgaccttccctccccttcccacaatgagccatttctcctaggagctctgactccttttaatggacaatggtatttagaaaacaagatatgggcatgaggaatgctcattgctacttgggtggccctgctccccagctctctcagcagacagatcttagaaataactcaagtcaaaatgaaaagcaggacaggcgcagtggctcactcctgtaatcccagcactttgtgaggctgaggtgggcagatcacttgaggccaggagttcgagaccagcatggctagcatggtgaaaccctgtctctactaaaaatacaaaaattagccaggtgtggtggtgcgtgcctgtaatcccagctactcaggaggctgaggcagaagaattgtctgaacctgggaggcagaggttgcagtgagccgagatcacaccactgcactccagcctgggcaacagagcgagactctgtctccaaaaaaacgaaaagttgtgttatccaccaagtttccaagtttctccactataaaggttccttttttatctttgtaattaataagtaatctgtggaatctctcattccaattcatggagctcttctttgccttccttcactccatatttttatctttcttctctcatagtgaggatcccagctcccaagaatatcattatatttacttatttgtttaatcctacaatacacagaaaatattttcagaattgctataccagatcactaccaactaagtgaagtacaaaatttctttgtagttttgtttgtttacacacaggtggatagtcaaagagctgtgttcaaagttatttgagtttgcctttctatgactaatttactatgcagtttagctcatttgttcacttctgtttgtattcaattttaggtttcctttcccccatcttatgttgatttagtttttctttttaaatactaaaacattaacatgttttgaaaagtcaaaactgcccccaaaaaaggtatgcctggagatgtgtcatttcctcttagactttcaccccattctcatccacccactgcaagtagccaatttattagtttctagttttttcttcctaggtttcttttttcccttttctctttttctttccaaaaataaggagatacttgaatgtttcacacaaaaagtagcctaacacagtactctctgtttaacttttgttcacttcctagtactgtataccctagaaatcactccacatcagttcagagaccttcctcactgttttttatacgtgcattgtgtggatgtaccagggtttattcacccaattgcctatgtattggcactgaagttgtttccaaaattttgccattgcaaacaatgctgcaatgagtgaccttgtacatatatacacttttatactggtgtaggcgtttctccagagtaaattcctacctgtagaattgctgggtcaaggggtaaatgcatatgtagttttgttaaacaatgctaaatgttcctctctaggagttggaccatcttgcattcccaccagcaatgtatgagagcatctgttaccccacagactgtcctgttgctttgcacttagcaacgggatcagttagaaccgtgatggtatctcagagtaccctgcatttctcctcctatgggagaaacggaacatcttttcattgaagggccagttttatgtcatttttgtgcagattgtcagttcatgttttttgcctatttggtctttgcttccctcaatgtttgagttatttacatacttgggatcttaaccctttatctgtgatagatgttgcaaatattttttcccagtttgacatctgtctttaatcaatggtaggggatttttttttctttttccttttaattttattttattttatttatttatttatttattttttttgagacagggtctcactccctcacccaggctggagtgcagagccgccatctctgctgacagcaagctctgcctccctggctaaagcaatcctcccacctcagcctccggagtagctgaaacgaacttttcttattttttgcagaggggttttcgccatgttggccaggctggtctccaactcctgaactcaaagagattctcccacctaggcctcccagcgtgctgggattacaggcgtgagccacagtgtctggcccatcttttttttttttttttttttttttaatgagacggagttcgctcttgtcgtccaggctggagtgcagcggtgcaatctcagctcactgcaacctccacctcccgagttcaagtgattctcctgcctcagcctcctgagtagctgggattacaggagcaccaccagcagcacgaccgactaatttttgttatttttagcagagacacggtttcaccatgttgcccaggctggtctcgaactcctgacctcaagtgatctgcctgcctcggcctcgcgaagtgctgagattacaagcgtgaaccaccgcgcccggccccagcttccgttttttaatgttattatgtatcagtcttttttttccgggcacttaggcgctgggtcattaggaagcctttccccacacgcaggtcctagtcaaccgtgctttttagcggcgagtaggccctgcggctctgcccctaacatgggcgcggggcacgcggccaggggcccgtgggagggggacagggcgcgcgaacccaggttctcaggccgcgtcgccgcgcgtgcgcactgacagccgggccgagccagcccgggtcccgcagggaagaacgccagcggcgcgcggaggccgcgctgccctgggccgcgaggtccctatggctgctccaccggaagccccgcccccttctggcagctggaggcggctttccggccgtcccggctgcagccccgaggcctcgactcaggagacggctgttccctggcagaggctcgcggtggactgcctgaccctcgcccggccccagcacgcccccggcgaacgcccacccctgtcccggcccgcagcgccccgacttacttctgaggccgaaacgcggccgctcctgcgccgggtggtcgcccgcgaatccctgccgcgccgcgctgcgccctctcgtggcccgcctggtggtgcaactgggctctctgcgcagggccgcggggccgcctggcctcctcctgccctggccgcggtgccgcgcgctcgggaacgcgggcctttcgccgctagccagcttctgcctctcggccacctgtcctctctcgcccacgctgcctgggaggcgcgcttctgccgccttcttgccgcgctcgctctagcctcgcccactcctgcggccttacagggccgaacctcaccctgccctgcggaaggcaggcctacaccttccctccgcgccttcctccctgaccggcaccaaacaccacgttgccctttccagcatcgacgacctattccccagttctctgacaccagctgaattagcgcgaaactactggttaagggattagcccagggagactgccctcccttcgccagccacaagcggggtgcccagaatgcccgcatttctaccctgcccactagaaactgagggattgccacagctcccgtgaggttcagcaattccctgggacgacacagaactcagggagacactttactgttagaagattattgtaaagaacacaactcggtaacagccgagtgcaagagatgcgcagcacggggggtgaagggcgggagtgctgtcctcacagcacctctgtgtgcccacctgcctggaagctctccgaaccctgtttaagagatttttatccaggtttcattatgtcattggccattagtgattgaattcaacctccagcccctttcccttcccgcaagaggagtagggacatgttggagctgaatgaaagttacaaccctctgatcacatggtgtgttgcaccagccccaccctgaatccatcctagagcccgcaattagccacctcattagtagaaactgtgatttgactaagggagtcattatgaataacaaaaacactcctattgcctaggaaattccaaggggtttaggagttctgtgtcaggaactggggacaaagaccaaatagattttttataccaaactccctaaaccaataacccagtttaatcgtgagaaaaacatcagacaaatcccagcagagggacattgtacaaaatagccaacctaaaatcggtcaaggttgtgaatgtggtcagaatcaaaatggtggagtcatttgtgttaaaagagagagaaaaaaaaaatgacaaatagagctggggaaagccatgaagaggattcttgttcctaaatgcgtgatgtcacaaatgctcataaaagatcaacactgtccacagaggccatgtcagccttcccaaaagaagattcctgccaggacatctgcccagcaatagcctgtccaacttcagactggtatcaccctgatcgatacttgtagctgaggctaattatcaaaaacaatatgtaatcctcctcattttttctttaaaaatcttggtcttcctttacctccctgaatttcacacacatagcttaaaatggcccacatggctccattgcaatgccctgttcccaaataaataccattttcttttagagaacctctctgttatggaggttgacaaggtcaccaaaaccaaagagagtgtgaggaactgcctcagccaagaggcatctaaggagacatgatggttaaatgtaagtggtgtcctagatgggatcctggaacagaaaaaggacattggtagaaaatggaggaaatttaaataatgtaccaataatatcaataatataacgtaccaatgttggtttattaattgttaacaaatgtgccatactaatgtaagatacaaatatgaggaaactggtttatgggaactctctgcactatcttgcaaattatctgtaaatcttaaactattctaaaaataacgctttaaaaaaaaattagagctgagtgtcatgggcacacctgtaatcccagcactttgggaggccaaggtgggaggatcacttgggcccaagagtttcagagccagcctgggtgacacagtgagaccccatctcttaaaaaaaaaaaatagccaggcatggcagcgtgcgcctgtagtcccagctactcaggaggctgaggggggaggatctcttgagcctaggaggttgaggctgccgtgagtcaagatgacgccactgcactcctgcctgggcaacagagcaagatcttgtctcagaaaagacaagaatcataaataaataaacaagtaaactagaaataagccagatgtggtgaggcatgcctataatcagttatttgggaggctgtggtgggaggatagcttgagcccaggagtccaagaccagcctaagcaatatagcaagactccctctgaaaataaaaggaaaaacaattacaaagatttaaaagcccttcaattttgaggatccaccttctttaaacagcagagggagaaagtgtataaattgagtgacattcactggaattaggagatccggagtggaaatttccagagaaattccaaaaatcctggtgagaagaaaggaatagccatagcaggccctgagaatacagagcttcctagccaagtcaaatccgtcccatccttctcccacctccactccccctcccctggcaccaagggggtcagcagagggagcagaaaccttcagccactccccttcctgcagaccagcagccccagccctgaccacagctggctggccttggaatgaagcttgaaggactgataaatacctgggactggacgtactagtttctgaattgagaacaagtttgtgatttaaagtgatcttggccgggcgcaaatggctcacgcctgtaatccctgccctttgggaggcttaggcgggcagatcacctgaggtcgggagattgagaccagcctggccaacatagcgaacccccgtctctactaaacatacaaaaattagccaggcatggcggcttgcgcctgtaatcccagctactcaggaggctgagacaggagaatcacttgagcccaggaagtggaggttgcagtgagccaagatctcactactgcactccagcctgggcaatggagcaagactgcatctcaaaacaaacaaacaaacaaatcaataaagtgactctaagattgtccccaacctaacatgagcagaaacgttttgggtctgtgttatgagttcaattgtatcctcctaaaaaagctatgttaaagtcctaaatgctcgcatacctgagaatatgacctcctttgaaaacaaggtcgttgcagatgtaattagttaagatgaggtcacactcacctaatatgcctggtgtctttgtgataatatggacatatggcgacagagggactgggagaatgccacgtgacaacaaaggcagaggctggcccaatgctgcaaaccaccgaagcaaggaagaagcgaggaagacttgaggaaggatcccccacaggtttcagagggagcacagccctcctgccactttaattttgaacttctaggctcaagaattgcgagacaaaattctgttgttttaaggcaccccgtttgtagtactttgctgcagaggccctgagagtccaattcagccctattagctttttcatccggggcaagtgaagatactctctactggatacagatagagatggtagaagataaagctgtgtttctcacgtcctgtgagttatgcatgcaaggtaccagttactcaactgtcctgtggactaaatctctttaagggactaagggagcttaccaggcccctggtaaggaggcctaggcccataggtggtaccaaagcaaaagggacctagcacagtggtgaaaaactccagcataccttctgggaacttgccctgcagatacggtcatctgtgtgcaaaatggtgtatgtgtgtacaaggttattcactgaggcattgtttgcaataacagaaggttggaaaccactacatatccaataggtatggaaggcaaataagtatttgtactccatgcgctattaagactgtgcagcttggccgggcatggtggctcatgcctgtaatcccagcactttgggaggccgaggtgggtggatcacgaggtcgggggttcgagaccagtctgatcaacacggtgaaacccccatctctactaaaaatacaaaaaactggccaggctggtggcgcgcgcctgtaatcccagctacgtgggaggctgaggcaggagaatcgcttgaacccgggaagcggaggttgcagtgagctgagatagcgccactgcactccagcctgggcgacagagcgagactccgtctcagaaacaaaccaaccaacaaaaaaaccgtgcagctcttaaaaactgggaggaagcgacgcccagcaagacggcggcagcgcagcgcgtgtgttgttgaggatccaggacgctggcccgcgggcgtcttggtcttcttcaccgctgcgaaatcgcgtcacctaccgctactggcggattcgggaggtgctgaagcacgccaagcacttccggcgggggagcggggtgcgggggaaattgctgctacaggttggcggtcagagccgggactggagcctttgtgaaatgcaccaaagccggaaacctgaagaagaggaccatgaggaccctctggattaatcgaattacagctgctacccaggaacacggcccgaagtacccagcgttcactggcaatttaattaagtgccaggtgaagcgccacaagaaagtcccagcgaatctggccatctacgaaccagagacttttaaatctttggctgccttggccaataggaggcgacaggaagaatttgctgctgccttaggagatgggaaggcagcatatttttccagaatggtacagtaccgctgaggaccgttgctgtattgactaggaaaagacacagagtaatttgcattttatttgatttgtgcttgtgtttatccacattcgagtaacaggcatgagggaaggccccttctctctgggacagagcctcacagatggcttccgtgtttcgtgtgaatgaaactcaaacattgttcgaaaaaaaaaaaattgggaggaagcaagaaagaaaaagagtaagggacctgtttgtatactaatagagaaatagaaatatctggaatacagtaacctcccttttgtgtaaaaggcagggaggctgataagaaaataatataactgtatttcggccgggtggagtggctcacgtctgtaatcccagcactttgggggccacggcgggtggatctcttgagagcaggagtttgagaccagcctgggcaatacggtaaaaccccgtctctactaaaattacaaaaattagccagtgtggtgatgcacacatgtaatcccagctactcaggaggttgaggcatgagaatcgcttgaacccgggaggcggaggttgcagtgagcagaaatcacgccactgcactccagtctgggcgacagagcaagactctgtcttgaaaaataaaataaaatacataaaaaagataaaataaaataaagaatataaaatgcacttattgtctattatgtactggacattgttctatcagtacacagccaagggtgaaataggccatggctagaagtgaacaaagttatttactcacagaaaatgggcagtgggctaggcatatttactcatctttatttcaaacgttagaaaagaattcctgtacatttctaggagccatagatgcccaggataccaatgcttttacttcctcacattcttcatgcttctgtagccgcagagcaaaatatagatagtgttttctataggtacactataagaacccagagaggcagaggaaactggatgggtctgaattccaacccatcagaacagaagctaagtttcagtgtgacccacagcctgactagttttcattcaggattggtctttcagttccaggccgggagcatggtggctcatgcctgtaatcccaggactttgggaagctgaggcgggaggatcaattgagtccgggagtttgagaccaactcaggcattatagtgagactccatctctacagaaaatttaaaaagtaggcatggtggtacatacctgtagtctcaactacttgggaggctgaggtgggaggatctctcgagccaaggaggtcgaggctgcagtaagccatgatgacaccactgcactctagcctgggtgacagagcgagaccctgtctcaaaaaaaaaaaaaaaagagagaaaaagaaaaaaatgagttccacatcttgctcgcagcccattctctatgaattgagagatgacagaagatgactgtttttttgttttgttttgttttgtttttttgagatggagtctcgctctgtcaggctggagtagtgcagtggtgcaatcttggctcactgcaacctctgcctcccgggttcaagcaattctgcctcagcctcctgagtagctgggattacaggtgtgcaccaccacgcctggctaatttttatatttttagtagagacagggtttcaccatgttggccaggatgttgtcaatctcctgacctcatgatccacccacctcagcctcccaaagtgctgggattacaggcgtgagccaccgcacccagcctggatgactttttaaccatgtgtttgtgatcttctccatggcctctgctgctcagcttattaataggttggttggccatctacaatttatctttcatgtctttcccccagaaagccagtgtacctgtgatgggagatcaatcctgacagctcacagaacgagtctggtcttctgtggagcacacctgctaagtcccagactctgcagcaagcctggctggcttcacatcacactcctgatcttcggggtgactttgaagtaatgattgagcttctctatgacttggtttcctctcctcaaaatatggataacctactttctctcttacatgcttattgtcaggactgagtaaattaaaatccacaaaccacagtcctggcacacagtacatgctcaataaatgttaaagttatagttactacagtagctattattaatgcagtggacatgtctccgcctcagcttccattatcttgtctgcaaaatgaaaagatgaaccaggaatgagactgaagttctcttctagctctgagatctgtaggtctggctttcctgatttgctttgtccatttttttttcccacatggcactgtatgtgcccaggcaatatgtaacgaataggagtttcttctgttttcctatagaaacaactagaagagtgaatctcattacattgacaaactcagggaccaggccaggcgcggtggctcacacctgtaatcccagcactttgggaggccgaggtggatggatcacttgaggccaggagtttgagaccagcctgtgcaacatggtgaaaccccgtctctactgaaaagacaaaaatagccaggtgtggtggtgcgcacctgtagtcccagctactcaggaggctgaggcaggagaatagcttgaaccaggagatggaggttgcagtgagctgagaccacagcactgcacaccagtctgggcaacagagtgaaactacggctcaaaaaaaaatgaccacacactgggcggtttacaacaacagcagtgtcttgtctcacagctctggggcctgaagtctgaaacccaggtgcctgcagcgttgtttccttgaagaggctctcggggagaatcagtcccatgcccctctccctctccttgcatctgatgttgccagcagaccttgtgttccttggctcctagaggcttcactccagtctctgtgtctgtcttctcatggctgtcttctccgtgtgtctctgtgtttccaatctccttccgcctttttcttatgaggacgcctgtcattggatttaggttccaccctgtgttagtctgttttgtgctgctgtaatacaatgccagagactaggtaatgataaaaaaaaaaaaaaaggaaatggatttcatacaattctagaggctaggaagcccaaggtcaaggcactggtaggattggtgtctggtgagggcctggtctctgcttccaagatggtgccttgaatacggggaggaacgctgttccttacaaagcaaaagggtataagagtgagaacccactcctgacagccttttttttaagggcattaaacccatccatgagggcagaactctcatggcctaatcacctgttaaaggccccacctcccaataccattacattgaaaattaaatttcaacaacagtttgggagaggacaaatatccaatccatagtacaccctaaatccagaatgatctcctctcaagatccctgctaccacctccttctcctccttctcctcctcctcttccttctcctccttctgcttcttattgttgttattttagagacagggtcttgctttatctcccaagctagagtgcagtggtgcgatcatagcttactgcagcctccaacccctgggctcaagtgatccttccacctcagcctcccgagtagctgggactacagttgtgtaccaacatgcctggctaggagtctctaatttaattgcatctgccaagcctctttttccaagtaaggtcacattcacaggttctggggggcagggcttagacatagatttttgggggccactgcttaatgtactgtaggagggccacatcctgtgtactacagggacagcctgaggtgagattctgctacctaccacgtgccacctgtggataaaactttctgctttccgtgttttctcatggtgggtgttagctcaaagtacataattaaattggacgactccatagtacttcttcattttcttctgaagctagctgagcagtgactgaaacagaggaaacccctgccctcatggaactgacacactcctaggaaaggcagacaacaagtaaaacaaataggtaagagacagtaggacaggcacagtggctcacgcctgtgctcccagcactttgggaggcttaggtgggtgaactgctaaagcttaggaattccaggccagcctgggtaatgtggcaaaaccacttctctacaaaaaaattcaaaaattagccaggtgtggtggtgtacacctgtagtcccagttgctcgggaggctgaggcaggaggatcgcttgagcccaggaggttgaggctgcagtgagccctgattgcaccactgcattccagcctgggtgacagagcgagaccctgtcttaaaagaaatagtaggttaaatgagttaaggtgatagatatatgaaaaatatggttatgttaaatgtaatggagaaaactgaagcagggaaggaggctagggaatgccacggtacacgtgtctttgtgagtgtgaaggagagagaggctttaaacaggtgtccagagaaggcgtcatccccggaggagatcggagtcagacctgaaggaggtgaggtggcaggccatgcagacgtctggaaggacagtgttgcaggcagaggccctgagacatgaatgtgcctgggaggctcccaggccagaaacagtccagagggaagggggtctgtggggagtggggtagggaaggtaaagccagggctatagatggttccagcttccagacatcagtcatggcatggttaagctagggatgtctgcagtcatgcagaaacgcttcttcttcttcttcttttttttttttctttttgagtttgagttttactcttgttgcccaggttagagtgcaatggtgcaatcttggctcatcagagcctccgtctcccgggttcaaatgattctcctgcctcagcctcccaagtagctgggattacaggcgtgcaccaccatgcccagctaattaacttttttcttttattttcttttttctttttcttgagacggaatcttgctcttgttgcccaggctagagtgcaatggcgtgatcttggctcaccgcaacctccgcctcccgggttcaagcgattctcctgcctcagcctcccaagtagctgagattacaggtatgcgccaccatgcctggctaattttgtatttttagtagagacagggtttctccatgttggtcaggctggtctcaaactcccgaccttaggtgatcctcctgcctcagcctcccaaagtgctggaattacaggcgtgagccaccgcgcctggccttttttttttcccgaaagctaacgtgggccttaacataaggattcaaaaacaggtatatttcacctaacaattctatttctgagaatatatccaaaagaactgacagcaggtgcttgaaggaatggtgttcatagtgcattattcacaacagccagaaggtggaagcaactcaagtgtccatctactgaggatgaatggataaacaaaatgtggtctctgcacacaagggaatattactcagcctgaaaaaggaaagaaattctaagctatactacaatatggatgaaccttatgggtattatgctgagtgcaataaatccgccaagaaaggcaaatactcacagattccacttatatgaggtacctataattctcaaactcacgaggacagaaagaatggtggctgccagggcctggcaaagggggaagtgggaagttactgttgaagagtttcagctttgcaagatgaagagttctctgggtagatggtggtgatgggagcacagcagcatgagtgtacctaatgctgctaaactgtgcacctcaaatggtaaagatgctagattccatgttacgtgtattttaccacaattgtaaaaaataaaaataaataacttttggctggacatggtggttcacacctgtagtcccagcattttgggaggccgaggcgggcagatctcttgaggtcaggagtttgagaccagtctaaacaacatgatgagaccccgtttctactaaaaatacaaaaattagctgggtgtggtggcacacccctgtaatcccagctactcaggaggctgaggcatgagaattgcttgaacccgggaggcagaggttgccatgagccgagattgcgccactgcactccagccggtgtgacagaatgacactccatctcaaacaaaacaaaacaaacaaacaaaaaacttaaaaaaaaaacaccccaaacaaatatatctcttattcccatggaacaaatatacaaatatccttttttggtcttaaatattttagaaaataacaacatcaaaagcagtaacaacctcttgtagcttctaaaacagctttcagagttgcagaacacttaggagcagataacaggaaatacggtctaactaaacagaagaaaaggaaattatcatttccctgcttgtcttcagcactgtttatgtaaaaatattctgacctcttagatgttctgagttttgggatcctcttcctaggcaggccggaaaccttcagggctgacatctttactttttgtttccaggcaacagtggagagtcagcatatgaaaaagaatttttaattaaagacagcaggagaagaaatagaatctccattttatttaactcccgggcagagagggtttcacacacttgaagttcagcaatttttcccagtttataagccaggggcctaattaagtttcttaagatttctaccccttccccaaattacttcctctattataaagacctcccatggactcaaacaaagtttaagaaatagtttaaaatacttggtaacacaaaaggtctttgaattcccaactacctcaatggcaatttattttgttcactgtattttaattcctgcacctgcaaaagaaaaactaaaaaacaaacaaacaaaaaactctcattttacattaccagtaaatttatttttcattaaacacattttcaacaaaaacacgcataattatggattttaattatggtttatgtagctacattctacctccccgaggacagattatccacataaattatttggaattcttctactaaggaaatttgtctattctccccatattttcaattattcaatatttactgatatcaatataagctcaagagtatttattttatacctcgagttataaacaaatattactttattttgttgctcaaattgtcccagctttggccatggtggtcttatattgtacttggccgaaggaaaaaaaaaagagagagaaaatagactgtctactgcctgcaggtgctgagtttggtctttttgctctttaaatttatttttattttattttatatttattttttgagacagagtctcactctgtcatttgggctggtgtatagtgatgcaatcttggcttactgcaacttccacctcccgggttcgagcgattctcctgcctcagcctccggagtagctaggattacaggtgcacaccaccacgcctggctaattttttgtatttttttttttttaagtactgacagggtttcaccatgttggcctggctggtctcaaactcctgacctaatgtgatccacctgcctcggcctcgcaaagtgctgggattccagacgtgagctaccatgcccagcccttcaaatttatttttagtggcgctcactttcttttttttcttttcttttcttttttttttttttttgagacagagtctcattgtgcagtccaggctagagggcaatggtgcggtctcagctcactgcaacctctgccttccgggttcaagcgatcctcctgcctcagccctccgagtaggtgggactacaggcgtgtgccactactcccgggtaatttttgtatttttattagagacggggtttcactgtgttggccaggctggtcttgaactcctgacctcatgacccacccgccttggccttccaaactgctgggattacaggggtgagccaccgcgcctggccgtggcattcactttctacagcccaggtatctgacaggaactcgagtcctgcttctctgtaccagttacttaacctctgggaagtccagtttcttaatctgtaaactgaggataatgcctgatttgcagggttagagggaggattataaattaatgtatgctccagaaaagaccaaatgattctacctctgtgaggtgcctggaatggtcaaatgcatagatacagaaagcggaatggtggttaccaatggcagggggtggggaatgaggagttactgtttcacgggtacagagtttggtttgggatgatgaaaaagttctggagatggggggccggttgcacaacaatgtgagtggatttattgccactgaattgtacatttgaaaatggttaaaatggtaaattttatgttatgtaccttttgccacaataaaaagtaatatattcattgttgaaaatttagaaaacaagttttaaagcccctccaaatctttggtaatgtcagcactcagcaggcacttctgttttatttgtagcctttgaatatatagttcacatcctatgcatacagttttgttctttccacatggtcatgtttttcctatgctgtccaaaactctgtaaacatatttttattaactgcatactattctaccgtcatttgtttaatcattgccatatttttggacatagtttttcaacagtgtaagcagcgctctctgattaaatacatcttcattcccatttcagaatacatctacagtatagacacaagtagaattactgggacaaaaggtgaactttcatttttgttgtgctttttttgagacagggtcttagggtcttgctctgtggcccaacatggagtgcagtggcatgatcatggctcactgcagcctgcaactcctgggttcaaacagtcctcccacctcagcctcctgggtagctgggaccacaaacatgtgtcaccacacccggcctgggtgaacatttttatggcacacaatacaccttatcaaactttttcattgcattgccaccagctacctagaagacactcatttaaaaacatccacacctagccaggcgtggtggtgtacacctgtagtcctagctacttgggaggctgaggtgggaggatcatttgagcctggaaggttgaggctgcagtgagccgtgatcatgccactgcactccaacctgggcaacagggcaagactctgtctcaaaaaacaaacaaacaaaaaacacaacgaaaacaccccttctgcacccagttgcccagtgttctttcattttcttttctttttttaaaaaattatatatatatatatttgagaaaaataacagcgtctcactctgtggcccaggctgggctgcagtggtgtgatcatgtcttactgcagcctcaacttcctcgagctcaggtaatcctcccacctcagcctcctgagtagctgggaccacaggcccactccaccacgcctggttaatttttgtatttttgtagagacggggtttcaccactccggccaggctggtctggaactcttgacctcaagtgatctgcctgcctctgcttcccaaagtgtgcagattacaggattgagccaccgcgccctgcccagtgttcttgtaaaaccccattctgcatttagattaaatatggtaccttattgttgcaatatggcccactaatgttctttgcctccttctagcctcctcccattaattcccccctcttaaatgtttgcctttatttagatttaattattgttgctcaaaatcttaattaaaaaaatgtgaaaacactttaatgtctgaagttcttcgattttttttttttttttttttttgagacagagtctggctcttgttgcccaggctagagtgcactggcgcgatctcggctcactgcaacttctgcctcccgagttcaagcgattctcctgcctcagcctcccaagtagctgggattacaggcacccgccaccacacccggctatttttttgtatttttcttagtggatacggggtttcatcatgttggccaggctggtctcaaactcccgacctcaagtgatccacccgcctgggcctcccaaagtgctgggattacaggcatgaaccaccgcgccttgcggaagttcttcgatttttttttttttttttggaaagggaatctctctctgtctcccacgctggagtgcagtggcacactctcggctcactgcaacctccgcctcccagattcaagccattctcctgcctcagcctcccaagtagctgggattacaggagcctgccaccacgcccggctaatttttttatttttagtagagacgggtttcaccatattggccagactgatctcgaactcctgacttcaagtgatccatccacctgcctcggtctcccaaagtgctgggattacaggtgagaaccaccgcgcctggcctagttcttcgattttttaacatccatcacagtaacttaaattatataaagtaactacccctgaggagcccggggtagttgaaggccctccagcgccttcggtgttctgtcgcagtgctctacgtgtgaaaccgctttctcccaccctggccgtgcgctggtgatggtggcagcggcgctccagcgacgcccggggaagtgtccccagggtcgggcaaggtcgcttctgctggtcgggaggccctttctaagcctggctggggctaaccgaaggagaagcccgccgctccaggctttattaaaaattcgcattctttccaaggccgccatcggtgggaagggtgcgctcgtagcacccctcttgctcggttccattcctggccttctgtctcctggaagggtcgccgcgccccaccccacccgcttcgccacgggttcgagccctggcgtcggggcgtccgggagcccactgtccagcaccgaaggcaaggccggtgcacgcggacccgaggattcggtagatgtccccgaagacccgctgccgctctaaggcggtggaagcgagattctccggaaacccagggaatccgatgctcgcacaggaccaaagcccgaggccgcggggaccacagagggacggagaagccgggactcctcacatcccacatccggcaggggaagcccagcaggtgagcgcaggtccccccagtccccgagggagtgcgcccgacggaaacgcccctagcccgcgggcctcgctttcctctcccgggttcctgggtcacttcccgctgtctccagcccgagctcgtggccccaatccctggtacctccatcctctggtcaccccttctctggtgccccctccccgacttttctttgtcccgtccccacccttgcccgggcctgccggacccccctccttgacacccggcgccacctccttgagcttttctcgtctcctccccatccccggctccctggtcccctcccggaacttctctggtcccctccgctcctccgacccgggcttttccttcgtaccctgcggccccctccgcacccctcacggagctcctcgggtcctgccccctcccagcgcttgcccgcgccgccccgcccccgtttttaaacctggcgcgcgggtaggtgagcgcgttagcccgagtggatctaggcgcgctcgtaggccggcgccgcagcaaggggcgcgggctccgccggcaccatggagcccgaagcggcggccggagcccggaaggcgcgggggcgcggctgtcactgccccggggacgctccctggaggcctccgccaccgcgcgggccggagaggtgagggtggccccgcgccccggtggacgcgctgagaggcgtgcgcggtggcggtgcggggagcgcagcgagcgggaggctggggcgctgctgaacccccgatccccagcggagctccggagctcgacggcgacgccaagcaagctcctgagccggcagccgggttcccgggaggggcgctcagttctccggttccaacgcacagctctgaagtgcggaggcccaggatgtagctggccaggaaaggggccgacgcttccgtgtagaggagatctcagttagccagccggggacactgcagtctcgggctcctaagccagccttgcaaaggcaatctctcaccttgctactttctcggtagccgtttctgttgtccctggattgggggctcggcgttcgctgtccctgggcaccaacccttttaaagacagtaacgttgtaggaaatcaaattagccagggaggtagggaagggaccgggtaggccggatgggccaggtagccaggcaggagaaagattccctcttttttttttttttttttttttttttgagacagggtctcactgtgtcgcccaggctggagtgcaatggcgtgatctcggctcacgggaacctccgcctcccgggttcaagcgattttcctgcctcagcctcctgagtagcagggattacacgcgcctgccaccacgcccggctaatttttgtatttttagtagagactgggtttcgccatgttggccaggctggtctcgaactcctgacctcgagtgatccagtaacctcagcctcccaaagtgctgggattacaggtgtgagccaccgcgcccagccccctttttttgtttgtttgtttttcatcctacaactctgtaaaatcatctctgtagaatcaatctccttccgtgaccaaggtggtgtgattgaaattaaccggggacaaagtagacagctatagttggggaaccccgaattgaacaattcagccaggatttgcagggagagaaatctctcaactaatgggttccctgataattgtgtgagattcgggacctcccttctcaaagcttaactggagacagagaactggggacgtagcaggagagaaaaaacacaaatgacagtaatttatccacagccctgagaactccagggaaagttcctggggggtccggtgcctctttttcaggcagacactggaactaagaatagctctcatggcatagtttgaaggcagcagaagtgcccagggttcactctctcctggcgcttgccgttccagccccgcgccgtggcgaccttggatccagacacctggagatgctgagctgaccagaactggaaggccggtaaggttcagtgcgggcgttgtaggtaacccttccagccagaaagtggcatcgtcttttaaaatacagggaccgtgaatggccttctgcgcagggccgtcccttgggcgtctaacccaggagcgcctcggggtctgggagttggaacctgaatgagtaaggtgttaatcagacctgactcgcattatagattgggctcctggtggcttctccttcctaaaaaagcatacccactataaaagcataatcgtaggctgggcgcggtggctcgggcctgtaatctcagcactttgggaggccgagacgggtggatcacctgaagtcaggagttcgtgaccagcctggccaagatggcgaaaccccgtctctactaaaaatataaaaattagctgggcatggtggcaggcgcctgtaatcccagctacttaggaggccgaggcaggagaatcgcttgaacccgggaggcggaggttgcagggagccgagatcatgccactgcactccagtgtgggcgacagagcaagactcatctcaaaaaaaaaaaaaaaaaaaaaaaaccgtagtcgtttcatgggaattataaggaatgtcctccctgttgcggtttcttctgcaaagcaacaggtcgggaggggaggggagaggctgccactatcgcttgccttggagaaaagcttagagcaccattagcgttgggccggtgccacagagcaaataggactgagccccatctgaggtgcccagagttgccgttaaaagcccccaccccgcgtctggccctttctgaagcactttcagccccgtcaagcactcctggggtatctcatgttgtctgagcaaatacactcaagcagagggctttgtgggcaagattaatgacctccaccattcttttgttactctgcattggtaactcagttgctttatacttactgatgtaatgacttgctttcatagaatttacctttcctttgttacattttaaaatataaattgatgacttttacttaatttttttttttttgatgactcttaaaacactgaagaattaggctgggaaagaccatgtattgaatttacgtaacacgtgttatatggactaacgtgcagttatttgtaatatggtaagaaaacttgattgtgggaaaacagaccttcaccgtattttgatatttacacgactttattaaattaatctgaatattgggaattttaatttacttcaaagaaggaagcagataaaagataaatcaattaacaagagatgatttttagtccccgattatttatacatatatctaaataatgtaaaatcccttcttttgcattcaaacttagttcttaaacataaaatttaaaggtgcttgtgtgagaatatagatgtttacaattatccagttttcttttaaatgaaatggatgtggagcctatcagtttcttgcaggaataaaaatacgatagcacgctccctaagtaagacagatggttttgggttttgttttctgttttgataaggccgtttgtgagaaaaatttacttgcagagaaatgttaaacgttaactttctcgctgatcagcaggtagcctgtcacgctgaagtagttctgtccacggatgtgggtgtgggaagagtggttgttccctgggggctgtagagcccgccaatcctcacccctagcccggagcccgctctttgcagagcccagctggttgcgcagagcgaccagcgccagtctgtgctctggtactgtgcaccgccctgggttccctgcagtccaccgacgagagctgcccagcgcagggaaggaacgcttcttgctcaacagcgccctcgcccgacaaagcaggacaattccccagctcccaagccctcttctgtatttctcaaaaatgccattggctggagtggcggtgaagaggactaacgcctggtgacctgtaccagggctcccggcaagcaaagcaaaactagaataaaacctcaagtaggccgggcgcgtggctcaccctgtaatctcagcactttgggaggccgaggcggtcggatcatctgaggtcaggagttcgagactgacctcacgaacatggtgaaaccctgtctctactaaaaatacaaaagttagccaggcagtggtggtgtgcgcctgtaatcctagctactcgggatgctgaagcaggaggatcgcttgaacctgggaggcagaggttgcagtgagctgagatcgggacactgcattccagcgtgggagacagaatgagaccctgtctcaaaaacaaaaataaaacccaaaaaaccctcaagcagagggaaggcctcaaggccctgtactctgagcagcacggtcaccctcacccacttcatgcccctacaacacttagggagctatctccctcccctacctgcacctttcttgatctctgttgcgtttccctcctggccacttgcgggcactgtcagggaggcagtttcctggaaaacatcagggactgtttgttcttctgggcctgccctatctgccaggctcccacttcttagccctagcccggtcagagactcgaacggggaggagaaggctgacccccactgaaagcctctctgcacctgtcagtcctcaggctcataggaaaacacactcgcacatatgttaaacgcagtgcttgcgttgtgcacatttctgttctcgtgtttcattataaaatgtgaatatttagacatttccctcagcagacaaaggatccttttggaaaacaatcaggatatttatggcattttttttttttgaggcggagtttcgctcttgtcgcccaggctggagtgcaatggtgcagtctcagctcactgcaatctcagctcactgcagcctctgcctcccaggttcaagcgattcgcctgcctcagcctccaagtagctgggattacaagcgtgcgccaccacgcccggctaatttttgtatttgtagtagggacgggggtttcactatgttggccaggctggtctcgaactcctgacctcagatcgtgatgctcctgcctccgcctcccacagtgctggtaattacgggcgtgagccactgcgccctgcctggcataaaacttttaaagctgcatatgtttgtggggtaaggtttttaaagtggataaaggtgtgctgaatgttttaacagggtccagttagaactggacgatttacagaagttattctttctctgacacctgccactgccgagttaggccctgtctgatcgcagggcgccaaatagccgttagcagggcaagattgcttgtggccataaagtagggcctgaggaaataggagtgttttataatcacgaacagagcttaacaaagaagcagcttcctgtatcccccaaagagtgaacaactttatggaaaagatttggtttcaaagagcctcatcactttcttagctcatcacagtgaattatgaaaatatggctggggccgggcgcgatgtctcacgcctgtaatcccagcactttgggaggccgaggcgggcggatcatgagatcaggagatcgaaacacggtgaaaccccatctctactaaaaatacaaaaaattagccgggcgtggtggcatgcgcctgtagtcccagctactcgggaggctgaggcaggagaatctcagtgagccgagatcgcaccactgcactccagcctgggtgagcagagtaagactccgtctcaaaaaaaaaaaaaaaaaaaaaaaaaaaaatggcagggaaaatgtaatgtctgcagaggctccttacaggcgaatttgctcatatatatcatgtgcacattccctccgccacccgccccagcgtccgtgcaggatggaatggcgtggagattcacggtgtcaaagtccttccttgtcaggccatagtaagttttgtcctgtttctcatctggttccaattgaactttggaatctgaagatttggggtttctgatgcactgccccagaccatttccgctccttatttattattattattattattattattattattattattatttttgagacggagtctcgctctgttgccaggctggagtgcagtggtgcaatctcagctcactgcaacctccgcttcccgggttcaggcgattctcctgcctcagcctcccgagtagttgggactacaggcacatgccaccacgcccagctaaattttttggtattgttagtagagactgggtttcactgtgttggccaggctggtcttgaactcctcacctcaagtgatctgcccacttgggcctcccaaagtgctgccattacaggagtgagccaccgtgcccagcctgagttcacatcctgccctcatccagaagctctttaccatcaattttcaagactggttcctccaagccctttctataccagcctcatctgtgcacagctccctgcggccgctgctctccttgaaatacagatctgatagttggactccctgactcaaaaatccatctccagttcctgtatccagagtcaaacctaaactcaacagtgggtattccaggcatatgtcaccgtttgagccctttgcccatcacagggtctcacttgttccacacaaggctcctcatggctccccacttgcaccccctgttttcctgccactctgatttttttttttttttttttgagacggagtgtcgctctgtcgtccaggctggagtgcagtggcaggatcttggctcactgtaacctccacctcccaggttcaagtgattcttgtgcctcagcctcccaagtagctgggattacaggcatgcgccaccacgcccatgcctagctaaattttcagattccacccgcctcaatctcccaaaatgctggtattacaggcatgagctaccactcccggtactgccactctgaatttgatgctctcctctgccaaaatagtcttagaattgcaaacccacatgccacagatgtctctgcgaggcccttcatgaacccgttcctgaccttccttcatgcttagaatcatgggtatcttaccgtgtgatgctttgtagctggttattagcatacatgtgcgtctctgtccattagattgtaaaatgctggactgaggcactgtgtccaactccttccatctgaattcttcacagtgcctgggacattttgggccgcggtaacaggaacacgggcttatcgaatactgataaggtgtctaaactctctaaaattggtattgatatgaccaactgcagatgacttacgttctgtggtttaaaacctcaggatgtcaccttccgacactcctgcactgtctctgtgtttgtatgtgtctgtcgttacagcttgaacctagggctgaccaacacacttttggatcaaagggagcctttgggtttcagcatcctgtaaggtaatatacgacttcacaataagtaatctgtaatttccttttaatataggcattaatatgctttagtgtcttcaaccacatagattgtcaacaaagtggaaaataattcaatgtattctttggtattgtttagtttccttataccaaggagattttgttggatttctggaatccattcatgtattcattcattcagtgttttctacaaagtgcaattggcctctctcttttctttatacctgttatttctacttctcattacaaattgtgccttgtattatatttatataattgcatgtgaattgtatatgcatatacaaaaacttatatattgaggtatatttctattgttctaccaggatataagctagtatattgtctagtgcaaagtcgaccttcaaaatctatgtgttgagggtggacatggtggctcatgcctgtaatcccagcactttgggaggctgaggcaggtggatcacctgaggtcaggagttcgagaccagcctgaccaacatggtgaaacccccgtctctactaaaaatacaaaaaattagctgggcatggtggtgggcacctgtaatcccggctacttgggaggctgaggcaggagaatcgcttgaatctgggaggtggaggttgcagtgagccgagatcacgccactgtactccagcctgggcgacaagagcgaaactctgtctccaaaaaaaaaaatctatgtgttgagtaaatggttgtctccagcacagtgggtgccgtgcacctttgagagagccttttcctcccacctcctaagtgtgtgtcatggtcctggtggtgaccaggattctcactgctgtatccatctacactctgtccattttagacaagtggctcacgttcaggatttctgcctgtctctctgtctctgtctctctctttttctctgtctgtctcgctcgatctcctttaccaaaattaaccttgcctgggccgcctccaccaggtgcctttgccctggttacccaagaagactggaaagcttaatacaacccaaagacactcatgtgtaggcataaagctcagtctcctcagactggtcagaaggaagcttcccttgtatgccttacaccaatagttttcttttctcttctgacatctcactctgtcacccagcttggagtgcagtggcacaatctcagctcactgcaacccctgcctcctgagcttaaatgatcctcccacttcaccctcctaagtggctgggaccacaggtatgtgccaccatgctctgctaattttgtaatttttttgtagagacaaggtctcactatattgcccagactggtcttgaattcctgggctcaagctatcctcttccctcggcctcccaaagcgttgggattacaggcatgagccattgctactggccacaccaatggttttcaatcctcatagaattactagtggagcttttaaaaatacagatgcctgggtggttctcccaggcactcggattcgcttgctctagggaaagacccatgcatctgttttttgttttgtttttgtttttgtttttgttttttgagatggagtcctgctctgtcactcaggctggagtgcagtggcacgatctcggctcaactgcaactccacctcccatattcaagcaattctcctgcctcagcctcccaagtagctggaattacaggtgcgtgctgccatgcctggctaatttttgtatttttaatagaggtggggtttcaccatgttggccaggctggtcttgaactcctgatgtcaggtaatccacccgccttggccttccaaagtgctgtgatcacaggctgtgatcacagccaccgcacccggccattctgtttttgattagttgaaaatgctgtgactgacaaagcatgagctgcagccatgcactgcacactggatatacaatttcactttatatttttattacagaaaatttcagacatacacaaaagtggagtgaatagtacagtgaaccccatgtacccatcaccggcctcaatagttatcaatgttctgagctcatcatatttatcacccgcaactatgttgttgttgttgttagcatattttattttatttatttattttattttgagatagggtcttgctctgttgcccaggctggagtgcagtggtgtcatcccagctcactgcagcctccacctccccaggcttccatctcggcctctggagtagctgggactacaggtacaaaccaccacacccagctaattttttttttttttttttttcagatatggggttttgccatgttgctcaggctggtctcaaactcctgggctcaagtgatcctcttgctttggcttcccaaagtgctgagattacagacatgagccactgtgtcccaccccagcatattctaaagccaatctcagacatgctaggaattcacctgtgaatacttcagcataaatacctaattgtaaacatggctaaaaatggaactatgctcatatttctgtcttagatgaacatacacattctgtctgctgcagaattcctcaacctcagcactattggcactttgggctggataattcttcacggtgggaactatcctgggcctcgtagggtgtttaccagtattcctggcctctactcactaaatgtcagtagcttaccctccattgtgacaaccaaaaatgtctccagacattgccaaatgtcccctcgaggtcgagaaccattggtctattggatatcttatgaagtaaaaaactatcatccattatttatagaagggtgttttctctctcccttttctcttctatctgaaaaaaaaggatattgaaatcagctttgcaaataagcagtgatcaattgacaaactcacttcttcagaagaccacagagaaaaatgcaaataagttaatgaatgaaaagcaggtcgaggcatggtggctcatacctgtaatctcacactttgggaggccaaggcaggaggatcacttgagctcaggagttgcagaccagcctgggcaatatggcgaaaccctgtctctatgaaaaatataaagaattagctggatgtggtggcatgcaccagtagtctcagctactcaggaggttcaggtgggagatgcttgagcccaggatttcaaggctgcagtaagctatgattgcctcactgtgctccagcctgggtggcagaatgagaccctttctcaaaaacaaaaaagaaagaaagtaagtgaaggataagagattatggccgggagtggtggctcatgcctataatcgcagcactgttggaggccgagctgggcgaatcatttgaggtcaggagttcgagaccagcctgaccaacatggtgaaactccgtctctactaaatacaaaaattagccaggcatggtggtgggtgcctgtaatctcagctatttgggaggctgagacaggagaatcactgaactcagaaggcagaagttgcagtgagctgagattgcgccactgcactccagcctgggtgagagagtaagactccctttcaaaaaaaaaaaaaaaaaagattacagggagggggtatcttaatacttgccatgtatgagcaaatccaaaatcttataaaacctggaatttaggggttccaaattttacatacttaagcactttcttttttctttctatttccttttttcctaagcacatcttttttattctggcagagcaaaggacttgtgcctccaatttctttatggcaacatctggaaaaattagctgcttctctagaccagggtttcagagatgtcagagtaaatttcctccagaacccaaggggttacagcatttcccatgctgcaggggacagagggtggggtgggagagtggggcttcacctaaatgggacatcaattatccaagaagagtcaagtccgctatttgatcagagtgagcctcctaatcttggaactcagtgttttcagttgccttttaccttccttgaagcacaccctcttccttgcgactgtctgaattgactggctcagtcagatttataactcacttctgaaccggggtaggtttatcaccaggtgcctccaataggtgcctagagttctctgttctgatgacttaaattctgtgtgttgtgaaggcaaagaccagaaaggaagactggggagttctctgcttctgggaaaaagcaccctctagaagcaatttaggacgaggttcaggttgattaatggtatatttgtttcttaaatattagagtctatttacccatgtcaaagcgtcaagaatacctgcggagttccggggagcaagtactggccagtttcccagtgcaagccacgattgacttctacgacgatgagtctactgagtctgcttccgaagctgaagagccagaggaaggacccccacccctccatcttctgccccaggaggtgggaggtcggcaggaaaatggcccagggggaaagggcagagaccagggcatcaaccaagggcagcgatcctcaggagggggtgaccactggggggagggtccgctccctcaaggtgtctcctcaaggggtggcaagtgctcctcatccaaatgaatcagtctctgtctcctgggccctgctctgggacctgcccctcacgttctcttggggacacccgagccaggacactacgcatccctgctgagtgtgcagaggctagaggcttctcgggcagcccctggcctgcacactactcatgacagaaagtcagcttttacttttctttcccctggcaattcgtttttggtgcactcatgcatgcctttgagaaaggattctaggagaaagagaaggtctatgtcaacagagttgttatctcatagagccagttttcaaagctccttctgcattgtcactcactgatcaggtgatgaattcttcctagatagtcgcccactccacctcctacttaacctgagactcattatttagctatttctgcttttgtaaaaataattcagatattaaactccaattttaatctatcatccaagggtagatgtagttgcttagtagcattttggaaaaaaaagaaaaaaaggtttggtttggttttgtgacggagttttgctcttgtctcccaggctggagtgcagtgacacaatctcggctcactgcaacctccacttcttgggttcaagtgattctcctgtctcagcctcccaagtagctgggattacaggcatgagctaccacgcctggctaattttttgtatttttagtagagactcggtttcaccatgttggtcaggctggctttgaactcctgacctcaggtgatccacccgccttggcctcccaaagtgctgggattacaggcgtgagccactgagcccggccaaaaaaaaatgtatttattaaaaaaaaatttttttaacccgccgaataattcccataagagtaacaaaaaggaccagcctgaccaacgtggagaaactctgtctctactaaaaatacaaaattagccaggcgtgatggctcatgcctgtaatcccagctactcgggaggctgaggcaggagaatggctagaacccgggaggcggaggttgccgtgagtcgagatcgcaccattgcattccagcctgggcaacaagagcgaaactccgtctcaaaaaaaaaaaaaaaaaaaaagaaagaaaagagtaacagaaagatagggatttttaggagacaattagataaaaatgtatgtgatgactgtataaggaggcctgtgtgtatgaatttatagggagtagaaccgtctctcttcttagttggtgactgtttggggcctggtattttaatagatgaacactacttttttaattttttatttttttaaccctacccttaacccatgaacactatttttaattaaagtatctgatgtaaaattattttgagtttttaatattttgataaacgtgtattcctgaaactttttgacttacttatcttacatgtggtgtcttcctgtatatagtacattatatcaatttctacttgaaataaatattttgaaagaatgtttgataatcacccttttttgcttaagacatttttagaattaaatagtttctgctttaaggttttttcatttttcatggtttttaaaaataattcttttaaaattataacctattattttatttcagtattctgttttattttttaaaattttagacacagggtcttgctccgtccctggctggagtgcagtggctcaataatagctcactgcagccttgaactcctgggctcaaggaatcctcccacctcagccttcgcagtaggtaggacaacaggcgtgagccaccatgcccagcaatgttttttgagacggagtttcgctcttgtcacccaggctggagtgcaatggcacaatctcggctcactgcaacctctgcctcacaggttcagtcgattctcctaccttggcctcctgagtagctgggattaccggcacgtgccaccaagcctggctaattttgtatttttagtagagatggggttttaccatgttggccaggctggtctcaaactcctgacctcaggtgatccacccacctcggcctcccaaggtgctgggattacaggcatgaaccaccatgcccagccacccagttaattaaaaaaaattttttttttgtagatacaggttctcaatacattgccaaggctgctcttgaactcctggcctcaagctatcgtcttacctaggcctcctaaagcactggaactacaggaatgagccaccatactaggcccaatatattaaaaagtaggagtaatgaatggaaatactttcagcaatccaaacactatagaaagtacacattgcaaagtaaaatcacattctgctcttccccctttcctttgtctaaagataacaaacatcaattgtgttttatggcttcagtcttttgaaaaattccttttttgtgtgtttttcttttctgggcctttttttcttttaaaatgtttacttttttgtgttttgaacaaatttggctactttttcatttaaaaattaaaaattatattttattgtttcttttacttgtttaaagtacatcttttcagacttaaaaacaattaaacctgggtcaatttcagaaaggatttaagatgaccccgaattttgctggcttttcacagaaaaatgctagaagtcttatcctcactccttcatgtgatgcttaagataaaaactaaataatcacatctgactttgttgagttttcttgataaatcagttttattgacaaataaagcctggtccaataatgagtttatcctaaataaaccaaacatagtccaaattctgatggcatcaacctccacagtttaaaatatgctgcgtgtgccaggtgagatggttcacccctgtaatcccagcactttgggagaccgaggcaggtggatcacttgagtccaggaggtcgagacctgcctggacatggtgaaaccccttctctactaaaaatacaaaaaattcaccaggcgtggtgacacgtgcctgtagtctcagccacttgggaggctgaggtgggaggatcacctgagcctggggaggttgaggctgcagtgagccaaaatcacaccactgcactccagcttgggagacagaaagagaccctgctcaaaaaagttgattaatatatgctgtatgatagttttacattacattaattctaaattacttagaatctggccagcttagtgcaaatacaaaacaaggcactttagctatggctagcaatggaatcacatatactgtgggtcagacatttttgatagcaaggatatggtgagcttggggcctccttagctctctgattgttacaattacgtgaattaactaaaagtctcaaacctaagagctccagggttttggtcatgtatccctctcacttaaaaaatgtagctgagcatggtagctcatgcctgtaataacagcactttgggaggctgaggcaggaggatcacttgagcccaggagtttgagaccagcctgggcaacagagggagacctcctcctcaacaaaaaattaaaaagctagccaggtgcagtggtgtgttactatagtcccagcaactcaggagcctgaggtgggagatgctggagcctaggagttcaaggttgcagtgggctatgattgcagcactgcactccagcctgggcaacagagtgagactccacctcaacaaaatacaaaattaaaaatgtgtgcctgccccctaacatatattcacttatgaattatatgttatgttgagccatttgaaattgctgatgctttaccatttttaacctacaaaaaaaggcaatttcatatggttcaaccaacatgtactattgggataatatattgcgcattacaaaatatacacaagacgtatattttaaaggaaagcccaagttgggcatggtggcttacacctgtaatcccagcactttgggaggccaaggctggaggatcacttgtgaccagcctgggcaacatagcaagaccacatctctacaaaaaaaaaaaaaaaaaaagcaaataagcaatttcatcactttttaaaacttgtattttaagttcagaggtacatgtgcaggtttgttacataggtaaatgcatatcatggggtctttttatacagattatttcatcacccaggtattaagcctagtacccatttgttattttttctgatcctctccttccttccacccaccaccctcctatgggccccaaatgtgcgttgttcctctctgtgtgtccatgtgttctcatcatttagctcacacttgtaaatgagaacatgcagtatttggttttctattcctgcattagtttgctaaggataatggtctccagctccatccacactcctgcaaaggatatgatcttgttcctttttatggctgcgaaatattccatggtgtatatgtaccacattttctctgtccagtctaccattgatgggcatttaggttgattccatgtctttgctactgtgaacagtgttgcaatgaacatacacgtgtttgtgtctttttaaaataatttttattttaggtttggggtacatgtgaagttttgttatacaggtaaactcgtgtcacaggggtttgttgtacggattatttcatcgtccaggtattaagcctagtactcaataattattttttctgctcctctccctcctccctccatcctcaagtaggccctagcatctgttgttcccctctttgtgtgcacgagttctcgtcgtttagctcccacttataagtgaggatataccgtgctttcttccctattcctgtgtcagtttgctaaggataacggcctccaaatccatccacgttcctgcaaaagacatgatgttgttctttttttttttgagacagagtctagctctgtcgcccaggctggagtgcagtggcacaatctcagttcactgcaagttccgcctcccaggttcatgccattctgcctcagcctcccgagtagctgggacgacaggcgcctgccaccaggcccggctgattttttttgtatttttagtagagacggggtttcactgtgttagccaggatggtctcgatctcctgacctcgtgatccgcccgcctcagcctcccaaagtgctgggattacaggcgtgagccaccgcgcccagccgatcttgttcttttttatggctgcataatattccacattttctttatgcaatctgccattgatgggcatttagactgattccagtgcgtgtctttatggtagaatgatttatattcctttgggtatatacccagtaatgggattgctgggtcgaatggtagttctgttttgagatctttgaggattctccactctgctttccacaatagttgaactaatttactttcctaccaacagtgtataagcgttcccttttctctgcaacctcactagaatctgtttttgttttgttttgttttgttttgtttgctttttaacaatagccattctgactggtgtgtgatggtatcttatggttttgatttgcatttctctaatgatcagtgatgttgagctttttttcatgttggccacatttatgtcttcttttgagaagtgtctattcaagcccttttcccactttttaatggagttgtttgtttttttctcttgcaaatttgtttaagtaccttatagatgttagatattggacctttgtccaatgtatagtttgcaaaatttctctcccattctctaggttgtcttcttactctgatgatagtttcttttgctgtgcagaagctctttagtttaatagatcccatttgtcaatttttgcttttgttacaattgcttttggcatctctttttcttttctttttttttttttttaagacagagtcttgctctgtaacccaggctggagtggagtggtgtgatctaggctcactgcaatctctgcgtcctgggctcaagtgattctcttgcctcagcctcttgagtagctgggattataggtgcccaccaccacacccagctaatttttgtatttttagtaaagatggggttccaccatgttagccaggctggtctcaaactcctgacctcaagtgatctgcctgccttggcctcccagagtgctgggattacaggcatgagccaccacactgggctttgcttttggcatctttgtcatgaaacctttgcctattcctatgtccagaatgatattgcctaggttgtcttccggggtttttatagttctaggttttacatgtaagtctttaatccatcttgagatgatttttgtatatggtataaggaaggggtccagtttcaatcttctacatatggctagccagttatcccagcaccatttattaaatagggagtcctttccccattgctttttttttttttttttttttttggtcacctttgttaaagatcagatggttataggtgtgtggccttatttctgggctctctattctgttccatccgtctatgtgtctgtttttgtaccagtaccatgttgttttggttactgtaaccctgtagtttggcttgatgtcaggtagggtaatgtccccagctttgttctttttacttaggattgccttcactatttgggctcttttttttgttccatatgaatttttaaaatagttttttctagttctatgaagaatgtcattggaagtttgatagaataacgttgaattggccgggcgcggtggctcacgcctgtaatcccagcactttgagaggccgaggcgggtggatcacaaggtcaggagatcaagtccatcctggctaacacggtgaaaccccgtctccactaaacatacaacaaattagccgggtgtggtggcaggcgcctgaagtcccagctacttgggaggctgaggcaggagaatggtgtgaacccaagaggcaaagcttgcagtcagccgagatcgcgccactgcactccagcctgggcgacagaatgagactctgtctcaaagaaaaaaaaaagggaataacgttgaacctagaaattgctttgggcagtatagccattttaatgatattcttcctatccaggaacatggaatgtttttccatttatttgtgtcatttctgatttctttgagcagggttttgtaattctcattgcagagatctttcacttccctggttagctgtattcctaggtattttattctttttgtggcgattgtgaatgggattgaattccaatttgactcttgctggctgttgttggtgtataggaatgctggtgatttttgcacattggttttgtatcctgagactttgctgaagttgtttatcagctgaaggagctttttggccgagactttagagttttctagatacaggatcatgccatctgcaaagatagcttgacttcctctctttccatttggagatgctctttatttctttatcttgcctgataagcatttaaattattaatagttcttaaatccttttattctcatgaaataaatatatatactaaataatgtatactgtgtacatatatataatatttaagccacctcacagagaagcatggattcaaataaaagaaatatagcatgcacttactaaattatacttttcagtcacatccaccaattttgaagaagtttttactgaaagttgatgaataaatcttctcttgatgtgaatccaagtttatttatttttccttttttactctttttttttcttcttctttttttttttttttttgaagcagggtctcactgttgcccaggctggagtacagtggtgtgacctcggctcactgcaacctctgcttcacaggttcaagtgattctcctgcttcagcctcccaagtagctgggattacaggcacctgccaccacgcccagctaattttttttttttgtatttttaatagagatggggttcgccatgttgcccaggctggtctctacctcctgagttcaggtcaatccgctgacttcagcctcctaaagtgctgggattacgggtgtgagccactgcacccagcctatatagatcatatgtatatatcatagctcattgcaacctcaaattcctgagctcaagcaatccacccacctctgcctcctgagtagctgtgattacaggtattcgccaccatgcccagctaatttttacatttttgcagagatgggggtctctctgtgttaccaggctagtcttcaactcctggcatcacgtgattctccctctgtggcctcccaaagtgttttaaaatgaaccccattgtataaccttcctgaagaagtcagaagattaccactagcctatcattctacagcaaaacacgaatggggagagagagagagaagactgctcttcgaaagaccaattttgggttcctatctcttggattttaaaaatcaggtgatttctctttaaaaatctggatctctggcagtgtttgcatgtgttcctgcaaggaatcaatcagctggagctgaggaacggctgttggcattaaacagcccagccttccccactctccacagtctgcatcttcctccatccccttccatttctttcctgcaacagcttgcctaataacggtgcagtacatggatttcacacgtggtgacatctctatgtgttttctctggaatcattttagcattctaatcaaaatggctgctccaacaatggttatacttagctaggttttctataaaatatccattttttaaaaggtaatttatggttgaggctgactcgtttgacacatctttctttcagtggctcacaaaaagtagctcctaatgaatttcattattgaaacagaattttgcaaataccacaagctggaacatgctagaaatatctgcactttcacccagctgtactcaaacctcctacgctgcgtgatttgatgtaataatggtttattcaaatctccagccacatcttctttgagtcttccaatagattttcttacaaaagaatgcatttcaatttcttgccatagtgtttcctatttgctattttaaccagttttactgtggtaggaagacagtgttttctaatattttttaaacttctataataaacatggaattgcaaaacatgctgtttaacacaccgttaaacatttgtcattaagttgagtgaaattttgtgtgatctggtgttgaggatcacatgatttttaaacacaattgacagtatctacagtaaaatgtatgctttgcttgaggtccaatgataaaagatgttaacaattcaattatttttcttgataatgttaattatttttgctaactttttgccaactttttgccagatctcttttagcttgttatgtggctgatgatgagcttgcaataaagacagaaatattagccttgacatttgtttgtggtttgcttgagcttgcattatctatattattttcaatccagtttcttgggaagaattttgtttgttttgttttgttttagagagacagggtctcaatgtgttgtccaggctggagtccagtggtgcgatcacgggtcactgcaggcttgaactcctggcctcaagcaatcctcccacctcagctttctgagtagctggtactacaggtatgtgccaccatgccttattattttgtgtgtgtgtatgtgtgtgtgtgtgtgtgtgtgtgtagataggacctcactatgttgtgcaagctggtctcaaactcctggcctcaagtgatcctcttgccttggcctcccaaagtgttgggattacaggcatgagccaccacattcacccagaaaaattttaaattttaaattgtgatgtaattcacatacgataaaattcaccttttttttgagaccgagtttcactcttgttgcccaggctagagtgcaatggcgtgacctcggctcacagcaacctctgcctcccaggttcaagcgattctcctgcctcagcctcccaagtagttgggattacaggagtgcgccaccatgtctggctaattttgtatttttagtagagatggggcctctccatgttggtgaggcaagtctcaaactccccgcctcaggtgatccacccatcttggcctcccaaagtgctgggattacaggcatgagccaccgcacccggccaaaattcacccttttaaagtgtacagttcaggctgggcacagtggctcatgcctgtactcccagcacttcagaagccagaggcgggaggatctcttgagacctggagcttgagaccagcctgggtaacatggtgaaaccctgtcactacaagaaatacaaaaattagctgggtgtggtggtgtgagcctgtagtcccagctactcgggtggctgaggtgggaggattgcttgagcctgggaggttgaggttgcagtgggctatgatcacaccactgcactccatcctgggtgacagagtgagactgagaccatctccaaaaaaaaaacaaaaaaactgtacagttcagcatcttttttgtgtattcacagaagtgtacgagcatcaccactaatctcagatcattttcatcatcccagaaagaaatctcatatccattagtagacactcccatatcctccaggccctggcagccactcaactttctgtctctctggatctccctctcctggacatttcataaaagtggaatcataaaatatgtttttttttaatttggcttctaaattatcttttaaaacttaaaaaaaaatttagattaaaaaaaagcccagaagtctcaatactgcaccctgtccccaccaaaccatggtccctttccacactcgcctgggctgtgcacgtcgactgtggtgagggcacagcattgatgctgtcaccagcacagccttgatttcgttacaatccaattacctcggctcagagaacaatttattctgaataaagaaataagcaaatccttgttttgcaaatttctgctgttggcctagagagtgacagtgcccccaaagatgggccagcaggggctcaaagcatcccactcattatgctctgcaggaacgctccactgcatggggcacatgcgttttcagtagcactgtcttcatgcagagagaatagaacgtttgttatcaaagaagactgcaaaaaagtaaaatctgtaccaccaacaagccaattcactcacgaactgttctttttaggacttaggagtaaattctggtgggcaccacacagaggagttttagactatttcaggtagatgttaaagtaaggcatgaaaagtaaggtataaaatgctccctgaaattatatgttaaagtaaggtataaaactgctccctgaaattatatataagattattctttctctttatattccagaggtgtatttgaagagcacattttttagagggaaagtcatagcaattttgttacaaatattaacatcaaggaaataaaaccatccttctttctaggctagtttttccatgtaaacttttaattttttttatattttgtatttattttattttattttatttatttttcgagacagcgtctcagcattagtccgttctcgtgctgctataaagacatacccgagactgggtaatttataaaggttagaggtttaattgactcacagttcagcatggctggggaggcctcaggaaacttacaattatggtggaaggggaagcaaacacatccttcttcacatggcagcagcaaggagaattgccgagcaaatggggaaaaacccattataaaaccatcagatagctgggcatggtggctcacacctgtaatcccagcactttgggaggctgaggcgggcagatcacctgaggtccggagtttgagaccagcctgaccaacatggagaaaccctgtctctactaaagatacaaaattagccaggcgtggtggtgcatgcctgtaatcccagctacttgggaggctgaggcaggagaatcacttgaacttgggaggcggaggttgtggtgagccaagatcgtgccattgcgctccagcctgggcagcaagagcaaaactctgtctcaaaacaaaacaaaacaaaacaaaaaccgtcagatctcgtgagaacacactatcacgagaacagcatgagggtacccaccctcatgattcaattacctcccaccaggtccctcccatgacaagtggggattatgggaactacaattcaagatgagatttgggtggggacacagccaaatcatatcagacagggtcacaccctgtcacctcagctagagtgcagtggtgcagtcacagctcactgtggccttgacctccctggctcaagctattgccttcctcagcctcccaaagtgctgggattacaggcataagccactgggcctggcccaatgtaaactttctattacagaataatacacctatagaaactacataaatcgtatacttgatataatttgcaaagttaatatgctcatgtaagcagtacccagatcaaaaacagagcacaactggtcgcctaggataaccccttgcactctcttccagtctccatgcctctaaaaccgtagatacgatttgtctggttttgaacttggtatcaaagggaccaaatggtatgtgctcttctgtgtctggcttccatccttaacattgtgcttgggagaatcagccaaactgtgatgtgaagctgtaggcagctcgttctcattgctgagtagaactctgttgtgtcaatgtattcactgtcctattgacaattggttagtttccggtttgtggttatcagaaataacactgccttgaccattcctgtcgatggctgttggtggacatatggacccatactgaatgcatttctttttcttttcttttctttttctttatttctttctctttctttctttctttctttctctttctttcttttcttcctttcctttctttctttttctttctttttttttctttctttctttctctttctttcttttcccttccttccttccttccttccttcctttccttctttctttttttttgttgagacagggtctcactgtgtcacccaggctggagtgcagtggtgccaccacaactcattgcagcctccacctcccgggctcaagcgatcatcctgcctcagcctcccaaatagccgggactaaaggcatgtgccaccacatctggctgatttttgtattttttgtagagatgggttttcaccatgttgcccaggctggtcttgaattcctgagctcaagtgatccacctgcctcagcctccccaaagtactgggattacaggcatgagccacggcgcccggccatttggtgtatttctaggagaagtagcaagaagatagtttttatgtcttcccctcatatgtttggtgtccttcagcctgaaaatagtttaaaaactgaagagtggagggcatggaccacgaagttttagaggaaaagaacaaagttaccaaacaggctgttcttttctttgcgatctttactaatgaaccagagcttaggggtgctgttgtgtccagaaagtgaccagagtcagtgggctctttcttcttcctaaattgggattttgtaacaagatatagaagcttacttcatttgggaatcggatgtgacttggaaatgtgaaaggggacctgggaattcaatccacccccgtttttttaagatggagtcttgtgctgtcacccaggctggagtgcagtggcatgatcttggctcactgcaacctccctctcctgggttcaagcaattctcctgcctcagcctcccgaatagctgggattacaggcatgcaccaccacgcctggctaatttttgtatttttattttttcttagacaccgtctcactctgttgcccaggccaaggtgcagtggtgagatctctgctcagtgcaacctccacccttcctgggctaaagcaattctcctgcctcagcctcccaagtagctgggactacaggcatgcaccatcatgcctggctgatttttgtatttttagtagagacggggtttcaccatgttagccaagctagtctcaaactcctgacctgaggtgatccatccacctcggcctcccaaagtgctgggattataggcatgagccaccatgcctggcttaggaattcaatctcttaagaagatcctggagaagtctaataattctcttctgaaggatctatgaacttaccaaggcttcaactcatctcatctctttacatacagagaaaatttaattacagaaagcgtcagattggagaacagaacccacatcctacaaatgctccttctcagcagggagcatggccccccctccctgacctcccttcctctggggtagcatccttcaccaggttttacttacactgaccacgggccacctgtcgctactctttatctgcttctatcgtacatccctaccatgccaattatagattttactaagattgttttctattattttggaccctgaacaatcgactgaactgaaagaggttttatgtttgtttccttgagcagtttatttaatttttagagacagggtcttgctccatcgcccaggctggagttcagtggagcaatcagctcactgtagtctcgaactcctagactcaagtgattctcccgtctcagcttcctgagtatctgggactacaggtgcaaccatcatgccctgctcatcgttttattttttgtagggacagagtcttgctatgttacccaggctggtctcaaaactccttgactcaagtgatgctcttgcctcgatctcccacagccctgggattacaggcgtgagccaccgtgcctggcatgagcagtttatttttgtcacctgtttattctgtgatagaagggtaatatatcaaagaagagaaaaactgtcctatacagaaaccaccagaggaagaatttgctactgtcctgcagagcatgaatcatgtctgcgtgactcatttttgcagaactgctggtgaaaggccaatgcataaataggtactttgtgatgatgatcatgaaaatgatggataataaaaagatacaaacagttctgactgccttagaaggcagttgctggacaaataaaaaatacagtactattttaatattctattgcatcattacttggtaatcattacaaacagatttgattttatagtttcaaatatttcaaaaagatgttcaatgccattacagaaatgcaaattaaaacacagtaagatacttctacatcactgttagaatggatacaattttatttatttatttattaaaatattattattgtaaattgacaaactatagttgtacatatttatggggtacaaagtgatgttatgatttacaaatacaacttgggataattaaatcaagtgaattaactattcatcacctcaaacttcttttgtggagagaacatttgaaattttactctcttagcaattttgaaatgtacaatacactattattaactaaacttactatgctgtgtaatagattgcaaaaaaccccttatttctcctgcctaacagaggctttgtagtagcctctgaccatcatttacccattccctccagcccccagcctctggtaatcaccatcctactctatgcttctatgaggctattgttttagattccacattatattagtcagggttctctagagggacagagctaataggagatatatatatagaatatatacatagaatatatatatagaatatatacatagaatacatatatagaatatatacatagaatacatacatagaatatatatagaatatatatagaatatatacatagaatatatatagaatatacatagaatatatacatagaatatatacatagaatatatatatagaatatacatagaatatatatagtgtatatatagtgtatatatatagtatatatatagtgtatatatagtgtatatatatagtatatatatagtgtgtgtgtgtgtatgtgtgtgtgtgtgtgtatatatatatatatatatatatatatatatatatatatatatatcagggagattattaaatattaactcacataatcacaaggtcccgcagtaggccttctgcaggcttaggaagaagaagagccagttggagttccaaaactgaagaacttggagtccaatgtttgagggcaggaagcatccagcatgagagaaagatgtaggctggaaggctgggccagtctagtcttttcatatttttctgcgtgctttatattctagccacactggcagccaattagatggtggccacccagattaagggtgggtctgcctttcccagcccactgactcaaatgttaatctcctttggcaacaccctcacagacacacccaggatcagtactttgcatccttcaatccaatcaagttgacactcagtatcaaccatcacacatacataagtaagatcacgtggtatttgtttttctgtgtgtggcttattacacttaacgtcatgtcttctgatttctttttttttgagacttgttccccaggctagagtgcaatggcatgatctcggctcactgcaacctccacctcccggaagtgattatcctacctcagcctcctaagtagctgggattacaggcacccaccaccatggctaatttttttgtatctttagtagagacagggtttcaccatgttggccaggctggtctcaaactcctgacctcaggtgatccacccgcctctgcctcccaaagtgctgggattacaggcatgagccactgcgtcctgcccatgtcttccaatttcatccatgttgttgttaatgagagaatttctttccttttttaagactaaaattccattgtggatatatgttacattttctttatttgttcatctattgatggacatttagattggttccataatttggctagtgtaaatagtgctgcagtgaaaatgggagcacagacatctctttgacatactgatttcaaatcttttgggtaaatacccagaaatgagaatgctggatcacaattttattttgttttattttatttattttattttttttgagacggagtcttgctgtcactcaggctggagtgcagtggtgtgatctcggctcactgcaacctccgcctcccagattcaagcaattctcctgcctcagcctcctgagtagctgggaatacaggaatgcaccaccacacccagctaattttttttttttttttttttttttagtagagacagggtttcgccatgttaatcaggctggtctcaaactcctgacctcaagtgatctgcctgcctcggcctccaaaagtggtaggattacaggcataagccatcatgcccaacctggatcacaattttaaataagaagtgttggcagggatgtggagaaactagaatcctcatattatattattggtggaaatgtataaacagtacaaccattttggaaaacaatctggcagtttcagtagaaagctaaaactgcctgggcactgtggctcacgcctgtaatcctagcactttgggaggctgaagcaggaggtttgcttgagcccaggagttcagaccaacctgggcaacatgtggagaccccatctctacaaattttttttctttttttttgagacgaagtcttgctctgtcaccaggctggagtgccatggcatgatctcggcttactgcaacctccgcctcctgggttcaagcgattcttctgcctcagcctcccgagtagttgggattacaggtgcgcgccaccacgcccagctaatttttgtatttttagtagagatggggtttcaccatgttggccaggatggtctcgatctcttgaccttgtgattccacccgcctcagcctcccaaagtgctgggattaccagcgtgcgccaccgcacctggccaaaaaaaatttttttttaattagccaggcatggtggtgagtcctgtagtcctaggtaggaggatcacttgagcccgggaggtcaagactggagtaagccatgatagcaacactgcactccagcctgagtgataaagcatggccctgtctgaaagaaaataaaaaagctaaacataaattcaccatagaacctagctattccactcctaggaatctacccaagacaaataaaaacattagtccacacaaagacatgtacgtgaatgtttatagtagcgctattcataacaatctcacactggaaatcatccaaatatacattaactggtggctggataaataaaatgtggtatgtccatacaatgggatgttattcagtaattagaagagatgaagtattgatacatgtggaaacacgagtggaccttggaagcagcgtgctaagtggaagaaaccagacataacagactgcattgtatgagtccattttctttttcaatttttatttatttattttttgagacggaatctcactctgtcactcagggtggagtgcagtggcatgcatgatctcagctcactgcaacttccacctcccgggttcaagcaattctcgtgcctcggcttcccgagtagctgggattacaggaacccaccaccatgcctggctaatttttgtatttttagtagagatggggtttcaccatgttggccaggctggtctcgaactcctgacttcgtgattcacccggctcagcctctcaaagtgctgggattacaggcgtgagccactgcgcccgtccgtatgagtccatttatataaaaggtccacagaaaggcgaatttctagtgacagaaaacaaaacagtggttgcttagtgctgggagtgggagcaaggattaactgtaaatcagcacaagaaaactttttggggtgatagaattattctaaaactggattatggtgttagttgcataattctagaaatgcacgaaaatctttgaaatgtacagtgccaatgggtaaatatatagtaaataaattacatcccaataagttgttttttttttaaagcgtagactcttattattaagacaatatttgtatcttttatttagctacagagtcgctacaggaataatacattttttgggggtggagggcatgacaaagtttaaatttttaagaagtaacccaaaggaaaacattctaaagaaatatttcagtttcttccctgagacctctgagtttttttactctcctgggtttattcattaaggccctgtcttctgaagatgtgcagtgacctctgagtcatcaatcacttaaaggtaaagaggtcccaggtgtacttttagaataatgggttcaattccaaagtaagacatgaagggaggaccaattgcctagatccaggtcatcagtaggctagaccttcctgtcctgcgttcaaagtgagtatctggaattacttgaaactccaagattaggttgttaaacaacatggtaagaccactacccaaatttaagttaggtgtaagacttagggcttcagatgtcaacaataccaaaccataatagtcaccattgtcataaagtgggtgctctccagatatatcaacagtacacctggaaagtccatcgttttccagaattttctacaataatatactggtccctagcaacagttaccatatagatgattaaaagacactaaaatttttattttaaaatgcagtttttatcaatatacaacagatacagaaaagcaagcatatcttaagtgctcaatgaattttcaaaggtaacatcccttctataacaccaacaaggttgagaaatagaagatcaccatcaccctggaagcccctcaaagcccctcccagctaccacactcactctcttcctcaaagataaccactattctgactcttaacaccatacatttgtttgcccagttctgaactttatataaatggaatcaaccacactgtatgcactcgtttttgtctggtttattttacactgtacataagtcaaccatagtctcttgtaggaatatgtcaactatttatttattcattctattattgatgtacatttgtattgcttccagggattttggctgttatgaataatgctgctatgaacacttttgggtttgttttttgtgcattatctgtggacatttctgttgagaatatatctaggagtggatgttggctgctagggtatgtgtatggttagctttagtatacatcattttatttggccaaaatctagaaagccacttgaagtgatgtaagtgtaaacatacctaaatggagaaatttcctaaatgtaaacacacgttcattcttcatcagaactgatggagcaaacactgtcacaggcaggacaactgagtatcagtcacgaagttagtggagtgtgatgtctcaccaacatcacttcggaagccatcgcctccgtggggttcgggccttgggaaatgagccccacatgaacttcctggcactcctgccagctcctttcagtggagtctggatgaacaaggctcatagccctgccttggctttgatacaaaggaaaatattaggtgtgttcaatttccctctaaggtctggaaatcaatttaccttttttctttcttttccttttctttttcttttttttttttttaagacaaggtctgtcacccaggctggagtgcagtggtgcgttcttggctcactgcagcctcaacctcctgggctcaagtggtcctcccacctcagcctcctgagtagctgggactagaggcacgtgccaccacacctggctgatttttttttttttttaatagatgcagggtttcactatgttgtccaggctggtctcaaactcctgggctcaagcgatccacctgcctcggcctcccaaagtgctgagatttacaacttattttctttaaaaaacaaaaaagccaggggtaattattagcacacaattgcaggctgagtctctcagttcctggaggacacttgtctgctgctttctggagcttggtggtcctttacctctgggcagggctaaaagctcttgcctgtgactggttcttcctggtggctgtgggctcataatctaccccatgtcagagtccatctctgacaggatttgaagccagggcagctggattcagctcacaatgcttctagtaggatattttcatggcccaggctaatcttaataatccagtgtttgtccccagtgaaaccttccagggagtttctacatcagtttcacttcatggtctctgaattgggtgtccacttgggtttggggaagactttctatgaaaacaaggatccctttggcttgctgcctatccgtggaagttgaagcgttagtcagaattccgacctcagacgcttttacaccctaatgggccaggctgcagagagggctctatcttcttttcttttaacttttctttaaagttggattccttctgtagctgcttgttctcttccatgtctctagggtatttgttagtatacacaagaaacagcttcttgaataatgtccattatagcttcgcatttaaatgacaatgacttcctccctctccctctccctctccctctccctctcccttcccttccccctttcccccttccctctcccttccctctcccttccctctcccttccctctcccttccctctcccttccctctcccttccctttcccttccctctcctttcctctcctttcctctcttttcctctcctttcctttcctttcctgtctcacagggcttgctctgttgcccaggctggagtacactggtgtgatcatagctcacggcagcctagaactcctaggttcaagcaatccttgaggctcaagctcagcctcccatgtaactggaactacgggcacgcaccaccacgcccagctatttaaaaaaaaaaatttttttttatagacaggatgtcttgctatgttgcccaggctagtattgaactcctggcctcaaacaatcttcctgcctctgcctcctaaagttctgggattacaagcatgagccactgcacctggcctgttttatttattttctaccatactctaaggctgcaagtagagcagctgcaatgcctgcttttagcattggagaacttaccatatgctccttactttctgtttttgcttgctttaaaagttgccacaacttttgtcattgttatttgttagtagtagagaagaacttatattctccaagctcagatggggttcctgaatttggccctactttttatgtttttataaaccattgacatgtactaaaactacttgggacatgacttgcaaaaaacttgtcattggtcaaatggcaaatattcactacaaacgtatagaacaacaaatcacctacttgcttaggtttaaaatggaaagaaattattttggattctatattttgggataacttaacattttaaaagtattatttattgcaggctgggcgcagtgtctcatgcctgtaaccctaccactttgggaggccgaggcaggcaaatcacttgagttcaggagttcaagaccagcctgggtaaaaccccatctttacaaaaaatacaaaaattagctaggtgtggtggtgtgtgcctgtagtctcagcaacttgggaggctgagggaggatcatttgagcctaggagacgaaggctacagtgagctgagattgtgccactgcactccagcctgggcgatagaacgagaccctgtctcaaaaaaagagtattgtgtattgattgcataagatgcaatacaatgaatacatatcactcagcattaggaggctaattaggcaatatgagggggcatggctttatcaagagaccaaccaggtcaattttctcagattttaggtcagtttcaggatacgtttgggatgatccttatatgggtgacttaggtagctttttgattgttgttaccagttttcattcattcgttttttttttaaatagctgtattgagatagaattcacatactttataattcacccatttaaagtatacaattaaatggtttttagtatattcactgatacgtgcaatcaccaccacagtcaattttaaaacatgtcatcacttcaaaagagaaacctcatgtctgctagccctcagtcctctattcccccaccctaccctaagcaatcacaagtctacttatctaggctgggcgcggtggctcatgcctgtaatcccagcactttgggaggccgaggtgggcagatcacctgaggtcaggagtttgagaccagcctggccaacaggattagtgaaaccctgcctctactaaaaatacaaaaactagctgagcgtggtggtggacacctataatcccagctactcagcatccaggtccccagggctctgtgggtggcatccgggagaggtggccttgccagaggatgctcagggagaagcagggaccccacagctgtgtattagcctgagggacgtccccagaggtggaacaagagcatgtctccaggtaaatgagcattccccaagtaagtgttagtgtcactgttctgtcctcactgccacccaccatcccccccaatcagtgggctggaaaggacaggtctggaaccagagagggggtttgtggttacagcctctccccacagcaggcctgggtgagggcctcctggcctggggaggcctgtccctcctgccacagcccttgcaaagttggcccctttcacctgacaactctggaggcaggcctgagcaggtggagcggcagctgaggtggggcaggtgtcagttgctgcaggcggctctggggaacagtattgggcattccttcttccacagagctgagtgtggttgattccacctaggatggccaggcagcctcatcacaccagaaggggtggttggatatttagtgttgagctgcccagggacatgagagtgggggtggccacacattcaaaagctgaggtgccctggggaaaaacaaacaaacaactcactaatccacttaaaatcctgagctaggccaggtgcagtggctcatggctataatcccagcactttgggaggccaaggcgggtggatcacttgaggtcaggagtttgagaccagcctggccaacatggagaaaccctgtctctattaaaaatacaaaaattagccaggtgtggcgcatgcctgtaataccagctactcgggaggctgaggcaggagaatcacttgaactcgggaggtgaaagttgcagtgagccgagattgcaccaccactgcactctagcctgggcaacagagtgagactctgtctcaaaaacatcaaactaaaacaaaaccctgagctgaaaccaacacagacttacatttcaaacagtacggacatggcacggggccagcttcaccaggccatatgcacagtgtgtttgcctgggccggcttggccctgaggttttcaggttggtgactatcttgagaactggctgagtacatcctaagacttgcctggaaagacctggctggggacacagaccgcctgagagtcggccccagggccctcctccccgagggatgacccggcccatttgcttttctgagtcaatttccctgtgaccgtcccttttccctctgctctgggggtgcagcagccgtccttctctcttcacagctgccatcagcctctggtatcttggggaccgctctgctccgcacccagagctgtctgaggaagagctttgtggcccttgcccccactgccttctgtcctggacccagatacatcaggcagaaccctgtgcaatgctgatatgtgaccagtttgacctataaaaatgactttcccataggtcaatttggatacagtcttttttcttttctttcttatatttatttatttatttatttatttatttttatgagacagtgtcttgctctgccgcccaggctggcgtgcagtggtgtgatcctggctcattgcaatttctgcctcccaggttcaagcaattctcctgcctcagccccccaagtagctgagactacaggcgcataccaccacacctgactaatttttgtattttttgtagagacagggttttgccatgttgcccaggctggtctcgaactcctgggctcaagtgatccacctgcctcagcctcccaaagtgccgggattataggagtgagccgccgctcctggcctgtatatagtcctttttatttgaaatatcttcctactaattgtgataggaaaataaacagaaagaaacaaaaataaaaatagtgggcatatagactctctagagatggtaaagcatagttttttctgtctgggcctgcctttcctggggccttttattaatagagaactttgtggctgggcacggtggctcacgcctgtaatcccagcactttgggaggcggaggcgggcagatcacctgaggtcaggagttcgagaccagcctggccaacatggtgaaaccccatctctactaaaaatacaaaaattagctgggcatggtggcgcacacctgtaatctcagttacttcacaggttgaggcaggaaaatcacttgaacccgagaaacagaggtttcagtgagccgagactgcaccactgcactccagcctgggcgacacagcaaggctccgtctcaaaaaaaaaaaaaaaaaaaaaattagggaactttggggatgtctcccaaggctaccacgccttccaacttggctggaccagatggcttcccagggacagcaggcgggccaggcccaggctcgtagaatccccatcttggggctcagtctctggttcccctcttctggtctctcctggctgtgctttcattctgcagctctctcttggccctgccctgcctctctctgccttccccatgaatgcccccaaggagtcccacggctcaggcttcctgtctgaccttgcggtcacttcctccctgtgtcctggaggctcctgggtccagccaccacccctggcccactgctctctgtcctgagtgttttgcccacaacatttttctggccaggctgataagtccagaaaagttcagtttccttacctgcgctgtggctttctcttgaagtcaggtgtcttacacggcaggggccaaccttggaagcctggctgacttgacttgctgcctcctgtctttctcctgttcctgagcccccgcagaggccgtctctattttaggcattagtccctgctggccttgctctgatacccagtccaggttgcacattgcttagggccctgcactagcaaggacagaggacagctggccacccccccccccgaaacctgcctcctcagggtcactttccatctctcctcaggtgcctgccccctacccagggacccccatcaatgggccctgtcggaatttccatccagggccctcacagggaatctggttagagatcagaggggctgccaggcagaacaggggcacagcccatgctgagctgtcctgagataaggggtggcttctgcctgggcagcggccactgccctgggcctctcctgactgccacgagcctggacagcaggagttgtccttgcacccctgtgggtccccagaatgcttgcagtcttcacagcctgtaccctgccactgggccaacagtgaccaacctggccaaacatcccgtggacccctctttccatatgccctcctttgtcactggctgcttgttcattgaaccacttgagtcattcactaagaatgcattgaatacctactatgtgccaggtaccattctaggccttagggacatagtggtgaatagggcaggtgaccctccccccaccccccagagctcaaagtctagtgggaacacaagtaatgaaaccaatgatcctctaagtgggatctgcgtactggggcctagccatggcctgtgttaccagcctgcgatgaggtggccaggagttgagagaaatgttgagaaacttctataggaatttgacagggaaagtttttgtttattgagtctagtttaaaaaaaaaatcaggtttctattgtttgtctttttttaattttatttttctagcaattctttttttttgttgtttgtttttgagatggagtctcactctgtcgcccagactggagtgcagtggggtgatctcggcttcctctgctgctacgaggtgaagccaagacaggccaacaagcaggggcacggtcctatcagcagcagcagctgggggtaagtgtctgagggattctcggaggaagtgttcacgtgcagtaaaagatgcccaggtttggggtgagcccagagcagacatgtgtggtttgcacatccttcctttttctggttgcaaagcaaaaggcagatgcatcctgactccactggggtactcaattgtcccattcagaaggacatcatgataaagcaacatctcaccaacagtccaagcccctgctcatttcagctgcacgtatactacaactggaatgatacagagaggattagcatggctcctgtgaaaggatgacacacaaattcatgaagcgctccacattaaaaaaaaaaaagtccaatcctgagacaggtttttaagagcagctttcttgcaaaggtttagcatgcaaacgacttttaaagaaactttttatgccttggacacttactgactgagataagatgctgccaagatggaattctctttatggaaggatttcctcaaagatactatgttgtgcaaccggaaaagaaaagctaaagcacggaaaagggaatttgaactcataatttttctgagaaataagagtagggtctgattcatagatacgttggtttatctggccttctatcagttgatgtttgcgggctacaaaaaagtggcaatgggtgcccttgccaatgatacggatgctccagaagtttctaaagtatcttgtaaatctccaaaaggaaaagcacattattttacgtaatttaagaattgtgcttcctatattcttttttaaaaaaaatatgcagtctgggaaacatagcaagacgcatctctacacacacaaacacacacaaaaattagctgggtgttgtgccacatgcctgtaagtcccagctactcaggaggctgatgcaggaggatcagttgagcccaggggttcaaggctgcaatgagttatgatcatgccactgaactctctagcctgggtgaaagagtgagaccctatctcaaaacagacaaacaaaaaatgtggtaagctgcaattgagacctatttacaaattggtgtatgtctacaatctgagtaatatatttcttctctttgcattttgctaccctgacatagaagagtttgccaggctactttcattgttgctgaaggtctttacatattacagaaagttgctgcaaatcatttacaaaagatgatttaggcaggtttaaattaggcaactcgagtagggatcattatggcggatgggaggcaggactagattgtagctccaactcgaatggacagagcaatgggcggaggctcgcatagtgaattttagctccaaattgactgcaagaacaaatcggcaatcttgagagaacccacagactctctgtctcctgcaggacccaggagacaccccaaatactgtgagcgccccaactgcagaagtgggaaagggagatccttttcccctgaacacacacccccactggagaaactaaaggtctgtttgcgggagaagtttctgaccttacctggagctgagtcaagttagagagccaagcgaaatacaggggtagaggaagcactgggaaaggccttgggaactcgctgggtccccaagcaggccattgctgcctggcaccgcagggacccattgggagagcagctagagtggggggatatgctacagggagaaggaaatctccagctgaactggggcgagaagcctccccgtcagaactcaggggagggcatgaatccagggtgcagattccacaggcaggggaagaaccatgcccttttctttcgcagctgggaggcaggtagcccggggcaagttctcaagcctgtgtcgcccactgcttggaaacagactctgttagtggtgcatggtgggagtgagactggcccttttttattgcatgggagctgggtgaggcctgtaactgccagctttcccccacttccctgacaacctgcatgactcagcagcagccacaatcctcctaggtacacaactccactgacctgggaaactcacctccatcccccaaagcagctgcagcaagacccgcccaaggagagtctgagctcagacacacctaaccctgcccccacctgatggcccttccctacccaccctggtagtgaagacaaagggcatatgctcttgggaattctagggccccatccacggctggttcctctccacagtaccatagctgatgctctctggaaagtgctacctccccggcaggaggccaaccagcacaaaaatagagcattaaaccaccaaagctaagaaccctcacggagtccattgcataccccctgccacctccactggaacaggtgctggtatccatgactgagagacccatagatggttcacatccaggactctgtgcagacaacccccagtgccagcctggagccgggtagacttgctgggtggctagacccagaagacagacaacaatcactgcagttcggctcacaggaagccacatccataggaaaagggggagagtactacaacaaaagaacaccccgtgaaacaaaagaatctgaacaacggccttcagccctagaccttccctctgacagagcctacccaaatgagaaggaaccagaaaaccaactctggtaatatgacagaacagggctctttaaaccccccacaaaaatcacactagttaccagcaatggatccaaaccaagaagaaatctctgatttacctgaaaaagaattcaggaggttagttattaagctaatcagggagcaccagagaaaggcgaagcccagtgcaaggaaatccaaaaatcaatacaagaagtgaagggagaaatattcaaggaaatagatagcttaaagaaaagacaattaaaacttcaggaaatattggacacacttatagaaatgcaaaaagctctgggaagtctcagcaatagaattgaacaagtagaagaaagaaattcagagcttgaagacaaggtcttcgacttaacccaatccaacgaagacaaagaaaaaagaatatgaaaatatgaacaaagtctccatgaagtctgggattgtgttaaacaaccaaacctaagaataattggtgttcttgaggaagaagagaaatctaaaagttgggaaaacatatttgggggaataatcaaggaaaacttccccagccttgctagagacctagacatccaaatacaagaagcacaaagaacacctgcagagttcattgtaaaaagatcattccctaagcacacagtcatcaggttatccaaagttaagaagaagggaagaatcttaagagctgtgagacagaagtaccaggtaacctataaaggaaaacctatcagattaacagcagatttctcagtagaaaccctacaagatagaagggattggggccctatcttcagccgcctcaaacaaaacaattatcagccaagaattttgtatctagagaaactaagcatcacatgtgactgaaagatacagtctttttcagacaaacaaatactgggagaatttgccactaccaagccaccactacaagaactgctaaaaggagttctaaatcttgaaacaaatcctgcaaacacatcaaaacagaacctctttaaagcataaatcacacaggacctataaaacaaaaatacaagttaaaaagcagaaacaaaaaacaaaaaacaaacccaaagtacacaggcaacaaatagcatgatgaatgcaatggtacctcatatctcaatactaacattgaatgtaaatggcctaaatgctccactttaaagctacaggactggagaatggataaaaactcaccaaccatctgctgccttcaggagactcacctaacgcataaggactcacataaacttaaaggggtggaaaaaggcattgcatgcaaatggacaccaaaagtgagaaggagtagctattcttatttcagacaaaacaaactttaaagcaacagcagttaaaagagacaaagagggacattatataatggtaaaaggccttgtccaacaggaaaatatcacaatgttaaacatatacgcacgtaacactagagcccccaaatttataaacaattaagaacagacctaagaaatgagatagacatcaacacaataagagtgggggacttcagtactccactgacagcaccagacaggtcataagacagaaagtcaacaaagaaacagatgaatttaaattataccttggaacaaatgggcttaacagatatatacagaacatttcatccaaaaaccacagaatgcacattctattcaacagcgcatggaactttttccaagatagaccatatgataggccataaaatgagcctcatataatttaagaaaatttgaaattatatcaagcactctctcagaccacagtggaataaaactggaaataaactccaaaaggaaccttcaaaaccatgcaactacatggcaattaaataacccactcccgaatgagcattgggtcaaaaacaaaatcaatatggaaattaaaaagttcttagaaccaaacaacaataatgacacaacctatcaaaacctctgggatacagcaaaggcagtgctaagaggaaagttcatagccctaaacacctacatcaaaaagactgaaagagctcaaactgacaatccaaggtcacgcctcaaggactagagagataagaacaaccaaactcaaacctagcaaaagaaaggaaataaccaagatcagagcagaactaaatgaaattgaaacaaacaaacaaacaaacacatacaaaagataaatgaaacaaaaagctcgttctttgaaaaggtaaataaaattgatgaccattagcaagattaaccaaggaaagagaaaaaatccaaataacttcattaagaaatgaaacaggagatattacaactgacaccatggaaatacaaaagatcattcaaggctactatgaacacctttatgcacataaactagaaaacctagaagagatggataaattcctggaaaaacacaaccctccaagcttcaatcaggaagaattagataccctgaacagaccaataacaagcagcaagattgaaatggtaataaaaaaatctaccaacaaaaaaaggtccaggatcagacggattcacaggataattttaccagacagtcaaagaattggtaccaatccttttgacactattccacaagatagagaaagaaggaaccctccctaattcattctacgaagccagcatcaccctaataccgaagccaggaaaggacataaccaaaaaagaaaactacacaccaatatccctcatgaacatagatgctaaaatccttaataaaatactagctaaccgaatccaacagcatatcaaaaagataatccaccatgatcaagtgggtttcataccagggatgcagggatggtctaacatccgcaagtcaatacatgtgatgcactacataaacagaattaaaaacaaaaatcacagccaggtgcagtggctcatgcctgtaatcccagcaccttgggtggctgaggtaggtggatcacctgaggtcaggagttcaagaccagcctgatcaacatggtaaactctgtctttactaaaaaatatttaaaaattagccaggtgttgtgccgggcgcctgtagtcccagctacatgggaggctgaggcaggagaatcgcttgaacccaggaggtggaggttgcagtgagccgagatcatgcaattgcactctggcctgggcgacaagagtgaaacttcgtctcaaaaagaaaaaaaaaatcacatgatcatctcgatagatgcagaaaaagcattagacaaaatccagcaccccttaatgattaaaactctcagcaaaatcagcatacaaagtacatacctcagtgtaataaaggccatctatgacaaacccacagcccacatagtactgaatggggaaaagttgaaagcattctctgcccccgagaactggaacaagaaaaggatgcccactgtcaccactcttcttcaacattgtaatggaagtcctagccagagcaatcacacaagagaaagaaataaagagcaggccgggtgcagtggctcatgccagtgatcccagtactttgggaggccaaggcaggcggatcacaaggtcaggaatttgagaccagcctgaccaacatggtaaaaccctgtatctactaaaaatacaaaaattagccgggtgtagtggtgtgctaatcccagctacacaggaggctgaggcaggagaattgcttgaacccgggagatggaggttgcagagagccaagatcgtgccactgcactccagcctgggtgacagagtgagactctgtctcaaaaaaaaaaaaaaaagaaagaaaaaaaagaaaaagaaataatgggcatccaaattggtaaagaggaagtcaaactgtccctgtttgctgacgatatgatcgtttaccttgaaaaccctaatgactcctccagaaagctcccagaactgataaaagaattcagcaaaattgctggatacaagattaatgtacacaaattagtagctcttctatataccaacagcgaccacgcaaatatcaaatcaagaactcagccccttttacaatagctgggaaaaacaaaaaacaaaaaacctaggaatatacctagtcaatgagtctaaagacctctacaaggagaactacaaaacactgctgaaagaaatcacaggccaggcgcggtggctcacacctgtaatcccagcactttgggaggctgaggcaggcagatcacctgagctcaggagtttgagactagcttggctaacacggtgaaatcccatttctactaaaaatacaaaacattagctgggcatgatggtgtgcgcctataatcccagctcctcgggaggctgaggcaggagaatcacttgaacctgggaggcggatgttgcagtgagctgagattgtgccactgcactccagcttgggcgacaaaactagactccatctcaaaaaataataataataataataaaataaaaataaaatatccagaatctacaacaaatttaaacaaatcagtaagaaaaaaacaatcctatcaaaaagtaggctaaggacacgaatagacaattctcaaaagaagatatacaaatggccaacaaacatatgaaaaaatgttcaacatcactaatgatcagggaaatgcaaattaaaaccacaatgcgataccatttcacttctgcaagaatggccatgatcaaaacaccgaaaaacagtagatgttggtgtggatgcggtgatcagggaacacttctacactgctgctgggaaggtaaactagcacaaccactatggaaaacagtgtggagactcctcaaggaactgaaagtggaactaccatttgatccagcaatcccactgccgggtgtctacccagaggaaaagaagtcattacatgaaaaagatacttgcacacgcatgtttatagcagcacaattcacaattgcaaagtcatagaaacaacccaaatgcccatcaaagagtagataaagaaactattttatatatatatgtgtgtgtatgtgtgtacacacacacagtggaatactactcagccataaaaaggaatgcattaacagcattttcaggcccgacgcagtggctcacacctgtaatcctggcactttgggaggccgaggcgggtgggtcatgaggtcaggagtttgagaccagcctgaccaacatgctgaaaccccgtctctactaaaaatacaaaaattagctgggcgcggtggcaggcgcctgtaatcccagctactcaggaggctgaggcaggagaatcgcttgaacctgggaggcggaggttgcagtgagccgaaattgtgccactgcactccagcctgggcaacagtgtgagactctgtcaataaataaataaataaataaagttaacataaaaaaaagaagaaac

SEQ ID NO: 168 - DNA, 73892 bp, Homo sapiens
aaagtaactataggtagactatcttacagacccttatttaataggtgtttcgtggcaacatttagttgaggacatgtcactggtctcttggaaattttggtttggagctggaaggtaacatcacttaactacaaaatttttatgtttataaaggaaaaaattgaaacagagagcgagaggtcacatacttaagagtacatacctgatggaaagaagttcccagaagcctgcctcccactgctgtgctgtcatgcactgctcacaaagtactattcacaacagttgtgttcccaatgtttgggattttaacaagactatttgaatttctagttcttatcatttcagacagcaatacgttgatattttgacaaaaggggcaaccgttctaaaattgtacccagtgttatttgtcactgaggataggaaataaatgaatgtgctatccatagcaggatgaaggcatccagctggagataggccatgatgctcagaagacccttgcatagtccataatgctagattgttttcgtgtgtgtgtgtatgtgtgttgtgggggtaggcagctgcaagataattaaaagaaatgcaagccactaattttggtcttttattcagtctcctgctagaaatcaccaggtaatgtggccactagttaagctagtcatccatttaaagcatttttgaagtagataataataggcttacctcagagatactgtgtcgttcagttccacacaaccacaataaagtgaatatctgaataaagcaagtcacgcgaattgtttggtttcccagtgcatataaaagctatgtttacactatattgtagtctattaagtgtgcagtagaactgtgtctacaaaaacaatatatataccttaattaaaaaaatatatattgctaaaaaatgttaacaatcatctggactgtcagtgagtcttaatctttttactggtggagagtcttgccttgatgttgatggttgctgactgatcacggtggtgttcccgaaggttcagtggctgtggcaatttcttagaataacgcagcaatgaaatttttcatactgattgacacttcttttcactaatgatttccctaatagcgtgtgatgttgtttgatagtattttaccaagagtagaacttcttttacaattggagtcaatcttctcataccctgcattgctttatcaacaaaatttgtgtaatatcctaaagcctttgttgtcattgcaacaatattcacagtatcttcaccaggaatagactccatctcaagaaactactcttttgctcatcaataaaaagcacatcctcctccactaaaggatgccatccttcgatcacaggatggcagcaattcagccatatcattaggctccacttctaattctagttctcttggtgttcatgatacatctatagttactttctccactgaagtcttgaactcctcaaagtcacccatgagggatgtaataaacttctttctttttaattatttttgtcagatctgataatgattcacaatattttctttttaatttttttaaatttttattttttccagatcaacttcttttaaattcctgataacatcaatatttgacctcctgcaaatcatgaatgtgcttaatggcatttagaatggtgaatacttccagaaggttttcaattgattttgccagattcatcagtggaatcactctctatgtcagctataactttacaaaatgtttttcttaaatagtcttgaaagtcaaaattactccttcatctatgggatgcaggatacatgttacgttagcaggcataaaaacagtggtgatcttcttgtacatttctctcagagctcttgggtgaccaggaccattgtcaataagcagtaatacttagaaaagaaactttcttttttttctgagcaatttgtctcaatattgggcttaaaatattcagtaaaccatgctgtaaacccatatgctgtcgtcaaaattttgctgtttcatttctagagcacaggcaggctggatttagcacaattgttaaaggccctaggattttcagaatggtaaatgaacattggcttcaaatgaagtcaccagctgcattatcccctaacaagaaagtcagtctgtcctttgaagacttgctgctagacattgacttctcctctctacctatgaaagtcctagatggcatcttcttttaatagaaggttgtttcatttacatagaaaatctgttgcttagtgtagctaccttcatcaattaacttagcaagatctggaaaacgtgttgcagcttccatctatattagcacttactgcttcaccttgtacttttatgtcatggagatggcttctttccgtaaacctcatgaaccaacctgtgctagcttcaaatttgtcttctgcagcttcctcacctctctcaggcttcaaagaattaaagagagttagggccttgctctggattaggctttgtcttaaggaaatgttgtggctggtttgatctcttatccagaccactaaaactttctccatatcagcagtaaggctgtttcactttattatcattcatgagttcaccaaaatagcacttttaattttcttcaggatcttttcctttgcatccacaacttgactgttttgggcaagaggcctaggttttggcctatttcagcttttcacatgctactctcactaagcggaatcatttctagcttttggtttaaagtgaaagacgtgtgtctcttcaccttattagaacacttgaggacactgaataataatttcaatatcattgtgtctcagggaccagagagggcaaaggagagggagagagttaggggaatagctgatagatagagcagtcagaatatacacatttattaagtttgccatcttatagggacacaattcgtgacacctgaaaacagttacaatagtaacatcaaagatcactgatcacagattacagtaacagatatgataataatgaaaaagcttgaaatattttaaaatttataatgtcacatagagtcacaaagtgagcacatgctgttggacaggtggtgctacctgcacctataccacaggccactgggacaactatgattgccaccaaaagctgcatggtcatggtggggcaggagggcctggtctctctgcctctgagggatggcccccagctaatagcccactctctgttttgagctcttggggccaccagcactgggcactgctggcagctgggcttttgatgtagacccaccctgaattaggttcttcttccccatgttttatacagatggaccagaagccaccttcttcttcccctgctagccaggggctctacacagactaacctcggccctataaagaccagccaaaccccatgggcaggaggccgatatggaccagggggctttaccctgactgatgcactttatgagctcggtgagaagggccctgtattcacctccactgctcccaggggctgtggatatacaggctggaggactgcccaggctcccacctgtttatttatttaacttatttcagtgttttatagtaaaggaaacactaaccaaaaagaaaatggtgctcattagtcctgctcaatgcaaggctgccgcaaatctgtaatttgtaaagtaaatcacaagaaattgagatatataataaattataagtaatatgtatccattatatatgttattataaacacatatagactatataaccatattatagctaataaagcaacaataagaagggttgattataaccaaaaagtcaactagatagaaaattgatagatagatattacatagcatatgcatacatatttatactttctcatgaacaattaaatcctagtattactgtttgtttcagttgatttgcatactgccttgggagttcagagacatctctggcagccagctggatttggttgccaaaagctttcaaactcatggaatcaaagtcatctctgaagagagctttggggcttatggtcagtttgctgatttcttgcaaggatatcaatgtctgcaatgcacatgatagaaaaacagggagctcactctgagcctgccagaacagtgctcacaaggcatcagagccacggaaggaacactgaaaaacgaggctctccacggcacttgctggcgtccctcctggaattgacaaggttatgactcaagcatttcacaaactggaacccattaatggagacacaggaacaacctttagctattaagtattttaaaaaagaaatttattgtatatatacgttacaccatgatgttttcatacacatatagatagtgaaatgattaatatattctagcaaatgaacatatctataatctcttagttaccaattttttgtggcaaaagcacataaatctacttttttttagcaaaaaatcccaatcccaatacagtattattctcatgtgattcattagttccctagacttactcatccaacatatctgctactttgtatcctttgttaacttcaaatagcatttacaataactaggtatcccagttaactctgaaatcttaatatgacaactcaatgatgcctgccgtgccagagacgaagagggcttaaaatatggaaaggcaagggctagcttactcttgaagaaaattttcttcaacaaaattagccaccatgcctggctaatttttgtgtatttttgtggtgacggggtcttaacatgttgcctaggctggtcttcagctgctgggctctcaagtgatccacccgccttgacctcccaatcttgttgggatgggagttagaaaatgaaatagctagaggatcaaattaaataaagtgtacttgtaacactgttcagcagcaagtgttatataaaaagtaaaatgttatttaagcttaccttatgatataaaattattaaaatatctttcagactctctccacgattttccctgttttgatatgggtatataaacttgatatatctataaatttacaatatattttatgtctttaagtttcatatctcaatatagttacttaaatattatccagatggtttgagaagacccatagagagcagcttttcatcataccttgttgatacactagctttgactatgtttttaaaacatgtcaaaatttaggagtgacattacatttttcttaattagagcctcagacatttgaatgatgccaaaatcttagataaatatttgtatatgcagtgatgctcacatttcccaaacttcttaaacaggtcaactgtaagagaagtggtacccaaggaagctgccttctagaaggattgctgtgtctacacaggcaacttccaaccgctataatggataagtcgatcaaaataatggatcaaatttatcaaaataaatgttcacatgtttgactggtttctttgaataggattcactctctataaaaaaaaataacaattttaagtactttcaatgtccaaatttgttagtttctgttatataactaaaaaatattttgtaagagtgtaatgttaacttactgacttgatagtttcagattgactaggctattcatttttaaatgtcttttcaatttattgaacattattatattattaaaaataattcaggatatgaaaacgtagaacaatatcattcctttatccttctccccaccctagcccatgctctatttcagatttccctccagcacttttgtaaatatagtgaaaaaatagtagaaaaatacacagtcataaaatagtccctgttattagattcaaaaatcatgaaagtgcccattgggttcccattaagtttttaaacctagacaccaaatttctgtccttattttaacttaaatagatggaagagagagaactctagctcctttgagttactactgctatataatagatcagttattcccaaacctcactgataatcagaaacaacactgggaaagctttattaaaaaaagaggtgctctgattgactatatttattaagataatgaaggagatgaaatttttttttccatatagaccaggtcgtggattccatctttaatgtgagtctttctctacctatgcaaatacccacactaaaagtagctgcaacaggaccttgtgaaagaaagaccagagagtttacaagttcaaattccaaaatcctaagtctggagaaggattttctatgctcatgcctgagactagcatgttccaagcacaaaaggtccttcagttggctgccaccaagacagaccatggtcaactcattttccagctgcctttttggctgcatgtctggaagcaccagataatctgagagcaggaggaggatcttggtctcagtggattgcataagcatggtgtgataattcttcagctcaggatcaaagagaaatgggccatattatgtcactaatcatcaacttgtatgtatatgtgtatgtttaataataaatttgtagacacccagggcaattcatttgaaagtagtttataacctatgtcatattcaatcttctattcagcatctttctttatgatgaagaataaatcattataatgttctgaatgtttacattaaacacataaaccattttacagtcatttattgatttaatgtttctacgacctattttattaaatatttttaaatactttgatatcagtaacatgggtcaagtatttgcttaacacaagtgggtaaattaatggtgctgtaaatataacctgaaactttagatcatcaggactttgtcctccagtttaaaggcaataaaattaatgacactgtcactgtcaattttcagatgataatatcaatatattggattagattcaaatgtattgcagtgtgtgcttaccaaacattgagtaatttgattgcatattcaagtggtcaataatttttaagtaatttagaataagttttttaagagggtttgggagaaacaatcacacttgacactattcatctggctcatttttatgtcaccttattagggtgaatcagttataaaataaattgatttattttattcttctccaagtgtataagttttcaactgtattgatcctacataattgcatgtaaaataataaaattacccttataagtctcccaacttctctcacatctacagcataaggagtgtgacctaatgctaaagtagctcgaattgaaatgccctaaccattcatccatgttctatatagttcatgtcaacctgattcccttttattatgagatttgtcctctcagtgcctgatccctcagggaaccaattgaattcttttatttctaaataattgaggagacaatcttacattttccaatggtctattgatagccactgcttcaacttggaaacctgagcacatggcttggaagagatggtgaataccaaaatgatgtctgttttaacaattccttgcattacaatgtagcaaatagcaactatttattgctcacttgctatcagtcaggcaatgtaataaatagttctgtgatagcagtccagcgaggtaaggattattcttgttaactggatcatttgacccaacttactcttacggaaagtcaattttggtaattttgcatccagaaaaagataatacacactcctacatatgcacacatacacacagccctcatacagtattgacatgtattatagacattcactaaggttttattaaggagataagtggtttccattgcatgtttcgtggaatttctttaaaaatccaagcaacataacctcaaaatatatatatatatatctaaccgatgttatcttccagattctttctctgatatgccaacatcagtccctatggttttgcccttttttttcacttcctctctggctacttctgtctccttctcactccagttttatgacctccagggtttcctcatttttccccagcagagcatgcctgtttttgtcttctttggttatcctcttactgcgtgtcgattttccaattaggactaacaactttccccttaagagatacacacaaaaaaaagagaagaaattaaaatattttagaatgattttctctgtcacatttgcactttacagataagaaaaatgtagttaaaaatgaattcctgagaagtcaagtagcttgttcagctggttaaatacttaaaatactattttaatacaaatttgaatgggtgattatattccaaaattttgtttttttctaatatgtaacattgtcttactgtggtacaaattatgtctaaacctatgagctttaaaaaacagagactattgtaatgtatgtacaatgtgtgctttatttgaaacccctactgattttcaaaactagtctattccttttatctttcctttttaagtaaggagtgcattgtccatatgggcacctactctgcaaaaagtttggagatttgttttcagccaatctgtcttctgaatagtagctgttattggacacaactgactctcatccatttctgataagaacccaaattttcagcaattattatcttctatgaattttttgattatgtgtataactgggatagaccatggccctaaccaactagtctggaaagttgtgagagaatagacatggaaattactacatgactcctgagaaagcaaatactgatgattactgtctgcttccatgaccaacttgaattatgagttctgacaagaaaaaacattagaattaatgggaaaatgtttattcctctctgaacaggctaccaagaaaaaatgaagatgtttttattgagacaggagtatactgtagaaaacaaatttcttaaaagagttgaggttatatgttaaggcaaattataataggttaagagcagcaggaagcaagacagaaaggtaattacagctgagaggattaatagaaattattataaatggctcatgctcggattatattatgtgagacatagaatcttatcttgtacatagttttgagcaaagatgtcatttaatttacatctgtactctaagattttatttcctaaaatggagttataagaagtactatcatcactaaaatatttattttatcccaaattgaaaattatctaaggaaagaattttaaaagtataaccattcataaattaataatcactatgcaatcacaggattctggaattattttcattagcgattattattaacctaaaattagcagtggactcttgaccttggccttgcaattggttgattcttaaaaatgtatgaatcatggccacaactgcaacaatagttcaaacacaatcaaattctcatggcatattttgctctttgatcttggtaataatttctgaccttgataatcattacacgttttcccacaaattcattctcaatgacttttgctcatttcttaattcttcagtgactgaaaaagctaattcattaatgtgggagttcaaaatcacctggttttcttgggaaattaagtgataaaagataataagagatactgagtctaagactgctgagaattcccttattttaccttggaaataagtgcaagtctgattattaaaaaatgaagttaacttctacttagagaaaacctctgagaatattcagtactagtagttccttcttgctcctgaaaatgactttagagatcttttcacatttctgtaaactccttcactctcttcttctcttatatattcaaacaaacattaccataggtgtaaatatttagattctaatcctaaaacatgtatttcaaaggaaaaatgtcttgcaaaagaaacttgatgtatgctgtcaccatgtgcagaaattacttctgtttcccacccatcaatctcagccattctttgtgcctaccactacagtagataggttctgagaatgagatagtacaagatcaaacaaagcagatagctgtcttctcagtctaatatcattgatgctaagccaggtcccatagaaaagattggagagcctcaaattatatggagttatttgagtgttaaagtatgccttattcagaaataacaaaatgaggattaaatatctggagaaaggttttcattatgtaaattatatgagtaaaatcttcttttctgattctgttaagctctattcttgaagatgaaatagatcccaggtcagcaatgaaagttgttcagggaaaagaattggaacaatctctgtgataaattagtcatataaataaaacttttttcatatttaatttttctcattgatctgatttaaattctaggcatactctgtgtatctcttgttgcagatagcaggtcagccagcagagagttggtagactacaaaatgtgatgtaggggctaacaagcataactttagaaaaaaaggtagaatttgtgggtgttgaagcaatttttaaaaaatatttggagggagttatagagaaaatgccattctgaaaataaatgaagaatatggtataacttctcattcagtgactgttgttcaaaaaaaaaagaagaagaggaaatccgatttgaattaaatcttcaggtcattaatttgtgaattcatgggtagcttcctaactctgagctaatcacataccaaaaagtttgcttaaacaagaaataaaatgatggtgtataaggagagattgctcaagaaacttaaattaaaacctgcaaaactaaaatataaaataacattcacaatacatgtaaatgcttaattattttcctaattatattgaaaagataaatatcaaatggttatcacctggtttctgtctacccctccatgggacacaaaattcaggaaagtaatgatcttctttacttttgaaaatcaaatgtattaatgggtctcaatatatgttgattgaacacggttctaaccctgatactgtagtgtatatggagtggcaacgtggagataattggaataggaacatcagcgtaatgctgttctttccttgaatttcagcaaagggatctactttctaataagaaagaaataattttatattcagtttttaaagtgactcacatttatcatttcatggccctatcaataaccttgtgaattaagagaaggaagtctcacttatttgtatttttgaaattagaaatccaagactcaaaacatttaagtgatttttccaaaatcaaaagactactaaatcttagatgcaacactagaaaccatcaagttcttctgccatacccttccatatacattcatgtcctttatttgtattttttataattcttctatctcctgggaaacatctcctcacacaagatctaaggccttggaaatatttaaattacgatttggagagttgggttggcaaattcttggacaagaaatcattcatcaagtacacaaattataattatctacatggctaagaatgtaaaacacaatatagattttaagttatatttagcatatgagagaaattattcactctacacatttgtacctgatataatgtgtatttcatgctatctgcaatgtaatatcaaatacaaatacttgtctttaaaaattgtgctctcatcatttggattctcggtgaatataattttaatttttctcctctgtctcactatgcccatgagatctagattatgttatcaaaatcagaaatgttaacagctgtcttacaactgatattcttaagtaattgtaaactataaacactggcactagattcaaaacaattaactaaaaataaagtataaaatatatgtagaattataagaaatctacctgattgctctgtaattgcttatatttaaattttccttctgttaaataaaaacaaatcttaaaaagtcaaagatagagagataaattgtgagtgaatcaaatttagccagccttggaggtacttgaccaaaatcccttgggcttgcatcatgaacttcaataagagctcaatgactgaaatcattctccattctactctaatgttaactgaagaggttctgcctctgatttaactctctgtaaaagtcggtttttgtaggtcatattgtccctgagcctccatttactttttgaccctcactgcagaagaatcttcacttctcctattgctctggcaaaatgacaagcagaaactcatagatatgtttgttgtggtcctaatagaagcaattagaactctctgttccctccaatttctctctgttgttgctattaaagtgtccagtacatccaagggtgatataggtttcacagtcagcctgaggatgtgaataaattatttacccatcttaaaaaaaatgttctctacttaaaataactctaggcaactaagaatgatgctgttcttctatgtttaattttaagtgccagaacgactaacaggtgcttcctacatgttctttgtgttgtctgtgctatagaatgtcatcacgtgattgatgtgcattaatattgacttgagacttgagtaatatcttaagaacgtgaggcagtcagctttcttcacctttgtatgtcttagagatttctagatacagcctttctcaggatagaaagaaacggcagtatttcagagacagactctgacctcagagtctgtcacaaacatgttgtatatcagagaccaagagcccttaactcctgggaactcatttgcacatttctatgatgaagcagttgttctggctatatgatctttaaaggtttttctcatttctacaaagaaaaaaatgtttctctagccagtaactaaatgctccagagaattgcctgaaggaagtggctagtaggatttccaacagaacatgggtttatgtgggtaatgaagatccacttcaggagccataggaaaaatctagagatgtgttcaaaacagccatgctctctcacttttgtggaaaccgacctaaatcacagtgttagatgaaagagaagaaatacaggaagatagtcttatttctgactggtgaaccaatcaaaaccactgcagaaaccatttccttcttttccttcatcggctactagggaagcaagtagagttcttctttagtttaaatggcattgtcaattctatgcagaatgagttagaaaaatctaaaagccctgcctcctcaaaaaatggccttccctccagcctgccagggtaatcacctggccaacctggaatccccaaagggattgatttcttctcaatcaaacaaggaaggtcttgcctcccaaaagctctcagtgcaaaaagaggattccacgacagtacccagcagtacaatgtgcacatttcatatttgtcaaatgaatgaattcaacagaaatgaaagaacaggggctcttgtagctttccctcaggaagtatgttatcagattcaatcaccttaccacagcctgatgaagggaagtgatacacacatagcattttagtgagttgcagggaggaaaatggaattgttattggtggcgtatccatggctgatgaagactgtaaaaagggatggaccagagaggctgacaaggcagatgctgagcatcatacaaaagtgagggatacactttgggactgaccaaagagaggtgcatagctcattgactctgtggcaccatttttgtttcaatgcctgtttctgtttggctctagcatttagatgtaatctttttattggactttggattcaaataaaagtactctgatgtaggaattgaatcttaacaagattggtatctgagtgaaactgaccccacatccattaagatgtcagaagccagagaaacaagggctgacccttttgaagagaaagcagaagttgcacatcggatttagatgtggaaattttgaaaggaagacacattcaaactgtattataattgagtgatgttggaaattagcaagcatgccattttaagggggacctctatcgtgttattggatttaataaaacattactttctgctctacagatcagtcacaaggatttatagaaattagctattttctattgaggacatagatgaaagatgtagaaaaattgaatgtgaggtgaaagcaagagaaaacagaaaggtgaagagagtcattttctctaagcataataacacattcctgcccagacttcagtctttgcacactcagtgtttgtgtgttgattaacactgctgtagtttcatctgttattacttaactgacatgttgctgcaaattatagctagagcacagtagtgggttacagatacaaataacatttaaaataatttctttcctttatacctagagaaattgtgaactcaacagcaggttttccctttactctaaaagcatccatcctgctaactgagtaaaatagctgtttttcagttcatgctgagttttaaatgtaatgtgttataaggtgtttattctctcaccgattagatcccattagcattaatgggagttgcctgaacaagtgctccatgaagtaatgaaaatatcatcttagtatgcttttttgtgtaatgctttatttcagagaaaattcttttcttaacctcagctattgtaggtgccacatcatttgttgtactgtcagattttttaatagtattaacaaaatgaaatagaaatagtcataagagcataaagataaaggagagttgggaagaatagatcaaagcatggataatttagcaatctcctccaagtgcagagccaatctcacatgtagctggagttagaagctgcctctatagagggattttaggttcgttcagcactcatcatctcaccaccctgccacccccactccacgccataaccaataattacaggttctgcttgctctagtgccttttttttggttttaaaactggagttaattttctcttcttttttaaggtttgaatatccctagaaggacagtgtattttcaagatagcttagtgaggcatgcagtgaatagaattattatttctattttaccaatgggggaaaaaaatgaggtagcacaacattcagcggtaagtcagaaattgaccagagattgttatctcttagcccagtgatcagaataaaatggttggaattgcccatcaccccatttcatattttgctttaaataaggagacccacaagaagtggtcaaaggaaagatgcagaattaatcatgttcagttggccaaatatcattgcaggctgatatacctgcaaatttttctaaatagtgcttgatgttatttgattccattttatgtgaagaaacaggaaatggttttacaagccagcactttgtagtcaaccacagaaggctcaggctgtttgtattcacacatgctcttctaggtctccagggagtcatttcaggataaaacatgccttcatagctccctgcctctagagcaagaacagtttgcctttatgtttgtggatcctatcagtttgagagagaacaaattctgagggaagaggcaaagtaatatgtcactttcatatggactttcccaaataagcacatgaatggagttggaaaagcaagccggaaatagcacttctcaaatggaaatacctcattttaaatgatcaaattggagtgttaggatcagcagtggacattctccaaagagaagattgtgttatgttgaaagtccacaatgaaagagaagtaaagaataaagagaatttgcaactatttattgtagagaaccaaccaattggcattaaagttcaatatagcctcatggctttctttttctattcatttagaattttaaataaatgcgcagagctctttctttttataccattttcaagagagattctctggggaataaagggaatagaatagttacttgaaaatatttgaacaatttaagaaaaaaatgattcccaccattttaagcatataaaaattctctacttaaataaagtgctatacaattataagccatttctttctattaaaagtagtttcctaagaacccctcatagtgagcagctcaacatatggatatataattcacaagttttctttgtttgttcatatttgttcagtcattggtaaatagttattgtgaccttccttgtgccagacagtatcctaggtattggagatataattttgaatcattcaaagtgagtggagaaaatttgagattgcatttccacctggtagtgacattgtacctctgagtcagggtttttcatgaaatggaaatcatcacattttctcagtgcagagaaagatatactattgcatttgttttattccaacttagctttcatacttaaaaaaaattgtcacaaaatactgttgtaaaagtcaaatgattccttaataggtaaaccatgagaggttcggatttatagcattcttaactttcctgctatcaaactgtgcctatttttaaaagtatagcaatgtatgatagccacagcctgtaacctgtgtatctagtcattcatccatctaatattcatgggatgttcattttgtgccagccacttgctgtgctcaggaactcaagaaatgaagatgaatgagacaaaagcctttgcctctagtagcctctggagttatagcactttctggaggtcatcagaaaaaccaggagacagaatgctagtgcttgttgttgcaatgcatttctcttctaccctcaggcatcaaggcatcccagtttgacaaagaatacaggaaacctaatgggaaatcaaatgaatatatctgagaaaatagattgcaataaatgtcttcccccaagagaaacaaaagtatcttataagaatatgcaaatcctagtatgaagttttccttataatcccatatatgtgattaatagtgagacccaaatatattaaaatttcaatcatattgtaccacaagaatttacaaaagttattttctattggattaagagaataaccattgtgtttatttactggatgtgaaagagtaactaatagtgagaacagatttctaaatttcacacattttacaaattaatactatgttttcctgccacttctccctgtaggggaggaagtatatattttctttctacctttctagtttcttgtctgggttctgtaacaaaatgcagattaacaagagaaaagcatacaaatgtatttgatatgagttttatgtgacatgggggccttcttaaggaaaagaagacctaagaaaaacctgagtgtttttgtgctaagtttgatgaaaaatgaaaactcatggaaaaatgtgatagaacaaaggagtgtgagctaagagcagtaacctgagagaaacgtagcaaggcttgttcatcgggattcctcctggtgtccttgcatcttcagagataagggtgcccttcccctctgagtgtagggaggttacctctcacacgagggtcactccaggagaaggtcagggagtcctgcatacacctgcaatttcttaaattgattcagcttgaaatagtcactatgccaggacaccatatttttgggtagcatcttctaaagcccatcactactcctttgaatgtttcactcttttgtctatagtttttaaaacatttgtaattttttcccagctttattgaggtataagtgtcaaagaaaattgtgtgtattcaacatgcacaatgcgatgttttgctatacatatacaatgtaattatcacaatcaagctaattaacgtatccatcacctcacatagttacttttttcattggtgaagacacttaaaatctattcttttagcagatttcaagtatataatacattatcattaacatgttcctcctacaaccaaaagcctgtattctttgaccaaaatacctttatttcctcctcccgttcagatcttggcaaccactaatctaacctgtttctatgagtttgacttctgtagattccacatctaagtgagatcacacagtatttgtctttgtgtgtctggcttatttcatctagcataatgtttcctaggttcatctatgttgtttcaaatagcaggatttttttcttttattaaggctaaatgacattccatatctgtagctgtatctaagatagataaagagacaaataatcacatttttcttatccattcatccactgatgtatacttagttgtttccaaaatcttggttattgtgaataatgtacttgttttaaagcaccactttgtttttacaactaacttgttaggtcccttgactttgtggctttgtacctagaaggtatcttgcaataccttctgtatactgtgtatttcatatactgtttctgctgctacagctgctgatgaggttgataaattatcatctccatctatttctaaatggagaaacagcttgcatctgttgagatgattgtaggtcatcctgtgagtacagagattagatcactcaggaaatgaagatgattctcataatacttattggctgaagtgagattttaaagctatggactggaattatatacaggagaaaacgagatttctagcaggtttttacacccacatcatatggctcagaaactgttgtgaattgggcttccatactaggcattgctaatgttccttctctccctcaagtaaaaagttattatgcagatcagttagacaaaagcttggaggtgttctgggatcatctcttcctttgacttcttgaccttggtaagcaattcacatcctcaagggcctatatatttaatgtacatcacatgagaattaaaagtgttttgtcattactcccattagggttaacctattttcctgctgacctggagatgattcaaagcccaatcttggccacaaatacacaccaaatattaaataggagtttaggattcaaaaggcagcaactcacatagtagttaagaaaacttactcaatcatatcttttagtgtaaatatgatgatgttcttcctgctattcctggccagtttcacaccatttcaagtataggttagagcagcggttctcaaacattaacttgcatcagaatcacctggagggcttcctaaccacaggttgctggcatccagccccagagtttctggtttacgtggtgctgagaatttactttttttttttaatttattttttttttgagacggagtctctctctgtagcccaggctggagtacagtggcgcgatctcagctcactgcaagctccgcctcccgggttcatgccattctcctgcctcagcctcccgagtagctgggactacaggcgcccgccaccactactggctaattttttgtatttttagtagagacggggtttcaccgtgttagccaggatggtgtcgatctcctgacctcgtgatccgcccgcctcggcctcccaaagtgctgggattacaggcgtgagccaccgcgcctggccgagaatttacatttctaacagactgccaggagatgctgttgttatgtagtctgacgaccatacattgagaagctctggattagagaaaagtctcataaatctatggacttagccatagaattataccgttagctgctgattcctccacagatggttccacctttccttctttgcagttacctgagatttctcaatttctcctaatcccctttcttcactcccatactcaaaggaaatggatctaagaatgaaatattgaaaatctatgaagtcctgattggtcccacatttagctctatggtactctgctttcactataatctgaatgcaaatttaagtatatagtaaagaacaattctgttctgttattacatccacccagggatctgcaggtcttttatcttctgattcccacacagggacaagagtgcctcatattcccagtgtctgctgacccctagtggcttgttatgcctcctactacacctagattaatttttataaactaaactcatagaggatttgggtttggggtgattgtaacagtgaataattcacaatattggccatcatagtcaatctggggagacaaacatattcatattttttcctcctttgaatatggtttttgagacagggtctggctgtgttcctgaggctagtcttgaactcctgaactcaagcaatcctcccatctcagcctccagagtagctgggattacagggacatgctcctgcaattggctcttgctttgaatattcttaatgtaaagtaacaattgattgacaaagctttctacttcttgaaaataaaatctgtcaggtcaacttcttgcaaattcagcatagtgagttctctacaaaatccaactgtttgctcaagatttattttatataactgtagagattaaaatctgagtgtaaaagcagactttatgtggttccaaagatgtaatttaaagacatatttaaataggtacacagtgtaaatcaaatgtgaagataatgacagttatttcagggaacatttaagtcagattaagtttccaattgagctgctcaatatccctgaatatgaacagatctgccagaaaatttgctggctatactacagcacagagttgttaaatgagtatacttataaataaacaaaatccagagagatattttccctgatggacagaaatgattcaaattaaacaaaatgcattaaatatgccatattgcttatatttaaaaattataattttcaatgtttaaaacacaaaggagtttaaaactgagaaaaacagtattagaaatgactggtacttcagtaattcttgaatcaaacgtaaacttgaattcttgacacatgtaagttattggagagtactgattatttatacaaatgtttctatgccatcatcttgtgtattacttcaaagagattgatattaggtgaaaaataatgccaaaaaatccctccaacactatttattgcccttccgtctctcaatgcgtccgaaatgaggggcatagagaacactaaaatgaataaattcccctggtgagccaaagagaataaatagtcttcacaatgaacaatctttgtattaagtgttggcctgatcaccccacagtacaaacacacagaaactctgacttcctaccagattaaggtgacccagccattctgcatgcataattacagagaagagaactcaataaagagccttctctcaagaagcacaggagaagtcagctcagggaaggcagagaggtcttactgtgtgtacactgtttcaacatttaaggatctctctttagatagatagattactagccaggaatttgcttcccttttatccctatttcaaagtatttttctggcaggttcttttaagatctcatcagatatgtgggtatagtgctttactcactatgacattttacatttttgggaggcagaatgaggacttgctactaagacacaagttgtgaagagagagtatttattacacttttgcacagagaaacagtattacctgaaaaaaaatatgtacctgcaaatgacctagacttacaatattaataacagatttacctctttaagagacatgaaatataaatcactctaaggaatttgtgatgcattaacattgcataaagcagggttaccttggatggagatttgtctctctagtatcttcatttcagttggagattttgcaatgttattcactaatgtttcacaaatgttatagtgcatattgataaaccaacaatgtgaatctctaaatatccagctcttgaagtttacaatccaggattttatctccgaactttgtaggatggctgctagtctttcattttttctcaatgttgcttactctaatcaatgagaaatgcttatcaaaacattttgtgtgttacttagaaaaagctatacagatagatttcttaattgatacataacagatgtacatattttgggggtacatgtaatagtttaatacattcaaataatgcataaagataaaatcagggtaattgggaggtctcttaccttaaatatttatcttttctttatgctacaaacattataattcatcttttcttgctattttgaaatttacaagagattatttttaagtacagtctccctatgatttattgaacagtagctcttcaaatatgtaattagatagaagaaataagacctagtgttataagtatctttaacatcatatacaaaatgatggtataaaacaattcatatagttgatatttcagtttcacttccctgcctttaatcatgctgttgggcccacttgaaatatccatttatttccctcctcatgtaaaaagtcaaaattcaccttttccaaggagttctccctaacctgtcaacacctatagttttcttctttttatgactgataacatacccactatttgtgccaacaacttttttactacattagatctatattgttaattgatttacaggtctctccatctgcagtgtaggctccttagaaggttcagaactttgttttctattgttcctgaattccagctcatggaatggtaacacttaataagtgctcagtaaaaattatctgaattaaatttaatgtcaacatccagtgtcatcctagtttggctggcagatgtagagacctctaagaagtaatgagcaactgaaaaagaataattcttacatagtggttcctaaataccaaattccaaactcctgaagaaatatatgatttgaaatgtacaatagtcctaattggctaactttctgcaacctggcagagaaaatttacaatacaggcctcttaaatttttattaatgtttcccctgatatctttattattaataattttttcacggatctccaactttttcagagacctttcaaaattgtcatacaaatttttatggcatgtttggttatgttttcatatagcttgaaaatcaacaacaggatacgcctccaaccaattatgatctgattcttataaggtaaagttttatttcaggcttaaataaaagtaactagaaaactctgcaagggcaagaatataaatggccctgatgaatcacaaaaggagaggcgttgcaatcataggtactgggatacaacagtaagagagagactaccatcacacccttaaattatagcattcttggtgttatcagaagctccagaaacctattccttctacacacaaacacatcctcaccctaactgttcacccgcagtaatggaggggaacattaataccttattttcagctcagaattaattttatatatctgtgcataactggattccaggaagaactaaatgggatctgtaggatgtatgtgaacaactaattagccacaaagtttcttataatatcttcatttgaatgattctttcattgaaaataatggtctacatcctatggtgaaacagattgagtcagctgttccctctctgagcttttcaagtggtgagctgatgaatttgtcctttataggtgggataatttgggccttaaattcctgtgttttttcctttttaacagttgcctgtttccttaaaatatctactctccttgtctgtgtatactcaacctagcctgatgagaagcaaactagaatatctaggaaattattatatccaacagggaataatagtataaaaggagatgaatggtccatagcatcattataagaccctttggtctacaaattatctgagtatataaaatattgataagtgaggtagccaaagttcacaaagtactgtgtgtgtgtgtgtgtgtgtttctgtgtgtgtatgtgtgtgtgtatgtgtacgtgcatgtatgtgcattactgacaagcagacttaagcagtggttgaaaaaaattggaaatgttaatacatccctcagaagttgaagcaccttttatgagaatatgattagctctaactgcataactgtgttctttgatgaaatgataatcataccactaccacaagcaaaacttgtattttctaataatttttcaaatgactttcatggtgataaccatttaactacgaccattgataatagatagaattagccgagtgtgttgtatttgccaggcattgtgcacacacaatctcacttttcatctaccagacaattccaagtggtcaacaactacacttgcagagtagtcagttcttctcattctgcagatgagaacacaaaggcttaggcagatgagcgaagcttctgaagatcatccaggtagaaaatggaaaggcagagactcagggctgaatattagccaccaactagaggataggatttatgctagaggcagttctatgatcatttggtatctggttttaacaatattttctgaattaaaaaattaggaaaatagcctgatgggaacagcaatttatactcaggaggaaatgaaacagcatgtttgaaattctaattctattggataattattacaatataatagtttatgcttttgagcacagggcagattccagtctatgatacagtgagctgccatacactagagtttggctttagttaaatgtgatctttgaaacatgatacataagtcttctgcatcagaatgtgagttcatgaattgattttctcttaaccaagagaaaattaagcaaggccttaatgaatagtaactttgatttcctaaggacatattgtgagaaatccaccgtcctttggagcagaaagttctcagatgaaggacaatgctaacgtaaaatagatgatttcatgttgtattcaaaacaagtttctatacactgtggtagaactggaatgactttcctatttctctactgaaatcataatgtgaatgtttttcataaaataataattttaagcaaacagcatgttggccaaaattgttgggtcgttctcagttaaaatttagcattaatatgactaactcataagtaattcaacattgatataaacactgcttagtttccacagaaaaatatttttccaaagtcccagaaatcatttttgcagttcatttttattacacaaaagcttgctgtatattaatcagcagaagaaattttaactattcagtagttttaaaaggctacatttaagacttgctacttgaagtggaatgatgaatcaaatttgatgtaaaatattttgccttaaaaaatcctccaatgaaataatcagacggaaaagcgacagtaaaatgtagaacttgtcatttttaagagccaatatcatcttaaatgatagggattcagtttctatggagcccttcttgggctcaagttcaacactttaatgtgataatcagcttaagctaaaattttttgcacttttggacagaaaggtttcgtgtttgaaacagatgcaaatgaatgctaagaaaggagaaatcttgcagaattcaatttaaagagctaccttccataaaattctgtctaccggcctgtctcatcgaatgaagcagcaggcagggaaaccaaggttatcagtccagtattctcctgcttgaaattttctacaccatgtgttcctctcagtgtctcacattttaagcactgagtaattgctcaaatttattggaatcataaatgttaaaagattatcgagacaattctaatccagtttgctaattttagagaagaaaatcgaattcagagaagttgtatgtgactagctcaatgctacaaaaatttgaccaaggtaccaaaatgtccaattgttatactgaatgttgattagtctgtaagttagccattagtactgtcacattactgcgattttgcaaacagtaaaactaattaacaaatataccaatatgtttgtgatcaaacgatcaatcttttgaaacagttacctcaagaggatatagaaacagtctagtaatttgcaaaatgttttaagtcaccttttcagaaccagattttatgacattaatccattaatttatttatgacttaacagcattgagagcttactctgcattcagcactgcaaataaagaagtaaaagatggtatgttcttgttcttatggacagcaggaaaagtaaagacagatgacaggagagatgagtagaaaatatggtaaataaaattggaagattgattagatataagctatgcaagtgacagcagagaaggagaaggttattaataataatttacatatactatattaggcactgatctaagtctttatcaaaactaatcctcaaaccaatcctatgaggtataactattgtcatctgtattttacaggtgaggaaacagattcagaaaggttgaaaaacttgcccaaagttacaaggctgggctataaacccaggaagatcaactatagagtccacattcttaaacattaagctacctgattttttttttttttttttttttttttttttgagatggagttttgctcttgttgcccaggctggagtgaaatggcacaatctcggctcactgcatccttcgcctcccaggtacaagcgattctgctgtcccagcctcacaagtagctaggattacaggcatgtgccaccacatctgactaatttttttgtatttagtagagacggggcttcaccatgttagtcaggctggccgcgaactccttacctcaggtgatccacctgcctcggcctcccaaagtgctgggattacaggcattcgccactgcacccggccgctatctgattttgatagactacttatgaagacttgagagtctaagcagataacagtatttctgaaataaattgggtatgaaggagtagaagttggtaatgaggaaaggaaaaagatggtcagtttctttatttggacagattcaacgtatctgttaatgagtcagcatttgtaaatattcatcaaggctgcagacatctctttgaaagttataagcgcaagaggacaagaggtagcagttaaaaatatgaatatggccaagtttcctcagagagcatattgagtgagaaatggggttccctgaagtacaaacaccaacatttaaggaaatatagcagaaaataagacaacaaaattaactgagataaagatgtcaaaaggaaaaaataataaaacatgagaacgttatatgaggaattcaagaacaagggcatgtttcacggtattgactttaaagagaattcaagaaagacaaggactaaacattgggagttgataacaaggaagttattccagcaaaagagtaaaaagctattctgtggtatgtagaagcatgattttgaggtggtcaggagttagtgacaagatgacctcctttgaagaaactttattaccaagtgaaaaaaataagagtgaagggaagcagaaaaggatttttttttctgaataatcacatcttcatgtttgtataaaagagactgcatcaagttgatatctcacttttaaatgataaacttgaattgtattcacaaacaaaaaagtctcttaaggggaaattatttgccaacatttgagacatttaaaaaagtatgttgcaaaccctaagattaattccataaaataaaactcagatatattttagtaaatgtacatagcaccagaaactgcacttggctctaaaggtcaataataagcaaatacagacacagttcagaaatgaatttttgttaaacaaagataatatgccaaattactataagataatgaaagagagcatatttcattaataaattatataaggtaaagtattttttgaaaagatatttggcagctgcaataatatttagaaaaagaaatgcttcaatctatctgcaatacaattaaatttggattagaaatgtcatgcaatatggaatttgtatattcttggtttattttagaccctgattaagccatatcttgtttatcatagttagaggttctaatgttattaacgtttcttctaaaataggattctgacacatctataagagaaaagcttgatcaccattagacaaataagtaaacattccccctttccattattataaagaatatgcacattgtaagttcaagaatagtttagaaaaaaaatactgaagtagtaaagggcccataaaacccttcctcttgtattttctatctcagattgcaacactgttcacttaattacccaacatgttagaaactgtgctataccttcatttccccattgcccgcataaatcactactcccattcagttctacttgtgtatacatgaagcctagctatcatctagatttgagttatcattttctttagtcttagaacaaatcaaactgctttcaattctgctccgtctcaatctcaatccattccacagacctagggatcattctgaaatggaaatcaatatcttcaatgtcttttgatcatcaacagatggaagctcaagattctcaacatgattttaaaaagcttaatgatctgactcatgttttcttccatctcaacattcaggccaaactgaaccctcacagtatttcaaatactccaggcagaatcctattccagcctttgcagaaactggcccctctccatgtaataccctatccccatcttgccaacttctttaccaggctaatgcctactcttctttcatttgcccagatagatatcttctatacaaatcctccctcaaagccaccagattgaattaggcatttctcccaaagttccccttgaagcctttacttatcccatcagaaaatttataaaactatgctgaaattgcctctttacatataatctatctacatgaggcaacttaaagacaaagtgtttgtcttctttacttttagacatataccagcagaagaataaacaaataagaaaaactcatttctatatataatataccaataaatttggacaaataactttccacaagcctttgtttacacatctgtaaaagcatggaattacagaaaagagaaaaaggtataataaagctagaacccatcagtaataaggcaaattttaatatatgctatattgttgaaatttttgtagtaatgattccttgtgaaagcaatatcacagataaagctgcttttacaagcagcttgaaacagcaacgtgatattcttcttgtgcagaactccatattccagatttgagctttcctatccacattttgacagtccatcagtcaaagaattccctgcagaaaactacaatagtaacccaagaattactgactagttactaagagtttgcttcaatagattagagctgtttgaataataaagatgttacccagcaaatatataaatacatattcttctgcaatagaattcttaatatacagagtataatagaataagacaaccttaaaaattaacctaactctttggagatttctacatagaattgcttgtgggttgtattcattttaccaaaaaaagtatataaatttaagggaacaaatctgtgctatatgaaacatgataaatattaagaattgtgtttaataattcttatgaaattatataagcgttaaacatcttatctctaatttctgtgcctaataattatatagagtttataataaactatacaatttatgttctcactcctagaaattctgagtcagtactctggttcaaggcagaggaatttacattttaatgagcacctcaaatgattctggtatatgtttcaatcaattcacactttagtatcctctccatgaaatatgtgcatctttgtttcttattttagttaatatactgttgaatatacctactcatgtagagtaacatttgtagatacttgtaatgtagggaaggggattctcattttccatattcaatttgagttccaatgatattaatagattttcttagattttaactagaactctacatattaggaataggtagctacagaacagacaatgataatgatgttttcacatgactgtttgccaaatactggtattaaattagaagatggagtgaaaagcactgaaaggcacatgagaagagctgttctgccatgcttttctgtgaccttaggcaaagtatttctgtgaccttggacaaggcatctaatggctgtggaccccaagagccgtatctgtgaaaatagattggagttgtttaaaaagtataattgtattgtgtatcttatgtaatgtagtctattcataacagaaaagagagggaatgaaactgttagggaaaataatcattctaggatggtaccaacttcttggtctgcatctttagtaaagggaatgatggcaaggccttatcagatactcacccaatagataaaagtattagttcataatctagttgtgtaacaaggtttctctgaaaagctgaattaggatccattaagtgctaacaaagttgatttagggaattctggatgtaagagtaattctgcatgggtgtgaagtcatagtccattctctggacacagagattccatggtttttaaaataaagtgcatatctattaagtcagtgaaaaagtgtcatgagacttctttctacagtgttccttctttgaaagatagaagatataattgaatatccttgcagaggatatacctgagaaggaatttgcaagattctgctgctgttctagacttgggaaatacaagtatgaatcattgacaaatattttaactttcaatagtcccacaaggtgagagtgattactcagtttttcagtgatctaacacaaggattacataattgttttctgattcctgaatctagaagtcatcctatttatcaagcaaaacttaagagacttaataatgagttctcccagaccacaacgcctatcttcagggatagctgatggttatcataaatagaaacgacccccaaggagcttctggtaccaaaaatggtgcacttgctcagggacttgtacatttttttctacctattactgacatatgtatgtcaactctgccacattggcattaataatattttaccctgaaataacagagttgttcatggattggggaatagggaaatgattaatagggaaaagagaccttgatctcattattctaaattgctttaggtaaaacagactggatattaatacatcttttaaaatatttgtgtcaccactttttgtgtgtgtgcgcatggatattttgcctttttttttccttttaagatgaggtctggctctgttcccaggctgtagtgcagtggcacaatcgtggctcactgttgcagcctccacctcccaagttcaagagatcctcccacctaagcctcccacgtacctggggctacagacacatgccaccacacctagctaatgattttattttttatggacacaacagggtcttgctatattgcccaggctgatctccaacccctgggttcaggcaatcctgcctccttggcctcccaaagtgctgagattataggcatgagcccggtcttgtgtcacctctttagcaagaattcccattactatttttgtaagggtcgctaaggctcagaacagttaaataaattggcatgacagaaatacagatatgtaatatatatattgtatatattattattatggtttctaaatcttatcccccatatatttattatttttgttaagacactgttaatttttaataactttttaagttatgtatctttcttcatatgattttgatagagctttaaatatatttacgtttatacctaaaactctcacaatgggctaagttgctggctcatttgttaagttgatgattatgctttacaaatgaatgcttttaaaaaacagcaaacattttgtctgtgtataaacctgtgttgcatttttagaaatggaaaatcatttttcatcagaacatctattatcagatttatttatttgaaggaaaaaaaactcttatgaaagaatccccatgttcctgctcctgtggtgcttatcaacgttcaaggatcattgaaactaacactattattttcccttcaacaattgaaatgattgctgtgtttttgcatgggagtagaaatgtttttctttgttaaaaatctataaatattaccatacttccagtctgtggacagtcatatgtaattatatattcttaatataatttcctagtaatcccaaatctcagtagggatggtattctgtttatatttgttgcaacatctccctccacttaatacaaatgactgccttgtgtgtctttattgttttgaaatccatgtatctgtcatcagaaaaatagcctaggatggagccaaatgaacataaatttgtcaacattttgaaacttgagctgcagatctctatttcaaagggcaatgtggtaaagtacttccagaattttagctaccaaggtgaggacatcccataaacttctgcaatcacctatttttatatgtaaatgctttcagagaaacacaaatatctaaaatgagcaaatgcttttatcctcccagtataaaacattgcttataattgcttcctgacatgataattatgcagtatattattttcattaagatttgtatttttttattaagatttatatttctgcctgcaaagctagctacaaattttaaattttgcacaccaacatcatgggtgtcatcatgccagaaaagaaaacgaatctttagggaataaaattagatatttgtagataagatcacagtccataacctcaaaccaggtaggcacacaattctttcatctttctctctatttagatatactttgcatcaatgatgcatgtaatattcttgaatttaaccaatttttgcacaaaagattaatttagcacttccttatgtgtgtttttggtaatagccttagaagaaaaatgtttgtcacaaagcaatttccaatttaaagcatcaaaaaaaaaaattcaagaacacttaaataagccttttctcaacataaatagaggaactacatttaatgactgtgagacagacagcaaataaactctcttctaattctgaagattaatattgtagtaaattctgtggagttgcatgaagactgctgtatattaagctaaaaaattatcagccctaaagctccataagtattttgtgattagttaaaaattattggaccctggaactgctgatactaatgaaacttaccagattcctatttatacttagcaaaatgtacaatttcattattaggataaaagaccaatcaagaaaaaaatatcttcttgaacttcaaataatttaattgatatataggaaggagaaattaagggattctattttctttcaaagtacatttgtatcttactttagggcaaagttgtattaaaatcaaaccccaggacttccaaaaaagttacttaaaatatgtggcaaatgttccagccatggaaatattgcttcaaagtacaattaataatcaggattagaacaccttgcctttgtgttgggaaatggattagtgcatgggttctgagccagactgcctggtttctaacttcccttgatttgttccctttagtaaattgctaaacctctgtctgtcttcaatccccttatcaataaaatgaaggtggtacttcatagggttgctttgaggataaaacaagttaatttagaaagtgctgtataagtgtttgctatggtgaagatgatgatcattattaatttggtatttggaattgattatttcataagggcaggggcatatcttttttttaattttgtttcccctcgcaattcttagaataaatattcaataattttggctgaaagaatgatcagtctttaacctctggtcgccctatcatttactagcacccccagcacttgcaaagggtaaacaaacaggagtagagtgaaaaataaaatgttaatgttaggacatagttatgatttcaaactgatctaggaggaagtttgcaaaaacaagtacatttatctttaaatgtacccatactatgcctattccttctacataaagatatttctgaggtgaccacatcatatcttccagttgtcatcttcctcggcacagtgtaaccaaagactacaaataactgaatgctctggtttcagacttccttgattaatgacaagaaaagcaaaataccttccactggagtattactaacaatacaatttctaatggttaatcattgcctctgaaaattatctaattatttcctgattgcgtctccttacttacataaagtaaaacttaatatcccaaattatttgtcttattttggaggattttatattggtacaagtcaacattaagaactcagaagaaaggaagttttagccttctgcctatttacaagcctgcctgtgcctgccccaccaaaattcccagaaaacatgcaaaatgttcctgaatcaccaaagagaaaccattaattgtttaaaaaacaaaactgactttggatcaataaatacaaaatactgtcataaagaaaactttctttatgttttccaacctagtaagtgttacttaaaaaaagcctgagtcagagaatagtaaagaaagtaaacaatatttttagcttaaattacctttccagtaaaacacagtataatatttctctaagatgcttttgtaaagtctgtttataaactgagattctaagatagaagatagttaaggttgatttgtaattggctggcagcttgcacaagaccacaacagtgacaggttgatggagctgtaatagggacaggggatctttcggacacagattgatttttatttgacaaatgctaatgatgctcaaaacaaaacaaaacaaaacaaaaaaacactgaagcactccaagcagtgttaggtagcgcattaaggatattcagagaagtgtccgtgtccctttttgtgtaaatatttatttttattgattttcctcttcttaacattgtgtaaataacttctgtttgaacataattttggaatatctgcacaatagaaagaaattagatgtttgcaaatagacagttgagccctagggatatttggggttctcccttttttaaaatatttgtatttcacagagtgaaataacagaccctggagactcctgaaagtgggatgatgggaggcgggtgaaggatgaaatattacctattggagacaatgttcactgttcaggcgactgggaaagctacaacccagattttaccactgtgcattatatccacgtaatacaactgcacttttacctcctacatctataaaaagttaaaaaaaaaaaaaacagcttgtgatcctctgtaagaaagcatgcttacacttgccttgatagctgcatatgtattgaacctatgtagtatgaaccaataaaaaaagaaatgttttaataacaaaaaagtgtatttcagataatcttcgtgtaatttttgcatttttctgtttctctctcaatggcaattaatttttcctaaatctcatcatatcctcttctatacccaggtataaataacatattacctttcttattaaagatgcttctcaggtgaaggactcaactactccattatttagtatagttttatttctataatgattctctcacagtgtcaccttcatcttcagatttcttaaaagtccagtcatcaggcagtatttttctcacaaacataacaccaccagccctattcttaaagctaagggtgacctttccttttctgtccaatatccaaagcggtataaacagttggtgtttcttaaatatgtcttgtgttaataatgttataaatgcttgaaaaataaaagtaccactgtgatactaacagttccgcaactttgtctatatgaggagaccctgcacgctgctcaagtctccgctgtcttaccatttctgtgactataatggctcctggtagccctcagcttcccacaactacacccctacgagcttcactgaaacagatcgtgtaagtacttcttcacagctgcacacattctgatacctatatggttggtgtacagactacatgtccccagacatctgttcctagttcagcctttactatatttagcctttatttgtgacttatccattgatctaattttaaagttttgaattgtagagagaagccaaaatatgaattaaagagagaaaaagatagaaaaatattatgaagtctaataaatgaattaaaaccaaaatccaaaaattgttatggagggaatcttggctccaatttgatgccctcaagttttaggctctgtgccttccacatagcaatgattcaataagggttcgtgaaaggaacagagggagagaaggacaaggcagaaaccttgctttccctagaatctgttactgcattgaggatatcttacctttccatgcttctcacgctctattctagaaaaacgtgaagaggaaacaatataagtttagatttttattttacataaagcatcaaagcaagaaattactccttagggcccctctgcatgtttaacatatgtcttctctttaaaaaccgcataactctttcttaatgaagcatcttccacaatatacattacctaaacatctggctaagtaaaaccaattatactattaaaaataaaccaggatttgccaacaatatgatccagtagtgtagtcttcctcaaagtcagatatttgtactctaaacacaattgtgtggaatcctgattggatttttcaactagaatactttttcttctttcttttctataatatcatttaatctctactttcaaaacctgattagaatggtaaaactaggaatagtgacagacagtgtaacaacagtaagcagacatgcctagcttgctaactgggatttttccagctttattttcctggctaattcctttattagcattgtgtatctgatttgctttcatgtgcgtagcagctggttaaatgaaaagaacgattgccttgatccttgccatgtaagttcagtcagaagcctaggatggagctagtgcttgccttttcccatcctaactatgaatgctttttttttttttcaagtaaattaaaatacagcccattgattatttaaaaattgtgcaaaggccatctgttcaaaaaatattttcctacattaatgtgaaagaagtgaatgtgtaggtacataggttgtagtattggactgcagagtgagttcaaaggcaatgcattctatattttcactatttacaaaaacaatgcagaggtgtatggtttctacacagattattttttatggtttattacttataaaaatgccttatgcgtatgtcaggcaatacattgccttacttattgtgacatttgatgatttatcaccatttaatagtttgagaaagtgtgaacataatatatatatatatttgagacagagtctcactgtcgcctaggctggagttcagtggcgtgatcttggctcactgcaacctccaactcccaagttcaagtgattctcccacctcagcctcctgcgtagctggaattacaggtgtgagccgccacacccagctaatttttgtacttttattagagacggggtttcatcatattggccaggctggtctttaactcctgtcctgacctcaagtgatccacccgccttggcatcccaaagtactagaattataggcgtgagccacagtgcccagctgagtgtgaacataatctatataaccagtttaataaaatagtttgaaatggaatctaaggagggagattaacaattccaaacacacacatatgcacacccacaaacatgagatatttttctttttaaaaatgctgttattctcttgatttgtaaactatttacatgtttaacataaaacactctttgattttgataaaatatatttgttagaccataaaaatcctttttagattatgtgaccttcaaaataaagtgttgaatctggaattttatggtattttcccaattacaattctcgaaattctacctttaaaaattccgctaaaacagcaagatttgagtattttcatcttccatagcagttaaagttgcacataggagcaaaataagtactttatgtcagtaattttagaatgctttacttttttcttttttgtgttttatattatacattaccacagacattaacaatcagatttcagatgcgattgtaaaatacatattcaaaatagcagcaagtattgttcccaatgctcaggttggactaaaatgttgaaagtctctatcagagatatggaaagaaacaaatttccaagtttagcccatccgaagtttctatagcactgcagactgaaatgaggcctagccctgaaacaagtgtttcccaacttgcattttcccccgttaagcttacttgaagactcctaatctctatgcactaaagtgggctgctcctcctagtagtccagaacatttaacatttttcataacaagtgaaggaaaagggtttgggaaatagatcttcagttggcaattggaaggatatttcattcattaagaagttgtttagtgctatcaatatgacagtttggtaaatgcaagaaacctaaaagggtgaatgtctttatcagaaaaagagacatttgcataccagatatagtcacaaagtactaactttaataagtagtcaagcaagataccagacattgatcaaagcaccaattctataatagcccactttaataaattacagttgagaagttattctcaaattaaaagaagaaaatttagaatcctgtgacaaatcctgtcttcacttttctgtataccattcattaaataacttaaaattaggtattaaaaatacatgtacatcattttaacaagtaagtctctgcacttttgtccctgtgctagtattagacacttaaaagaagactaagttaatgatccttttagactgaggaaaaaatagaactaatttgaatgaatcctagaaaacgttaaggtttaagatccttgactttttcttgttctttcactaaataggtaaaggatacaattttatttttctacagtagaatctaatctaaaatgtggcaaaatgacattgttgacagttgtttataatccagttaaatgtattttgggtgtatattgaccatggtagcttgaactcaaccactgtaaagtgtctttgaccatgcaatgaacagaaatatttgtcagcagccaagccttggatatcatatgtgaaagatgatttaaaattccaatggcaatacttgacaaggcacaaatgaaagcaaaaataaaggtaaatatgtccaataatgccattggttacaatatctgctaaagcatacatggatttaaaaggagagaatcttaacatttaataagaggctattctacacaatatcaaaaaactaaaataaattaatcataaacttctagactggtggttctcaaacttagcttcacttcaaaatcatctggagcattaaaaaaaaataccagtgtctgaatcttactctcagggattgtttttgttagactgaggtgcagcctgggcgttggaatttttatagcttccaggtaattctaatgtgcaccaaggttaaaactcaccattctaggttttttttctctctctctgcctactcccctttctctttcttcaaatcacttttgcaacatcaacaaaacaaatagctgttgtttgatctttgggcaatctatgtatgatggttttcagctatttttacagctatttttttctatgtaaacaatgtaaaaaatacagcttttttgaattattttaaaatttcttacttataaataaatatgatccttaatgtgaggacaattccattctttacacttacaaagacatataattaaaaaaataaacaacgactcttatagtgtgtattagagttctctagagggacaaaactgataagatagatattcgtatctaatagtatctaatagatagatattagtatataatagtatatatgaaagggtgtttattaaggagtattgactcacatgatcacaaagtgaggttccacaataggccgtctgcaagctgaggatcaaggaagccagtcaagtcccaaaacctcaaaagtagggaagccaacagtgcagccttcagtctatggtcaaaagcctaagagcccctggcaaaccactggtgtaagtcctagagcccaaaaactgaataacttgtccagtgttcgagggcaggaagcatccagcacgggagaaagatggagaccagaagactcagccagtctaatccttccacgttcctatgcttgcttttatccgagccacactggcagctgattagctgttcccacccagattgagggtgggtctgcctctccaagtccactgactcaaatgttaatttcctttgggaacaccctcccagacatacccagaaacaaactttgtatccttcaatccaatcaagttgacagtcagtattaactatagcgtaaattctccttacaaaataattccagccacccaaaatttgtacacctggctatatgatgctcagaaacagcttacttaagtagcttacttaagttttgggtgcttaaatcaaacgaatacgttcttatttagccctgaatgtctggctatgtttggtttgaccagaagtaagctggtgactctggtatcattatatggataagaacactcttcacatgcccttgcaagaattttccaattctgtccctcagctttctcatatctaaaataaatgagtttagcaatgtctaaggttcttaaaaattctcaggatgtacactttattttttcacactcgcaattttgctgtgttacaaaactaagctcatgatgtagacaaagttgtatatcctgattctctcacaactctatgccattgctggttttgagtgttatgcatattgtggatatagaaaaaattaccccccaaaagtcaataatcatgctatctcactacaaccattttgatatagtcttcttcagcaatttttcagttagattttatgcatgcacacacacatacacacccacacaatatttgaaaaataattttgtagtagcaaagatgaaaaatttttgaatgaattaataaatattacaaatagtactaacaccagcaattaaatatttagtagaatttcttatttaatgttataacaaaaatattttacagtgccatacaattataaaccatatttgaaatgctacataattttccattttacaaatgattagctcttgccctactgctaaacatttaggttgattccattgttttaattttgtaaataatgttatgtagaacgactatatatttgcctttgattatctctaattatttccatgagctcacagagcatgaaaatttttaaagtatttttattcatattgccaaacaagtacaaatttaaacttcctctaacagaatgttaaaaatctcacactaaccaaaattgagtactattttttttttcagttgtatgagtgaatgaaggatttacttctaaatctgttttcttcattcttccaagaaactgtatcctctatccttaggccaatatctgaaggtgagaagaatccacagatgattacagactgataaagactgatgtgcttattgcttactgttttactcttttaagtaaagtgaaaatatgaagatatacaaaaatgtaataatgatttcttaaataaataataatggagaggctgggcgcggtggctcacacctgtaatcccagcactttgggaggccaaggcgggctgattgcctgagctcaggagttcaagatcagcctgggcaacacagtgaaactccatctctactaaaatacaaaaaatttgctaggtgtggcagcgtgcacctgtagtcccagctactcgggaggctgaggcaggagaattgcttgaacccggggggttgaagttgcagtgagccaagactgtgccactgcactccagcctggacaacagagtgagactctgtctccaaataataataataataataatgggacatttaaagatcaatttaatattttaagaaaaagctaaatgaaaaatctgagaagaaagaaaaaataataatattactggcaatatgaattaaaagcttcaaaagttttcatactttgaactcatggaaatagaggtgattaattattgcagaaaattattttcattttttaaaatttacttaagttttattcataacttgctatgaatgtactgattgtggaagatatctttcctggaacacacatcatttctacaattctataagggactttctcatacctccaaagataagaatgaagatctgcctgcctaccatatcagcctgtgtaagagaaactaagttaactctgcctccctggactcaaacgacaacaacaaccgcaaacaaaccaacaccaaaccgtatttttttggttttgttttgtttagagatggagtctcgctttgtcacccaggctggagtgcagtggtgcaatctcggctcactgcaacctccgcctccggggttcacacaattctcctgcctcagcctctcacgtaactgggactataggtccctgtcaccacgcccggctaattttttgtatttttagtagagatgggatttcaccgtgttagccaggatggtcttgatctcctgacctcgtgattcacctgcattggcttcccaaagtgctgggattacaggcgtgagccactgcgccagccaaaaccttggtatttttaagaaaaaatacatttttggccaggcatggcagttcacacctgtaatcctagcactttgggaagctgaggcaggaggatctcttgagtccaggagttcaagacaagcctgagcaacatggcaaaacgaagaaggagaagaaggagaagaagaagaagaagaagaacaagaaggagaaggagaaggagaaggagaggaagaggaagaggaagaagaaaagaaggaagaaggaagaaaaattagcctgatgcagtagcatgtacctgtagtcacagctacttaggaggctaaggtaggaggatcaattgagcctgggaggtcaaggctgctgtgagccatgatcaagccactgtgctccatcctgggtaatgtagcaagaccctgtttcaagaaaaaaataataataatatattttagttaagattgtattcattcaaaaaaatccttttccagagcaaagaaaccccaacttaaaatttaactcattttatactgcctttaaagtgctaatctagcacattaaaacctatcacttctggttgccccatgagttcatgagtctaccattagccaattaatcacattctgtcctcaacaaagtaataagatatgtcacttaagaaataaagtttgtccagcctagcgaacatggtgaaatcctttgtctactaaaaatacaaaaattagccaggcgcagtggttcacacctgtaatctcagcactttggggaccaaggtgggaagatcacgaggtcaggagttcaagaccagcctggccaaggtagtgaaaccccatctctaataaagatacaaaaacattaacctggcgtggtggtgtgcacctgtaacccagctactcaggaggctgaggcaggagaatcacttgaatccaagaggcagaggttgcagtgagtgaagattgcaccattgcactccagcctgagcgacagggtgagactgagccaagattgattgcgccactgcactccaacctgggtgacagagcaagaccctgtctcacacacacacacacacacacacacgcacacaaagaaaaaagaaataaagaaataaagtttgtaaagatatagatttctttcttataaaataaaattttttcctagatattcactccaaatcaaacactttaataaggaagtttttccaaaaatatacagagtccatatgtttctaatgttatttaagttaaatgaagaacatatattttaaccataataaaccataaataaactatagaaagaggatagagataaaattgggcaattttcctctgctttacctctcctttttttttccttttaagcaataaaataaaaataaaagtgactttttgactatactattattattcttttctttattctcagatttatcttttagttttttcttaaaatattacattggtctgggcacggtggctcatgcctgttatcccagcactttgggaggctgaggtgggtggatcatgaggtcaggagatcaagaccatcctggccaacatggtgaaacccacctctactaaaaatacaaaaattagctgggcatggtggtgcttgcctgtaatctcagctactcaagaggctgaggcaggagaattgcttgaaccagggagtcgaaggttgcagtgagccaagatcgcgccactgcattccagcctggagacggggcgagactctgtctaaaaataaataaataaataaataaataaataaataaataaataaataaaataaaataaataaaaattaaattgtcctttaaaatctcccactgtttcttttttttaaaaaaaatcattattacatttttatatatcttcataaggaccttggaatcaagatccattttttaaaatagtaaaacattatacaataagcacatcagtctttaccacactgtaattatctgtggaatcaatttttctctgttaagtatggtagagcccaagaaaagttgggcttttgttaggattatggaggggattcactgcatagagcatatgttggagagctggtaatgcctttagtggtctaagctggccatcctggctccatttctgatactgagaagtctgtggttgaggattagtctcagatctctcacacttcccttgattatactgatgcctatgcataacatttcacatgaaaatcccagtctctgtcccatcgctcacagatattaatcagttgtactagttcaatcaggatttatgtatcagcacagcataaccctcttactctttaagatttgtcatcaggcattaggaatttccaatgggggaaaatgttttcatagagtaagaaagacactaaatggaattttagtgtttgggagaacaactcgttatccaactaagctattaaacctatttggcttagccctcttaaagcataaccctttaggtttgcctaaaaggagaaagaaaaggagaaggtgacatggtgctggaaacaggcaaaccgtctctcctcttttccccactttcctctctcctccaccccatcttcccttccaccttctgctccacaagctagcagacagcaagacaggccggaaacttgaaaactggcagaacccaccaatcagaatcagggtactgcatactcaagtgataattattcagacagtcctgcattgtttacaaacacctgcccctgtaccaaatgtctaatgttctcttttgattcttgaacacatttacaattcactttttcttagaacttgtgttctgttaataagaaagatatggttttattttatcttgtaagaaactattttttatgcttgacaagctactttactatcttatactttctgccttgtaatatgaagttggaatctaaaaaaaaagcccccaaaactttcataacttgtttttattatgaacttgcttttattatggcacaatgagcaacttctaaagctagtgagtttcccatccctaaaaggagtcaaaataaaaggccaaattaccttagtgtaaggatagttgaacatggattcttaaattcagtagaaaactggactaaattgtttctacattttatttcaactccaataattcatttaagccacctattttcaaaattgtttgagataactttcaataaaatatatgtggttggtcgattcaagtggaaattgaaactacaacttctgagaactcaagattataattatgtctaatataaagtcttattagaagatataataacgaagcatacccagctaggcagagttttctaagcttattcatacattctgaacaaatttgccaaatatgactagtgtcaacagactgcagattttagagccagttgaatgttcctctctctaaaagcaagtttagtttgtttctcgctttcctatagaaaccttattgaaatatttagtatctgagtttgatggttttatatcataggacgttcttagcagacagtatcttgcacccagtaggtagtatgtgtaagtgtatgcattgaattgaatatcctagaacagacagtccttatccaattctgtcttcaaatgtcttacctcattctgaagaatggatataaatcctgatgaagtcctaattagatagtaaaagagggatagaataaaacaataatgagcacagatagcaacagtctagtgcctgtctgtttggagagaagcaatcttccacctacattattttctttacagatgaaaaatgtagtttgtagctttagtgttatgttcaaataaagattagggaaggtgaacaggcagcaagctaattgcctggaatctaaaattggtagatcttaataattttttttttttgatggagtcttcctcggtgcccaggctggagtgcaacggtatgatctcagctcactgcaacctgcacctcctgcgttcatgcaattctcctgcctcagcagcccaagtagctgggattacagacatgcaccaccaaacccagctaattttttcatatttttaatagagacagggtttcaccatgttggtcaggctggtctcaaactcctgacctcaagtcatccacccgcctcagcctcccgaagtgctgggattacaggtgtgagccaccgcaccgggccaatcttaacaatttaacaaggtgcaaatgaaaaagaaagaaaaccttcagtccttttaatatttaagggtaatctatgtcactcttcatctacaacattcaatggaattgcttccagtcttttctcattagattttttcagaaccttggcctgtggtcactctgagccccagttccacagcagtgttaatcacttcctcctcgctgtccctaaaagatcccaagacctctccattgtgattttttttaaaaatcaagtaacccttctcctactagcacctcttccattttcctcctttctagcaaatctaaacgttcccaattaagtttttctctccttttttttgaccattatatatactctcctcattcttaatattctatagtcaaactgtgctctccttctgtactgataactgttttaaggacacaatgatcatttgttgattaaattagtggttgttttccttcaacctcctgctgtgttttctactattggccgctttctgctcacaccacaccttagattggtgtagaatttgtctgctgcaaggccttaggtctctttgaagtactctgactacccctcctctgcctctttctccatcctcccattccataaagtgggcttttccctcaagatatagacccaagcaaatctttaaacaattatacaaaaatatattctaagatatataattaaataattctccgctgataccatctcttcatctcttggtcagtttttgttttatccttgggcccaattatggcccagcaggtattttattatttatatcattcatatatttttcttcctttccagtctcatttttagctactacacacctatagaactctcagaaggactttctgtagtttctttagcttatgacattagtttctcatcctatctggtttgcattgctctgtgtgtgtgtatgtgtgtgtgtgtgtgtgtgtgtgtatgttttatgtgcacatatcttgtttcctcagcttccctatcagctcctgaaggacagaaagtatattgtacacttacagtgtaaccagtagttctggcagagtctcttactcatagttaagatggtatagatacttgtaatcacgaggttagtggataagtactcagtcactgtcaggagcatggataaggaatacagcgtagctctttatccattgtttcagatctccactcagaccaacacatcctacagagcaggacccaccgacacattcatcgccagttttgctaattcttcttgatgactattttcatttctatcccaaatttctattcaaatattgattttttcctaatgaattttataatgtggatataatgttagtcagtttttgaaattgaacaacaaattgttgatttggagcatgtatatgtgtgtgtgttttatattagtttgttagagctgacatgagaaagtaccatatactgggtactatgaaaatctatttcctcacagttctggagaaaatgcagagaaattgagatcaaggtgtcagcagagttggtgcctgtgaggtctctctctggcttatagatggcggtcttctcccagtgtcttcccatggccttccttctgtgcctctctgtgtctaaatgttctcttcttataaagacaccaataatattaaattatggtcaccttaatgacttcattttcacttaattagctccttcaaggtcctttgatatctccaaataatcaccttctgagatacaggggttaggaattcagcataggaattgtggggggggggacaaaattcagcacataaaatttaagtagcaaagtaattgtgtgaaaaaaagcaatatagaaagagaagagagacattaaactttgaggaagaaaaaaaagaatcacaaaaatgtaatcagtcatccaccctaatgtctgaagaattcagcagggaaggtgtcaaccacaggacatcagggaggtcacgggactcaacactgccatttcagtgaagaaaaggaagtagctaatgtatccagtgaaattccaaagggtgttaatcatatcagtttttattcccttgagaaattctcttgaaactgaggtaaacatctggaatgcacaattgacagagacatatggagctcatgctgtaataatataaatatgctttctatcctctttgggggcataagttacattttgaattatgtcatcacacatatgctgcccttgtgtatcagcagtttagcattacatgcagatctaaaactgtccctaggcctgggtcatttattgattgtgttcggtcatggtttttactgatcatttctagtctcacattcaggtggctctttcagcgcattttaaagtttccttgctgctatccctgctgttatttcttaggtgactcatgttgtaattttccaaactgactgtcttcacagtgagaggaaaagcattcacgcagctaaaatggattttatgttcaatgtcattctaaactatcagtgaaaaaaagttgaacaggttagcatttgaaacaggtacatggggagcattataaaggggctcatttaggaattagctacctgcagaacatcttcatgtcagaaagattcctcgaactcacagaagcataatgggactcacagcaatactaatccttagtggcaatcctaaatacatggacccactttctgccatatcactatatgtgacattctgcagactgtgcacactcacgtgctcacgcacacacacgcatgcgcgtgcacacacacacactttgggtgaaagatgcaatattagttaaagcaaaaaaaatcataaaatatgcaattgtattgggtttgtaaaagaagaataccttattaattatcatgattgacattgaaatgaccaaaaaaattcaacagtagaaaaagaagaaaaatagggaaacatgattttttcagtatatttgccttaattagaagagtgactttttccaagtggatgatcattctctctttggggtggtggcatataagaagattgagtttagacagggctttttctaactctgaaggcatctcgtagttcctgacacacacttaggtgtgcctctcttcttgagagttaccaagtataataaaggcattactaacacttgctttttgtgcctaaggggagtgtagagacttttttttttttaaagaaaatctcctgggaaatattatatcacaaaactcacctctgtgaacaaatgtctttggttggatgattctcaaggaaatgtggacggaagaacagaggcagagaaacagaaggggatggggggtggagtgtgggacaggagatagtgaaggtaaagaaagtcatcatggttgacaaaggagtttgatatggtctgatttgaaattctttaagcagatgagaaaagggaggtgcacaaacttacatacttcctaggcatgtcttgggcagacagaatgaatagaggaaagaatgcagagaaacatatggtgcttggacatagtagagaaagcatgggtctgaattcaggtagataaaaagagcatcagtttgcaccatacattaagtaggtcagagatcacacattaggtatcaaggggagaaaagagagtaggaaataagtagagggcaggtgtcatccatataaataggtaaagaatgaattccaggaagcagggaagggaatcaagaatctgggccagggcactaaagagaaacaggatcactgacacatctcagtgctcagctgtttgaaccagggacctgtaccaaaagtaatatttgaacgcaatgataatgaatcttaatcctgtaaatgatcatctctaggaaattagatgatctttcctggtgtctgtgagccaccattgtctattcatttagtccacattaatgagaaaattctccaggtttcaccatggaaaattggcagcttttgaagattgatccttcagcagtcatatggctcagtccagctcagtcagtaaatcctgagctcattctcataatcctttctcaagaaaaaatgctacggactacttgacttgatttctatagattgttttttctatataggaactatgtggtcagatttttataaattttaggtatcatacaatataaaacacacagtagctgtatactcacacacagacacacacacacacacaaacacacacacacaggcataaagtacagatggctacagaatgatgataacattgcaccttcttatgaaaagcgcacccatatgtcctaaagttaaattagtgctatctaatgatgtttgaccctcatgtattttttactgaggtcttttgattctcatttcctccatttaaataatgaactcctcttgtttttgtcaaatgacaaaaaaaaatttagtcacacataaaattcatcaaaatctttgttcattatcaaacttgtaagataaggttaacattattatcaaaaattattataaaggaatcctgtattctgtaattgatcttgcatcaaaaattgacaggcacaaatgaaggatttttgtcactttaagcaagtaattctcccttttctttactgtatgagtccgtattcttgcacattttgtagactgtcaaataagcaaagacactttattagtgatttgcagcattttattgttaagattttcactgctttctcaacggtttcctgacttgcagaggatttttttcttcttcttctcatttcctaccagtgtagcattttaagtaggtgttataaatctctgccaaaggcacattcatagccctgcttgaatagtttcatttagactagaactacccttacttttcaagtcccttcaagatctttatcatagtgaaataacactttgttttcattaaaggataaagcacaactttataaaaagcccccaaagtaacgaatacagaagatttctttaatttttggagtagattcaatattaaatcttattattaaattaattttaaatgtctacttgaaatccaaatagggattttaaattattttttaaatacagaaagggacatgtatattaagtatattttaatacatttactattttagctctataaatcactcttgatgactgcatgctgtaaacatttttcacagaggcaaacaaaatgctcatgtcttctttggtaattttagtcaaatgtgctctaatagacttgtgacaagtatgtttttccctaatccaagacttctaattcaggccacaaatattacttcaaaatataccaaatccagcagagaagtatattgagctggagtttccagaagggaaaagtggagatagaaatctttcgcaaattccatttacaaccttgccaagtagatgccaagaatactaatctcttgaaaggtgtcataacttttcaaaattttagccggaaggcagctatatagtattcttcttgatctgtttcatgatcagtcagaatggtttattcatgtggttataagtgaccagggaacacatctcctaatgacttacaggattttttttttccagacgaatagatttcctaacagatatatcttttggggaaaaaaaatcaaatgtatcagacataagatgacctttctctttcaacatttcttttgtaacatcagtcactctgttctcttcatataatgatgaaaaaccaccactttcagttttataaaagcttctatcttcacaatgagccattttcataaagcattacactgcctttaggataaatgcatgtggtgcgtgttacagcccctactgtgtgctgatgcatttattctttttgctttaatttttagtgtttcaaatgatagaaaaaaataatataatagcgttcataaattcaacaggcacctcctacaggttttgtggtagaccctaagatcacctgaagtctggaacctatgtttagaatcctggggtcttttgcttatacagtatgttataaatatgtttatattcatgttcatttgtaaagcctaaaatgtcagtcagtgaaaggaactctcttcacccagtaaatgacaaaactacctgtttttatcttaatgcatgctcttctctcctcagttgaatatttttacagatataattcgtaggatatgtttctgtggtatttatgtaatacaaatttacattatatttaattaaatctttacccaaataaagtgaggaattagtggcatcccttggctttatagtctaacaggtgtgtgtgaggtttaaaagttcctatctcattttaactgatattttgtaatcctaaattccagaattaaaatactatgaatgattttatttaccctttcatggggcatataccttgatcattgatttttattgcagccaggaataatagagggaggcaactgtgcagtgtgtgtgtgtgtgtgtgtgtgtgtgtgtgtgtgtgtgtttccttgagtgggttgctcagacaagaatctaggatcagaatctgagatcacctactttgaacccataatcttgaaatagaatctaatggaaagctgcttgtagaaagataagcagagcactattcaccctgctgtttactggggaggatgaaactcgattctgtttcacagctgcatttactcccacctcctcctgacatctgtgggctaagggaacacaagcttgtgaagaaaactgtgttcagtcaccaattacaatgaaaactctaaaagagggtggaggaaggaatggcaaaataggaacaggaacaggacaggaacaggaagaggactgaattaattttattccattgcctaatgtatatttttaaattttccttatctgatttctttaggcttgggacataattgtccacctgcccatctgacagaattttactcaataaatgcctcatatagccatgtcttgaggtttcagaacatcatctcttgtgctaggttgaataaaccaaaattactccttaccatggaaatgtgtgttttcataaatgaaagcaataaaacattaaccaaaaaagccagaccggaaagatttttctgaggacacaggtcaaagtggacaaatattatgtaaccctaaatttggagctaacacacgtttattattttacaaagctgaactcagtcatgcaatagctatagactccatctttctaaggttagaaagtaggtgaatataaataggaataatagaattataagtgaatagtagaattataagtacaccagaataaatgtgtactaggatatgacagattcaccatgtcaaataaatagcagaagtgaatgataagtatgcaaaacacaagaataaataaaaatttaggcctaaaatttaatttttaccattcttacaaaaaatacacatttaatagacaataaagtatacacaaatatattaaagaatttggtaaggtgtagatgttttttaaactttaggatcaagaacacttggcatccatttattataagtgtaagacttgtcaaggagacagacagagtcgctattgaagtcctttccagctcattgagcctaaaacccttaaatgctgggacaaggcagctggcagtaaaataattttaatgatcattaactttgctattttgatgtctattttaatataccaaatttgtcttttatgagttcaatttatttttaagtaatttattctctaggaaaaataaatgccatacttttttaagtgaagaacagaaatcttctttctatatgaattctatgaatgaatttatcatatctggactgagactttgggcaagtctcctaacctcactatgtctcagtttattcctatggaaaatggggttaatggtagtgctaacatcataatgttgagagggaacctgagttggaacatgtaaatgctcaatgaattactattattattattgccactttatgcactttcagtcagaaacagagctctaaagttcaagtcttgcttgtattccttaattttcacaaaggctcgttatttcctttttttgtttttgtttttgtttttgtttttgagacggagtctcgccctgtcacccaggctggagtgcaatggcggcgaactcgatctcggctcactgcaacctccgtttcccaggttcaagcaatcgtgcctcagcctctcgagtggctgggattacaggtgcatgccaccatgcctgcctaatttttgtatttttagtagagatggggtttcaccatattggccccgctggtctcgaactcctgacctcaagatatctgctcactcggattcccaaagtgctgggatacaggcgtgagccactgtgcctggctagggctcttaatttcacctacttcacagtggtttgcatctccctttgatcagtcataaaaaagatacagcttcttgccagaaattgcatgccccaaatccctgctgttaatccttaccaaagtctgattgtggcaaataatattaataagaaattgaaactatccattcatttattaggggaattctggatgtaagggatgcgcttccaggagtgaaaatgtcactggattttcagatttacattttctttcattaaatatattgcaaatgtaattttgtgtctgtatttttggagagagaagttccaatcagagctttcatctgattctcaaaagaatatgcagtcccaaagccacatcttttgtgaggcattctgagtattctaattttatcctagcatcaattcaggccctcagaaaattatatatatatagctgtactggcttgttcttttctagaattttttactgaatcacactttagtgctatggatttcttatctagtttcagttgtattcattatgtagatccttgtctaggataacttgttatgagaacttcatcagagaattttttttatgtttcagtatcagagaaagttatgaaaaactgtcttgtgtttatcttttagatggttgaatattttttttcttgggctgctagaaaatctatactgcaggttttctgtgttaaccttattctggattaattatttttcctactatgataatgcttcatctcaatttcccacacattttctttggaaaagtaaaaaattagtagcttttttcccagtatatatcacccaacatgttcaatgtctttcagtaaagtaatgcttcaaatttcaacctacataatttgaattagaaatgaaacaagtttttacaaatttggtgaatgcttatgagataattggggatttggggtttaaataacatattggtacattcatagtttgctgtattctgaatcagtgttcactaagtatcatcggtagtgaaaaagtggattggcctacagaaagaggcaatatgatttcatagaaagtgtcctgctcatgaaattagacttactctagtccaagctctgcagattcagaaagaagtttatcctctccgtggctagaagataataacaccactacacctattcacctcacaagactgtgttaggataaataaagtaatgcagtggaaagtcctgtgaaaggcactatagaaatacaatgtgtttatacccataatttgaagtacatgtactcaactaccttgcttcatacagaatcataaccatgctcaaccttatacttttaacctatggttaaagagctctcaagcaatataaatttattcagtccattcagtctccttttactacctattagttatataatattgggctagtctctgagcctccccattcctcaatcttctcacaagcttgtgaagaaggataaataagataaagcaagtaaaagtgtggtacttgccactatgtgtgaaatacagtaaatcttggccattattattaacattaattccttcgacgtaatagatgttacaaatcaaaaacctatttcattaagtaaaaaatatgtacactatgtgcaaatggttttatagaatagcaactggtggctgccaagactttataaacaatatttaatgagattctaggcgctgattaaaatgtaatgaaaaaagctttaatgtaaatattgccatgctaggtatcctagtcacccagttttagtttaatggcggtggatgtagttgagagcctttagtgaggcagccgctaagtgattgtgctgtctagtatgtttagtcaccaagtgcaggatccagccacatgcgacaattctgacaaaacaccatcctgcaatagtagagacatgttttgtttgtttgtttgtttgtttttctctaacataaagaagcaaataaggctgggtgcagtggctcatgcctgtagtcccagcactttgggaggtggaagccggtggcagatcacttgaggccaggggttcgagaccagcctgtccaatatggtgacaccccatctctaaagatacaaaaattagcgggcgtggtggtgatcccagctactcaggaggctgaggcaggagaatagcttgaacccaggaggtttcagggagccaagatcatgccactgcactccagcctggatcatagagggagactctgtttcaaaacagaagaagaagcaaatagaccagaatgctctatcagtctatcaattaattatacaatatttgaaaaagttttctttgacaaaatgtcttataaagtcaaaaaagcacattcgtctttcttcatcatgcatcagtgtgcatgcctcagcctttgttcacagagctctttgctgcacgtgtgacctggttggaaacaagttacacagattgtaaagactagtaaatatcagggtttcttggcctaataaaattaggttcatttttatctaaagaaaattaagatatacacttagagtgctcacagtgctactcaaaattttcactagtcttcttttttaatacatttattttatgaaaatatttaagaattttaatatctggtgggatgacaatataatcctgataaacactcttcatgctcatattttataggagaatagagagatatctgttgtcaaaacttacagagaaatatcaaacattataagcaaacagtttttgttaaaatgatcacaaatatggccaacttgaatatcagcaaaatatttgattctataagaacaaatatcaaataggttcaaaaggattctatgaaaaccctatttcgtttagctcagcactaacacaaaaatgaaagaaaattttgtacctatcaaatattctttctcagagcagacgttggaacccaaataagatgcagtatgtgagagctgatccaatcacatactaatttatctcttcattgtttctaagaagtacttgatttagggtagaacaacctcctgattgattcaccgaacagaattgatttcaaaatgcacattcaaggagctaagtaaatttccctaccagatgaggtcggtctacagacattgtccctgcatatattggaaaagaagattatcacagaatcctatcaaaaataaacttcctgtcccttcccactgttattaagaccaagccaagcagttgactatgataggaatgccacctcctagctacaaaccgagctaatagacaggtaagaaaaattcatgcaaacaattttggcagcaagagagctccccaccatgatgatgattaatgattgttctatggcaataactttattggactccgaaatggaatgatggtagaatatatataaacgaccatgcataaataagcaaaaagtgtaagcagaccattgtccacacctagagtacaaatatggccccacagagagcaaagggtagttctctaatcccttacccacttcattagaaggaaatcaatccttttgctggaaatctggcccttcactccaattatccctcaaggatagagagggtacgatttgtcacatattaccagaacagtgctgaacctctactcagatgacccattgaccaccatgtcctgctgcctctgctggcctgcccagaccagtacagcctctgccaaactgccagaggcttggcgctcatctctgtaactcaccagggacttatgcctctcataaccaggtaagtcagagagcagaacttttggaactctgatacataaaggtatgatcccagggatttccaaacctcattgaacatcaggatcatctgataaactcttttcaaaatagacttagagatctcatctccaactgaccaaatataaagttttaagagtagatttcatgaaatctgtactttgaacaagtttctcacagtaaaggcacacactgaacgcacaagtagttattaagttaattcctaggtagatagtggaacccccttgtctgtagcatttcaggttgctttcacaaattaccatagactgggtggcttaagcaacaagcatttatttctcacagttctgttgctgtaagttcaggatcaggatgccagcatggtcaaattctggtaaggaccctctttcatgttgcagactcctaacttactgtatcctcacatggtagggaatggactagagaactctctggaggctccactctcttgacctaaattactgcccaaaagcctcatctatttcaacgtgtgaattttgtagaaacacaaacttcagtccatagcacccagcatacagattggcattgggaaatcacaaatgccacagctgttttttgcctgtggtagaacaacaactacttccttgccccaaacttactgagacagctaaagaagttcttaagcattcattacgagactggaagccgggtactgtggctcacgtctgtaatcccagcactttgggaggccaaggtgggtggatcatgaagtcaggagttcgagaccagcctgaccaacatggtgaaaccccgtttctactaaaaatacaaaaattagctgggcatggtagcgtgtgcctctaatcctagctactcaggaggcggaggcaggagaatcgcttaaacccgggaggcggaggttgcagtgagccgagatcgcgccactgcactccagccttggcaacaagattgagactccgtctcaaaagaaaaaaaaaaaaaagagagagagagaatggaaatcgatgtgtcataagtacctagcattagctctacagagacatgttgcctaagtctcttccatcccaagcatcacatgcatccatctcagttctactaaaatccatatgtaggccgggtgtggtggctcatgcttgtaataccagcattttttggaggccgagacgggcaaatcacttgaggtcaggagttcgagaccagcctggtcaacatggtgaaaccccatctctaccaatgtacaaaaattagccaggcgtggtggcacacacctgtactcccagctactcaggaggctgagacatgagaatcacttgaacccaggaggtggacgttgcagtgagctgagattgcaccactgcactccagcctgggcaacaaagtgagactgtgccaccaaaaaaaaaatatatatatatatatatatgtgtatatatatatatatgtgtgtgtgtgtatatatatgtatatatatgtgtatatatatgtatatgtgtgtgtgtatatatatgtgtgtgtatatatatgtgtgtgtgtgtatatatatatatatatatatacaccagaacttttaaagaaattaccgtgtcattgctaatatctcaaatactgcattgggcttacagatagctaagtccaaacaatctcaatgatatttttaatcccatttttgagggcccattgtgtaaaaataattgaactttaaaatgatggactgagtttttctttaagctacactgtgagttcctcaaaaggtgaaactttctataaatagcagccagcacataaaagacactcaaataatatgagctagaaagaaggaaggaaagcggaaaggagggagggagggaggcaggcaggcaggcaggcaggaaggaaggggaaatgggggaagggatgagggagaaatctctgagtggatgaatgaatgacttcattaatgttgaccttttatttgccgttttgttagtgttaatgaaaccagaccccaatgttttcagcctctttattactgtgatgtcaaatgaatttttccaggtgatctttgttttgataagggcaactttgcccttattttgtttacttagtttcactgtatttctcaaaaatgtaggtaaggatatatccaatttttgtaagaactcttttataattatgttaacttttgggcttttaaaaatgaattaaatattggcccatcactgccagattgttacttatatagataattgtgataccagccaatgtctgcttaaaaagtaataaagcaggaatgcatctgctccagaaatatgagggatcagtttgtgtaactgtatatgagttaaatgttaagaatttgtgtaattgtatatgagttatatgttaagggtgaaactaacattttatgttaaagttatttaaaaattgtgtgtgttgtagagcttgttatgccagtttttgttaaaggaaggggacatagaaaggttcttaatctccgtaaagttgtaccaattgtatatgccaaagacagattttgaactcagtgtgtttgatctcaaagcatacactctttctagataaatattattaggaatctggatcagcattgagaagaatattcacaaatgtctggtaaataaaatctatctaatagtacctgataaatatttatcacatcctgttacggttaccatactgttagttcctgggtaattgttgtatactaaaaaatcagtaagattcagtgtccaccccaatgaagttcatggtctacatggaaaaataaaacaagtgcacatgtgattatactacattgtgctgagatctgacagaaagataaataatcctcgttaacatatttttactaattctatgtgcgaggcactgtgctgaagaatatatatcgatttcacaggaaactcagaaaacttagacttgaagacactaagtgactaatctatgactgaagctcaaaatcaggacatctatttctggcacacttaaacttaattactattttatatttcttcctgggttacaaagtggagtacagactggaataagggagatcagttaggttactacaataatcaatatgaaagatgataaggacctgagctaggaacggcagccctggtggaattggaaatgaattagacaaaagacacttgacagagagaaatgagcgcattgatgtctgattggatgtagaggaagcaaagaggggtattgataaaagatagggaggagtcaaagataaaagtttctagtccaaacaaagaatcgtctgtgttttaaaaatatattccaagaagaaatttatagggaggagaaatgggtttaattttttatatgtttcatttaaataaaagatttcatggattcaataaattagtctttctaatcagttaagactcaggaataaaaataaccgaagacatatatggctagaatgtcagctgatataaatgctatcagctgtggaaggacagatatattatttaattttccttaatgaaattctgaatggccaattaaagtgcatcccttacaagggtcttacatacttgggcatgcagaactttctgaaccttaaagagctctacaattctaattacaccatgactaacaaagatgtgggaaacatcttttgggaaagtgaaacaacctaagtgattcccatcctaaagatcttgggagagtatccccaaatccactattctctttgttttaaattgtatgcagaagaaggctatttgggtaatatacatatttaggaaattaaggccctagtcagtcttgtttcctgagttgacatgttatcttagaaaacagtctgtgctaaattgccacagctgtgatttaggtatcacagcatcagccttctgtccctagggtactcttctttaagtcaaaagtactatctgggcctggagtgggagatttgtttgcagattctaaaaaccgcctccacaagagcatttagcctcccctgaaaaatgtgacttttccttcagagagacaccattaacccaaaaaaactaaaaaaaaaaactaaagaaaaactaaaaagaatgaaaattaagaactaagaacaattaattgttccactgaacaattaagtggtttcaatgaggaaaagtcaattcattctttatgacttaaaatttaatatcatttatttttgtgtaaaaaatcggtagcatcagtgggaatattagctctaatcctacaaggtagttccttttactattgaataatggaaatatattactgctcaatgtttaatgcacttaagtggcaactctatatttgtattgttagattatcattttatatagggaagaaacatggtttatgtagctcttctttatataggattgctagatcatttgataatggtatatttcatttaataaactgccaaactattttcccatggcttccatattctgcatattcacaagccatggaggagttttccagttgcttcactctcttgtcaccacttagtattatcaggtcttggtggggcagggggggcggggcgggtggcattggtttgtttcattgtgttttacactttagacaagtagtttttcagatttttcactcattttaaataattggattgtttgttctgtttttatggtgaataaagttatttgtattgtctgtatacatttctttattgcatattctcttgcaaatgttttctcccaatctgttgcttgcattgttactttcttaacagtcttttaaagataaatgttttaattcttaatgaacatttagataggcaaataatccatcagtttttattatgttaattgatcatgaatttactgtcacatttaagaaatcttttactaatcaaggttacttttgtctgtgttttgttttaccagttttacagttttatgttttacatttaggtagccgatccattttgagttaaattttgtgtatgatatgatgtatagattgaggatcactttttggaatgtgaatgtccaattgttccagcactatttgttcaaaagattatcattttttattaaattgcctttgcacctttgtagaaaatcagttacacagatatatatggatctatttttaaatcgtggttggttccattgatatatttgtctactgttttgccagcactactgtgtcttgaatactgtagcttcataataggtcttgaaataagatgaattctctaaccttcttcttgttcaaaattaattctctaacattcctcttcttcttcaaatggattatttgcctatctaaattaatttttggaataaaattatttgtctcaaaaaaaaatctgctgaaatcttttctagtattgtattaaattatttgacaggcttggggagttggtattttaatggtactgagtcttccagtgcacgaattcagtatatttctccatttatttaggtatttttttgtttcttttattaatgagttttgtgtttgtcaacataaaaatcttgcacattttgctacatttaaatttatgcattttgtaattttggtgctgtttgaatattttttaaaagaaattccaagtgtttcttgcaagtatacaaaaataaaattaataattttcattgtgctaccttgttaaactcattagttctaatagcttttttgtagatttttgacatttttctatgtagaaaatcataaatctgtgaatacgggctattttatttctttgtctttgatctgcatgcctttttatttccttgccccattctactgacctccagtaaaatgatgaataggagtagtgagtgcagacatttttgcattatttctgattacaggaggaacatgtttttctttcacagttaattatgatgttgactctaagtttcttgtagatattctttttctaggttgagaaaattgccttctatttctatattgctgagagtttttatcatgaaagaaagtgaattttgacatttttccctgcatctagtaagattatcatattttctttttttaatttagtctattgaaactggattttttcatttaaagaacttagtaagagtccatactggataatcacaagataaatgtttcatgggagaagatggagcctgtttccagaggtttatacactatatatttatggaatgaaatcagacttcaacctttcaatgacactccataatccatcccttgtatatacttaggagacagataccaaaaagcttttttagtctctgtaagtcttaaagaaattcatccaaatattaatttattaataatttagttctgctctttcaacttcaaaatttagaatactaaaattaaacacagtgccatcaactcttagagttactagatgtgtaaaatcttaaaacgtgtctcactagaataagttctactaaaacccaacttctgtggacagagtattagatatttcagaatgccacatttccaaatggaccttaaacttcattaacttttaacttcagttaatctactaagtgtccattcaaaagaaagccaacagactgtgaaagtaagtttaaaattgatttttcaaaagaaaagggacaaacaatgatttgtctaattaccggatgagcatcattgctcatagtaagacatcatttgcctttatttattagagatttggggaaattgattataaatttccttggtttttaattctaaataacttcatacatgattttcaaaatttgatataatatgctgatataggaaatatgttattgttgtttatgtattatatcaatgaatgtttgttaactgaacaactcaatgaatcagtaaatcaatggtcatgtataattttttactgataaaaatataaataccccattatgtactatacattcctaatttttatttattcctaattttactgcaacactatttaagttttttatttgtatattttccttaggattcactctttatctgatgagtcagataatatgttttaataacagttaataatcactataaacatttcttaaatttttttctgtgcaaacccttatgctaggtgctgagaagaaaaagataaatgaaacacagtgtataccttcatggagttaatatgctattccagaggggtgattagatatataaataagagttaccatattgtaaacaccttaggagttggtactatattttatttactcatatttctgaccattgtgctaaaccaatgcttaccccagaatgcactaacatgcttgatgctgcagtgatagaactcttaaaaaactgggaagggaacacaagggagccaatgaacaattctttatattaataaaaagcctgttcagaggaaataacattttaactgaatcccacaggtggaagaaagatcgaaaggacattcaaagtagaatagcataagtaaggcgttttttttgtgctaaggaaagcagttttgaagacacagctgactctatcatgtaggtcaatggttgtaaaaactggccattgtttataagagttaatcgctggacagcaaatcaagatttagccttctctacaggaagtgcaggtggcagctaaagaagtctaactctatgttatgttgcatattttacaacatgttaaactagcatcaaatgatttgagagttgaccttgaactactgtgacagtcctttagcactgcaaagacaccctgaccaattctttctacctctgcccacaaaaatttgaaatttagttgaaattgtcaactaaaagcataaaactctctacccacactgaactacactatcccttagaatatataaccctttctcacctagctaatttataggttcacctgctcacgtgtgaggccaatatagaattccattcaatgatttttgcaatttgatcagcttgaagatgtggataaaggaaatcttcaaaaataaaactgtctagtgaagataaaagcatataatgtaggatctgcagcagcagccatcattagctattgctcttccctacgaactgaaaaaaagctgcagacttccataccaactgacagaatgattgcttccatcccaagcctctgtggtgcagatgtaaatagtaaagtcatgtaaatagcattaagggaaaatttcaacattctctacatttatcacatttcctcattttagagaattcatgagtattaaatgggttattatgaaaaatgttcattctcagtgatcatcagagtgtggcgaaattcatggtgatgagattaatgtctgttacctctgttttttccacaagtgcaccactgagctttagtgtacatttttcttgtttgttttcctctttgccattccactccagtcacacaggcttcctgcaatcatctattcaatatgcctggacagaggtatatgatgtccagttttctatgacccaacgtcagcattgggaaaccagttatggcgatgctgagcagagagagggattcatgcaggtaacccagattaggacaccccctttcaactacagcaataaaactaaaatgttttatagtatttggagtttttccttaaaattatagagtatcaatttataacctaaaatattcaaaagaaatgtgaagagaatctcctttagaaatgtattcagcctcaagaaataactacttcaaatctcttgaggattgaatgtccaaacttcagaaagacattggctgagactgttacatagttttcactttcttctccagttgtttctgtggatacattttaaacatattcttgaaataaagtagagaagatagcaataaagactcacatacagaagcagttcgtgagagtaaatgtttattcttagaaatctatcgaaatgttcccttctactcctgggacaaaggtgagaaggaactcaacacaaattgtgtgaggaattcaattattaaactagatggaaatgctttaatacagcacaatatttcctggaaaaatattatgtagccaacttatggagcctgatataatagaaataacactactaaataacacaagtaaacggaatgaaaagatctaccttactatactcattgacatgtgacctattagaagttacttaaatctctgattcttcatcttttcatttataaaattaaatcatagtagaacatagtttgctatttcatggatttctatgaagctcaaatatagtagtaataaatgtggaagcaactataagttctttctagctcctcaacgccataggttctttctagcttctcgacctggatagaatctatgagacgtgccccttctgaatcgcactttttcaaatcccccaagtgggctgcacctacatgtgctggagccccagactagaccatttctgtaagttgggcttctagattttctgagcagtaaacagagatggccttgagttcaatctatactatgctctgtatatgcagtggggtctgggactggtgcccagcactgagcttgatatgtatgactgttttgtaatccagggagaagtagcatagggcagtagaaagagctaaaggtcagcaatgagataggcattggatcaaatcctagccctacacttattaagcatttctggctttgacctcctcccctgactccttggggagagccaaacatcatatcccagccttcatcagatgcctcacaaattccaatattaaaagtttccatggtccctgtcatgtgaaaacatatttttgcaagatattcagcatagtgatttatctctactggcaaaaatggcattgaaaattttgcacaatgtaataagaaatgcaatccaaattataccctttgtcccacactggttcttcttaagatctgactactttttttaaatagtgaaaagttggtatgatatatgggttttgtcattaaacagacctggattcaggactgaatctcacctcttgttgcctgtctgtccttaatctttttaagcctcagtttccttagctataaaatgggaatgactccttgagccatagctagtaggatcatttagaaattaaatgtaatttaaaacatttaatagagggttttgacacatttaataaattctaaaatgttagccattgctgctactatgtaagtgagtgtgcaaggaagtcctacctttttggcctttttgctttcataattttaaactaaggctgggcacggtggctcacgcctgtaatcctagcactttgggaggctgaggcaggtggattacctgaggtcaggagttcgagaccagcctggccaacatggcaaaaccccgtctttactaaaaaaaaaaaaaaaaaaaggaagtagctgggcaagtagtcccaggtactcaggagactgaggcaggagaatcacttcaacccggggcgggcagtggaggttgtagtgagccgaggtcgtaccactgcactccagcctgggtgacagagcaagactccatctaaaaataacaataataataataataataataataataataataataataatattactaattaaactaaggtagtgtcttttctttagagaatccaatttagattcagtgttctctctggcagttaaactggaaacaggtgcttcttgcattcctgtgtcttgaatatgcaaaagtttgatttatttttatttatctaattatgctttaatgattgtggaaacagactgaatatttttcaatactgtgttaagtacagaatgtaacaagaaaaatttttttatggtgcatcatctttcatgtaagaactataaaaagaaaaacattcataaatgtaacctcttaatcattctggtatacctttgatgtgagtagaatattacaacctattattcatataagaaaattatgttgcagattattcctactctatccaattgtaattttctcctctcctgaagtgaaagcaatctttgaagtaaacagtgcatttttattgttctgtatcttttaagattattactattaattaataatccacttcaagatgttttcacatcagtacatataagtctgcagcagtggttttcaaaggggttactttgacccccatgctacatttggcaatgtttggaaacagttgcacaaccatgaccactgtctaattccagaacatcttcaccaccctaaaaagaaaccacatacttgttagcagtcactctccaatcctctctcccccaagcccctgtcaatcaccactttactctatgtctctatgaatttgcctattctagacactttatgtaaatgcagtcattccacatttgtacccttttgtatctagaatctttcacctagcatgttttcaagatttatccatgttataacatatatgagtacattgtattcagtgatacagattaataatgttccattgtatgaatataccacattttgtctattcattcatcagtgtatagaaatttgtttccattgggggctattatgataaattctgcttttgacattcatgtataagattttatgtgaatatacattttcaattctcttcagtatattatctaggagtggaactgatgggccatatggcaactcaaggtttaactttttgaggtacttccaaattgttttccaaaatgactgcaacattctacaattctaccagcaatgtgtgagtgttccatttccacaaatcttccccaggacttgttattatctatctttttgattatagtcatcctagtggatgtgaagtaatctatcactgtggttttgatattcattgtccttatgactaatgatattggccatcttttcatgctaattggccatttgtattgatatagtgtggctatgtccccacccaaatctcttctttaattgtagctcccataacgtccacatgtcataggagggacctggtggaaggtaattgaatcatggggacgggttttttctgtgctgttctcaagatagtgaataagtctcatgaaatctgatggttttataaaaggcatttcccctgcacacactctcttttctgccaccatgtaaggtgtgcctttgctcctcctttgccttccaccatgactttgaggcctccccagccatgtggaactatgagtccattcaacatctttttctttattaattacccattctcaagtggcagtatgaaaattgactaatagatttataaattcaaatcctctgccaattttaaattacttttatattgttgtattgtaagtgttgtctgtatattcaaaatacaaatttcttatcagatatataatttaaacattttctgagccatcttttcatttctttgtcctttgaaggacaatacttttaattttgatgaagtcctatttgtctttctttttcttctgttgctggtgcttttggtgttgtatctaacaaatcattgtttaatacgatatcacagagttgcacctatattttcttctatgacttttatgattttaacagtcacatttaggtatttgatctatattgagttaatttttatatatagtacgcagaaggggtcattatttttcttgagcatccaactgtcccagtagtcattgaaaagattgttctttcctaactgatttgtcttggcagctgtgtcaaaaatcaactgactataaatgtgagggcttatttctgaacttttaatcctatttcattgatatgtgtatgtaatataatatatataaaagataaatatataatttttatgccagtaccacactgtcttggttactgtagatttgaagtaatcttaaaaatggaaagatgttcagacctccaactttgttcttgattttcaaaattattttggctattcagggtttcttaaatttctacatgaattttgatatcagcttgtccatttctgcagcaacagtaaaagctagcttgggttttgctgtggattgcattgaatctgtagattattgtatcttggattaattgatattttgtactacagtgactgattttcatgttaaactaaccctacagtcttgccaggatgttggcttacatcatggttacaagactattggtttttaaggctcctagggaactggggagaagagaatgagaacaggtaaagttaaaacaccagaaagctaatttttcttatgcagattaaggtttgtttttttttttcttgactaaatgttgcccatattgttgcaagcctttgggtgatttccagacttctgaaaaattgaattttgacaattttggtcagagttctcattgcttttatgaaggagaggttttcagagggcctactctgctatccatgctgatgtcttccattaatgcagttttaatgaagatattaaatattcatggacattctatttaaaagatctgtagggtaagaaatctacaggttctcaattttattttctggtactacccactatctcataaaccatagtaattttcatctctatttctttatctcagctaaatattcattcatcgtacatacaccatcaaatgtatattcagtgacttctgtgcttaagacactgtgatacccttttaggtagattcaaaattaataaatacagattattcccaatgcaataaataagatgattgtagctaatacacaaattaaacttgataaacatcagaaatgggatatcgatcatgagatttcaaaaaaggatgaggaaagactgcttgaaagaataagtaggggaagatacacaagggctgtggtgtaaattctagatatagcatgagtggtattagaatatgcaggatggaggaagaacattttttagacaaaggaaacagaaagaaaaacaacatggacattaagaaagcactagtcctaaccaggaaaagtgaggtaggtctactaggctgtagcttagggtatctaagagatgtgagaaataagatttaaagattaagctttagccaaaaagtactttcaatgccagcctaaggaatgtgactgttttttttttttctgtaggtggtatagagccacaaaagattacaaaattagacctatgtgccagaaaagtttatctttatatgtgtataaatatttgagagatttaaatcaagttcatactctcatcaagtgtaatccaacaacaggataaatgacagtattataaaaagatgggaaaattataaattaaaatccagactagtgatggcaggatgaaaaaatgaaagtactagactcctgattattttaagacttacttgttttagatttacttgtttttcagaggttcttagaaccaataattttatagcaaatgtgtaaggaccactgaaagttctaggaaataggaatatagacaaagaagaaattactccagtatcctcattttcaagtaaatagaaaaaaatgtaatggtattgccacattttctatttacactgtccttggttatggcaccttcttccagtttcttcagcctaaattatagcatctctggtcccagaaaaatagattattttgtctctcaccttttgtttccagaagaacaatgctgagcttcagtataatattcaatgtacatttgtcttgttttcctctgacgtcccactttagctgtttgggcttcccacaatcatttattctttatgcccaaccctacgaagtggcatggttttattcacccaaccacagtatagtaatcattgacagttaaatatagggttaaatatagcaccaaaacacctcaaacacctcaaaacacctgaagttgaaaaattcaaagtttagacgagaggctgatgttgcacgatagatctgctagccttccaaacactgggttggcttttatgattaaattgtctgcttaaaaacaaacaaacaaaaacaaagcaaaataaaacacaccaagtaactgaccagttaaatggtattcctcctatggagtcaggtttatgtggctcagctatctgtaaaacaagaaaatatgtctctttgtgggatttttccctactcaggctgggatataaccttggttttcagcgggttaatcatctctcataacatggttaactggtagtgcaaaactgttcataatgttctgattttttttttctgtacagttaagaataaagtaatacagttgctacctaatcactgccttgaggactttgctgatgtccgtagcctactaagccgaggcaaactaaggtcatataatttaaaaagcttccatttc

SEQ ID NO: 169 - DNA, 294558 bp, Homo sapiens
agaaaaatgatttataattgtaggatacttttgatatatgagaaacaaaccagacagactacttcaacattgtatccacatctttactttcttcagactacctattccccatttcattctctctaagattatgcatttgccttccatttcagataaaacgaggctctaaggcttgagctcaacctcctgccttacatatctgatcaaccttcacttctttatcccaatctcaccacttatgcacctttctggttacttgttccatcaatcatttcctctgttctgtattttcaatactttcccttgagtatagtccgtatagcctactacttcacattaaaagtcttaaaatacaaaatggactcaacattagagtatataaaagaccttctcaattcgactggatataaaacttgtattgtggttaggttagaaaatactgggggccaggcacagtggctcacacctgtaatcccattactttgggaggcagaggcaagcaggttgcttgagcccaggagtttgagaccagcctgggcatcacggcaaaatcctttctctgcaaaaattacaaaaaattagtcaggcgtggcggtgtgtgcttatagtcccagctatctgggaggctgaggttggggaatcacctgagcccagaaggccaaggctgcagtgagctgtgattgagtcactcactgtactccaacctgggtgacagagtgagaccctgtttcaaaaaaaaagaaaaagaaaatactggggcaagatgtcatgaaaactaattttattatagttcagcaaaaacaaaactctccttgaccaagactccctctaattttgtatcttcattcctattcaaaggcaaactccttaaagagtctgtatgcctatgttcatttcctcagtccccatttactttttctaccccactttcccccgccaccctcccagcttaaaatgctctggccaaggtcaccaaggaacccactgccacccaggtacctcctctctgggttcaactctcagggccacacttcaccagtacctggcaatactggcatctctgtattcttgaaatgttcttttttgtattctgtatttcctgctgcttctcccatctgacctcttttgctttgtctctctgtgccagctttgtctctttccattccccaaatcttaagtttccaggacttcagttcctagccctcttctcattctacaccactggattttaactatttggaggccacaaatccctttgagaatctaaggaatgttaaaaccctctccttgggaaaaggcctatatactacatgtacacacaattattgaatacaataattcttcaattctaatctaattctcttacctcaatcaccacctataagctgacaattccacatttattgttctgctctttcccaaacttccgacacacttataaagtgccttcttaccgctgtcatcaaacataccagaggcctaaagggcaatcagtaatctctcaagcctcctttttttctttttcagacagtctcactctgttgcccaagctggagtgcagtagtgtgctcttggctcactgcaacctccaactcccaggttcaaatgactctctcacctcagcctccagagtagctgggactacagatgcacgccatcatgcctggctaatttttgtatttgtagtagacatggggtttcaccattttgggcaggttggtcttgaactcctgagctcaagtgatccatctgcctcagcctcccaaagtgagtgattacaggtgtgagccactgcgcctaggaagcctcctcttcattagccttttccctcccctctgcaaaaaccagagtggaagtacttgtaattccctaaatacaccacgcactcaccagaacttttgttctgatcccagctgccgtctgtggtctttctcaacttccctgcctagcgaatacctattcgtctttcaaagccctaccagcaaaagtagtccctcctgtgtcaccatccttcagctatctgcctcttttgaggacagggacagtgacttattagactgttaactagcacacacattggcatataaattaacacgtgaattattaaagagaatataaaagaagaaaggtcacccagaacagagatctaagctatgtttcccaaaaagtaaagctggcactcaactaacatgaacataaaacttaggaaacgtgctaaaaccccacatttcctcacggatggaaattaactgtttctccccagaacaaaaaacacccgaaaaatgagagattattactataaaggaagaaatatcagatgacaaaataatatttttatgatgactttttttttttgagatagtctcactctgtcacccaggctggagtgcagtggcacgatctcagctcactgcaagctcagcctcctgggttcaagcaattctgcctcagccacctgagtagctgggattacaagtatgcaccaccacacccagttaatttttgtatttttagtagagacagggtttcacaatgttggccaggctggtctcgaactcctaggctcaagtgatctaccagcttcagcctcccaaagtgctgggattacaggcatgaaccaccacgtccagcctatgatcactttaatatcattaatatcctctactgaaactgaggtggccttaatacatatctctatatatttttacatatattaataactgatcacattaaaaggaaactttaaacaaaatgccatatatttcccaagactttcagcaacatttttctttgaatataataatatatataacaaaccttatattagtaatcgtttctgtccacaaatggtcaatacacagttcaggaacaattggctccgtttctggtgcaagaaaggagccattagaattactatttggagaatgagaaatactatgtctctttggagactgattatggcttgaaatgttgaacctttgcacccctgaaaaagagtgcactcctaacgcaggagaatgagcacgactgcaaaataaacagaggagagagtacatcacagttagcaaggcaggcttatatgacacacactccaatgacacttccaaaaattccacagacagaagagcattcatggcataatccaggtcagaaattaaaatttttcaaaaaggagtagctatttaaatggttcatgtcaatgtgctttactatattctaaagatttagaattattattagaagaactcatcttttacaactaaaacttagatcatcttctttttcggaaaatgaatgattattcaaaaagctctaaactatgtccctgtatagtcagacatatatatttatcaacaaaacaatgtccctgtagcaccagatatacatatctggtcatttaaatatatatctatatagagaaatagatacatttacatatcaaataacaagtaaaaaaaaaagaaaaactaacataaattaaggcaaaaataaaatagtgccacagtattttgggaattaatattcatcaaactgttgcccacatagtggtagaaatgaggcaactaaccttaggtcaagcataggcagcttcaaaatatgactcaggaaagaatgtgacatggtaaacttagaaatcttagtaaaagtggctcagggctgagcacggtggctcacgcctgtaatccccgcactttgggaggccaaggcaggcagatcacaaggtcaggagatcgagaccatcctggctaacacggtgaaaccccatctctactaaaaatacaaaaaaaaaaaaaactcagccaggcatggtggcaggcgcctgtagtcccagctggaggctgaggcaggagaatggcatgaacccgggaggcagagtttgcagtgagtcaagattgcgccactgcacaccagcctgggtgacacagcaagactccgtctcaaaaaaaaaaaaaaaaaaaaaggctcaattgggataatggctatttcccctaaaaaacatctcccctaaatatatttcccctaaaaacagctgtcaacagaaattctaaatccttcaaaacaaaacagaaagcttagaaagaaaaaccaggaaacccttataccttagagctgccatgttggaaatagaaggtgagcgagaatgtagactgggtgatgaggttgagcgactctggctgtgaatggaggagtaattctggaaaggtgaagtcacaggggaatctcctttggagaggcttctgagatgtgctgtgagggagctgctagtggccacattctgtggggttcccccctgttcagagaactttaaaacaacattctcttccttaagtcaaaataaagagaaagaggaaaaaaaaaaaaacaataattagaataaagtagcaatttccttgtaagaatgcaagttgaagtcagttactaaagacacagtatttcttctttcctaagaagctcaatctatttctcaaatgaggccaggtgccgtggcttacatctataatcccagcactttgggagggtgaggagagaggatagcttgagccaaggaattcaagaccagcctgggcaacatagcaagatcccatctctacaaaaaattaaaaattagctgggagtggtggtacacatttgtagtcctagctattcggaaggctgaggcaggaggatcacttgagcccaggagttcaaggctgcagtgaactgtaattgtgccattatacttcagcctgggtgacagagtgaggccctgtctctagagatgatgatgatgatgatgatgatgatgatgatgatgatgatgataataaaactattcacaagtgatttttccaaaaaaaaaaaaaaaaagtgagggtatgaagtattaactactctttcatatatatatatactttttttttttttttttttgagatggagtctcattctgtgacccaggctggagtgcagtggcatgatcttggctcacggcaacctacacctcccaggttcaagtgattctcctgcctcagcctcccgagtagataggattacagaagccaccacacctggctaattttttatatttttggtatagatggggtttcaccatgttggccaggctggtcttgaacgtcctgacctcaagtgatccgcctgccttggcctcccaaaatgctaggattacaggtgtgagccagtgcacccagcctaccctttcctattaaggagaagtgacttgcctttctccttacctctgatttgactctccggagagtccacacagaatgcacattttgaacagcatcataagtcattacaatagaggggtcagtattgaggaaaacaattttcattgcatgatctacaacatattgcacccgtgatgaaccaaaaagaccttaaaaataaaatagaaaaatcaggtatagaacaatgggctttacaagactgatatttatgaacagagctcttaaaattgttaaagataaagaacaaccaagccaaagagagcacaaaatttattactatcttaaataattaactctgaatttttaataaatttactttaggcatcaacttccttaaaatacattaaagatgagagcattacaagttttagcttcacatacatgctgttgctaaatgttaagatttgtgctgactctcaccattacacgaatcagccacaggtaaaaggtcgatgatttcttcaactgacttatttataaattgcactcaactattctgccaagtttgacttccttattggttctgtttttctgtatgaaagctgtactctataattactattcagacagtgccgaacagtacactgttgtttctgctttactagttacacatgcaaaataaggtttttcccagtgagttcagcttttaatctaaagtaccatggactggtctccatatccttatttgacaggaaatgtttcccactcagttaaaatactgaaaaattttaaaatatgattctataatcataagaaatactttataaataaaaatcatgccaccatctcaaaatatctactattaatacattagagaatttttggtttttttcatacatatatacacactttatacatttttacaaaattataatcatactgtgttatttgtatcctacttgacatcacaaataagcaacttctagttcactaaatattagtcaaaaatatgatcaataatggctacactcctccctccagtccgtgcctccaagatgacaaagaaaagaaggaacaacaatcatgccaaaaaggggcacagccacatgcagcctattcgttgcacaaactgtgcccgacgtgtgcccaaggacaaggccattaagaaatttcatcattcgaggctgggcaggtggctaacgcctgtaatcccagcactttgggaggctgagtcaggcggctcacgaggtcaggagatcgagaccatcctgactaacacagtgaaaccccgtctctactaaaataaaaaaaattagcgggtcatggtggcgggcccctgtagtcccagctactcgggaggctgagggaggagaatgatgtgaacctggaaggtggagcttgcagtgagcccagatcccgccactgcactccagcctgggcaacagagcgagactctgtctcaaaaaaaaaaaaaaaattcatcattcgaaatgtggtggaggccgcagcagtcagggacatttgtgaagcgagtgtcttcaatgcctatgtgcttcccaagctgtatgtgaagctaaattactgtgtgagatgtgcaattcacagaaaagtcgtcaggaatccaccttgtaaagcccacaaggaccaaacacacccaccaaagcccatgtaaggagctgagtccttcaacactgaagacaaggccaggcgtggtggctcatgtctgtaatcctagcactttgggaggccgaggtgggtggattgcctgagctcaggagttcgagatcagcctgggcaacagggtgaaaccccatctctactaaaatacaaaaaattagctgggcgtgatggcacacccctaatcccagctactagggaggctgagacaggagaatcgcttgaacctgggaggcagaggctgcagtgagccgagatcgtgccattgcactgcagcctgggtaacaaagcgagactccgtctcaaaaaaaaaaaaaatgaaaataaaacgactaaaaacagactattctccagagaaaaaataaaatggaaattgtacttaaaaaaaaaaaaaaaaaaggctgcgtgccatttaatcccaggctctagtatgtttattcgggttgtctgcaattagtaacaacataaaatttgaactttttctgtaaaagatcaaagactaaatagggcagtttgctgtccacatactgactctatcacataatctttgttatttcctacaaccctttaaaaggtaaaaaccattcttatgttgggtgcggtggctcacgatgtaatcccagcactttgggaggccgaggtgggtggatcacctgaggtcaggagttcaagaccagcctgaccaacatggtgaaactacgtctctactaaaaatacaaaattagctgagtgtggtggcacatgcctgtaatcccagctacttgggaggctgaagcaagataatcgcttgaacccaggaggcggaggttgcagtgagccgagatcgcaccattgtattctggcctgggcaacaagagcaaaactctgtcttaaaaaagaaagaaaaaaaaaaaccattcttagctcacaagctttacaaaaacatgctgcaggccagatttagcccatggcctacagtttgccaagacataatacagaagataaaaagcagctaggcacggtggctcacccctgtaatctcagaactttgggaggccgaggtgggtggatcacctgaagtcaggagttcgataccagcctggctaacatgatgaaaccccatctccaccaaaaatataaaaaattagccaggcatggtggcgtgtgcctgtaatcccagctactcgggaggctgaggcaggataatcacttgaactcgggaggcagaggttacagtgaactgagatcacaccactgcactccagcctgggccacagagcaagacccctctcaaaaaaaaaaaaaacccaaaacaacaacaaaaaataaactttacttcatctaagtatcattcatttacttattaattattaaagaacaaagcatctacaggtaggttaataaatatatcggtattcctcactgatttatatgccttatttttactaaaataactgttgagcagttaataccatgatattcaagaaagtcaaaatagaagttatttttgtaaaatgtttacattatttttataagtcagttttcatataagcgcctttataacctccctcaccaaagtcaaaaaaaaaagagcttatctaaaagaatatagaaatacacttacttccagatttacaaacaagtggagttatttcatctagtgggtgcagcatgctgaacatagtaggtaaaggttctctagcaataaacaaataatcaattaattaccaatacgagtatgtctgtgcacaaattttgcacttctattgaaaagaaatctccagattacatgagcaactagaaacctactatctcaaaatgcaatcttctaaactttgtacatactatttttcacattgtcttctatttcattcctagaaatctctccccttagagtaattctatcaatgcacgaacagagggaaatcaatatagccagggaatttctgcaaacagcagtcatcacagtacagaacaaatggagtaatgtgcataaagcggtctttttttattgacctctcttactggcagtgtgtctttggcagctaagaaagaaatttattctcccatatctgctgacaaaggaatgcattttttaaaaaaggaagaaacaaactacttcaagtaaattaagtctgctttttttttctgagatggagtctcactctgttgcccaggctagagtgcaggggcatcatctcggctcactacaacctccacctcccacgttcaagcgattctcctgtatcaacctcccgagtagttgggattacaggcacacgccaccacgcccagctagtttttttgtatttttagtagagacggggtttcaccatgttggccaggctggtcttgaactcctgacctcaggtgatccacctgcctcggcctcccagagtgctgggattacaggcgtgagccaccacacctggccagaagcctacattttttaaggaattattttttttagagcgaagacgggctttctttcaaagcataaagagatgaaaatctatcagcaatttctttaagacttagcaagtgcctacctcttgcaccacaacatgcctgacaggtgctgtatgctgctgcccttcggtgtgctcataattcatagggggcaagataaacacgccgctagtaaacatctgccatttattgcatacttaatacctactaggccctgtgtcaaagcttatatacatttagctactttaactttgcataagtcctaagaggtaaatgataacattcctgtaacgcgtaaggaaactatagctaagaaagctctaatgatctgctcaaagcagcacaatgagaaaatggcagagctaagaactgaatcttgttatttattttttttttgacacggagttttgctcatcgcccagctggagtgcagtgatgtgatctcggctcactgcaacctccgtctcccaggttcaagtgattctcctgcctcagcctcccgagtagctgggattacaggcacctgccaccacgcttggctaattttttgtatttttagtagagacagggtttcgccacgttgggcaggctggtctcgaactcctgacctcaggtgatccactcgcctcggcctcccaaaagtgctgggattacagacgtgggccaccgcgcccggccaaatcttttttgaagccatttatttgcatattcaattttaccacttagattgggaaaaaaggctaattaagtgccaagtgcgtagagttcatgagtgtacatacaggctgagtatcccttatctgaaatacttgggaccctaagtgttttggattatttaccttacactaacggttgagcaaccctaattcttttgggggtacaagtggcttttggtgacacagaattatgtagtggtgaattctgagattttagtgcacctgtcacctgtgtagtgtatgttgtatgcaatatgtagtttgtttatcccacaccttcttcccaccctcctccttctgagtctccaaagtccatcataacactctgtatatagcctctgcatactccttgcttagctctcacttggaagtgagaacatgcagtatttggttttccattcctgggttacttcacttagaatcatggcctccagttccatccagcttgctgcaaaagacattatttcatttcctcgttatggctgattagtattccatggtgtatatatacattttctttattcactcattggtcaatgggcacttaggctgcttccttatctttgcaattgtgaattgtgttgcaataaacatacatgtgcatgtatctttttcacataatgacttttatttcctttgggtagatacccagtaatgggactgctagattgaatggtagacgtacttttagttctttaaggaatctccatactgttttccatagatgtcatactaattatgttcccaccagcagtgtataagcattccccttccaccacatccatgccaacatctattgtttttctgactctttaataatggccattccttaaagagtaaggtgagatctcactgtggttttaatttgtgtttctctgatcattagtgatattgagcagtttcatgtttgttggccatttgtgtatcttcttttgagaactgtctattcatgtcctttacccactttttgagcttctgtcttgctgatctgagttccttatatattctggatactagtgctttgttggatgcatagtttgcaaatattttctcccactgtgtgaactatctgtctattctgacatttcttttgctgtgcagaagctttttattttaattaggtcccatttatttattgtttttgttgcatttgcttctggtgttttagtcataaattccttgcctaggccaatgtccagaagagtttttccaaggtgatcttctagaatttttatggtttcagggcttaaagcctttcatccctcttgaactgacttttgtataaggtgagagataaaaaaaacccaatttcattcttctaaaaaaggtatcagttttcccagcaccatttactaaataggatgcctttcccccaatttatgtttttgtaagcttgtttgtcaaagatcaaatacttgattacaagtatttggctttatttctggtttccctattctgttccattggtctatgtgcctacttttataccagtaccatgctgttttgctaattataaccttgtagaatatgtgatggctacatacttgttctttttgcttaggattgttttggctattttgggctcttttggttccacatgaattttagaattgttttttctaactctataaaaaaaaagatcttattttgatgagaattatggtgaaatctatagattgcttttggcaggatgatcattttcacaatatggattcttcaaatccatgatcatgggatgtgttaccatttgtttgtgtcatctgtgatttctttcagcagtgttttgtagttctccttatagagatgattcacctccttggttaagcatattcataggtttttgtttttggctctttgctgctcttataaaagggattgaatttttggccaggtgcggtggctcatgcctataatcccagcactttgggaggccaaggtgggtggatcacctgaggtcgggagttcgagaccagcatgactaacatggagaaaccccatctctactaaaaatacaaaaaattagccaggcgtggtggtgcatgcctgtaatcccagttactcaggaggctgaagcaggagaatcgcttgaacctgggaggcagaggttgtggtgagccgagatcatgccactgcactccagactgggcaacaagagcaaaaccccgtctcaaaaaaaaagagactgcgttcttgatttgattttcagctttgtcattgttgctgtatagcggtgctattgatctgtgtacattgattttgtaatctgagactttactgaatttatttatcaaatctaggggtcttttggaggagtctatagggttttctaggtatataatcatattatcagcaaatagtgatagtatgacttcctcttttcaaatctggatgtcctttatttctttcacttgcctgattgctctggccagaacttccagtactatgctgaatagaaatagtgaaagtaggcatcttagtcttcttccagttctcagggggaatgctttcaacttttccccattcagtatgatgttggctgtgggtttgttgtatatgacttttattaatttgtggtaagtcccttctatgcctagtttgtttttatcatcaagggatgctgaattttatccaatgcttttttctgcatctattgagatgatcatatggtttttaattgtttatgtgatgtgtcacatttattgacttgtgtatgttaaaccatccctgcatccctgagacaaaacccacttgatcatgacatatctttttgatgacagcaaccctaatttgagaatccaaaacctgaaatgctccaataagcatttcctttgagtgtcatgctggagctcaacaagttgcagattttggagaatttcagatttttggatcagggatactcaacttgtactgagatgagagaaaatggcatatatctatgctgtcaacatgaaaattatcatcatctcaaacttttagataaacctcagaaccaacacaaacacacaaatcccaagcagtaatattctgaagtgaataaaatgaatacctgggtgaacctggaggtacttcatgtgaagaagcgcttcgttcaaacagcaatccatatttagtgggccaaacatttgcaacctttcaggtaaaagggtgggaaaagatagaagtaagagaacctacccctttataaaatgttttaaagaaacattacagaatgttttattttccaatttagtaatagctttacaaagtaacataatcattaaatacggtattttcttaaaaagtaatacaaataagcaactctaagataaaatcaaatctaataaagaggagttgttcaatgtgaaattcctgccactggccaggatcagtaacaaaatgacaatgtgttaacaatagccctaggcattaaaaagacgatgagtaacaaaaaaagactggtgttattcatatgccttatttaatataaccaaaagttcttaggtatcatttaaaccaacaaacacataccacagaagacttcctaatttacttcactaaataacttattttcttgtgaagtacagaaaaatggtaagccactaaagctgccaaaatttagttattttgagtaaaaataacatttttgactactacgaaacatgagacataagacatgcctctaaaaccaattaattcaaaaatgttctccaacaaaacccccccaaaatttgaaacacttgtttacctgaaatggtaatgaagctatgtaatcctttccttctatgctatgcatgttaatacatgagctttgcaatatacatatgcatttttctacttcattgctacctgaaaagaaagggtacaacaagacttatgtgttttttccctcaaaggagttcaatcctaacagcacaaattatttaatgcacaatataaagatgcttatggtaaaccactattactagtggctacttcatttgaatgaaaaatacaatgagataaatatttggaatcatcataagaaaaataaaatttcaaaaagaaacttactgtaggccttttcagacttatcctgtgatataatgaagtcacaccacaatgcctaaaatcaaaacaaaatgcttacctaagaaaattatatctaaataatcatctattaactaatggcatctaaataataataatagcatctacgtaataactttgcctcctcagctcaacatgtacaatcatgggaacaaaaagaataagaaaaaataaattagagtaataaatgataaatatgataaggaaaggcaaaatatgtttacaattaaattttatgaaaagatccataggaattaaaattttaaattaaaaaaataaattttacaaaaagagaagacaagaatcaaaaaatctaccagatagaaactttgcagcaaaaattcaaatagtagctcaaaccatactaaaccctatatcctctacaaaactaaagattattcaaactttataatctccagattaaacaactgatcttagactctctctagactgacttttgaaaaagtctttagaaaaactaactcctccctttcttaaaagcccatcttacaaaatataaactaggaaaagctattaaactttaactgacatacctggcaatcacttattatttaacagcattttgtgtttttttttaaactgtggtcaaatacacacaatatgaaaattaacattttaacaatttttaagtagacaattcagtagcattaacattaaattgacgagcttagtacaatttgtgagcttgtacaatactgcacatttccagaactttttcctcatctcaaacagaaactccgtgcccattaaacaatactccccatttcccaatgccctgagctctggtaacctctattccactttccctatgaaagggcctgtgctaggtatctcatgtaagtgaaactgtacatttgtccttttatatctattttatttcacttaacataatgttttcaaggttcatccatgttatgacatgtatcagaattttatccctttttaaagctaaacaatattccactgttagcatataccacatttgtttatccattcatctgtcaatggacatgggttgtttctaccttttggctatcataaataatgctgctgaaaacactggtgtacaagtatctgtgaatccctgttctcaattcaattgtgcatatacctagaactggaactgctggatcataatggtaattctaagtataacttttctttcaagagatggggtctcactctgtcacccaaactgcaatgcaaggcatgattctagctcgcagcagcctagaactcctgggttcacatgacccccctgcctcagtctcctgaacagcttgggagtacaggcatgcaccaccatgcctggctacacgtgtaactttttgagaaatcgccaaacttttccacagcagctatgttacattcccatcagcaatgcacaggagttccaatttctggacatcctcaccaacatttgttatgtttctttaataacagccaacctagtaaagtggtatctcattgtggttgtaatctgcatttgcctaatgattagcgaagctgagcatcttttcatgtgcttactgaccatgtgtgcatctttagaaaaatgtccatttaagtccttctgcccaattttttaattgggtagtttgttttattgttgagttgtgggagattttaatggttaagaaatgaaaattcaggaagaaaaccatgcatgagagctgtgctccaacctgaaatgtccaaaatctacaatgcaccgattacagtctcaacttcctttgatgaaatcccatcctctcagcctctaaaagtaaatattttaacatctcttttatccctgatatctaagagatcactaaccccttccacatctccctctgctttatcaccccttctttgccaaggcaccaatcttttacctgaacagtcacaaaatagtgcccctgacaacagtctccctcctctccagtcaatcctatatatatattgctaacaaagcaatctcttctcaaaacacaaaattgatcgcttccattttaaaatccttggcaggctcccttcagcacacagtttaaaatccaaattccttggtttatatacaaggccctttggtctgtatactgccagcatccacttgcatctctccacacccacacttcgtgtacagccattctgaagtttaaaaagtcatctttttccataattctttttgctgtgatttcctctgcctagaatgcccttctgccaccattttataacacaaatagcatcttctttgaaaaaccctccctttggcactcagtcctttgggctctcatcactctgtggacaggtagttattatacagcattcagaatacagcatttcaggtgatctgtttgttctcctttctaggctatgagtccttcaatggcagaaactacattcacctttgtagccccagcataatggctgaaacagagtgagactaaatacttgcagaagaccaggcacagtggctcacgcctgtaatctcaacactttaggaggccaagccaggaggatcactagagcccaggggttcaagaccagcctggacaacatagtgagacccccatctctattaaaaaacaaaaagaataaatgaaaaaataaaaagaacaaccaaaaaaaaaatacttgcaggataggtaaaacaatgaacagataaaatctgagtcacatatacctgatattatttcataaacaaaatagaaaattatctttctccatattagcaagaagattaagtaacaatatattttccagatcaaaagactgaaattccaaatcttacaattacacttacaagtgatcttaagataaaggagataatatatctaactgcacttccatagaatctagtaaataggcaactgttcttggagaaattaagatgaagatatagaagcaaagaactacttggatatcatcaaatgcacttttcacatctatactaactatatgaattatatgggaaaaaatttaccatcaaaaagatcactggcttcaacactccaggacacaaatgctttcacatatgccctcaaatgttggaataatgattcagtttatcctttccaataaatagaatacagtactcatcaggaaatagttaacggtaggcgggaggagtgggaggaagcagtatccagatacaaagatttcagcatttacaaaaatgaaacttaacattagtcaaagcctccaaaacctcgtcaaccctaattcaactacaataaatgcattagttcttcctccaactttttgttataaaaattttcagtaagaaaagttgaaataatgcagcaaacatatttcacctatatccaacaatcatgaaaattttgccatatttgtttgtgtgtgtgcatttgtgtacatatgggattttcggaatgggaatgctgactgtttaaaaataaattgcacacacatcatgacatttcacccctaaatacttcaccatgccttttctaaaaataaagatgttctcctataaaaccataaaatcatcgtccctgagaaaaaaataatacttctctaacatcagctactggccagtaattttcaactttcccaaattttccccaaaaatatctttttagctagaaaaccaggactcaatcaaagttcatttaacaaggatcaaaaaatactgcatttggtgatgtctctttagtctctttcaatgtagaacagtccccacctttttttctttctccgtgacttttttaaagaaaccagaatgtagactataaactttttataatggaaaatttcaaataaatacaaagtaaacagaataggataatgaatccccatcagccagttttaataattatcaagcttggctgggcatgatggctcacgcctgtaatcccagcactttgggaggccgaggtgggtgggtagatcacaaggtcaggagatcgagaccatcctggctaacacagtgaaaccccagctctactaaaaatataaaaacaaaattagccgggtgtggtggcgggcaactgcagtcccagctactcgggagggtgaggcgggagaatggcatgaacctgggaggcagagcttgcagtgagctgagatcatgccactgcactccagcctgggtgacagagcaagactccatctcaaaaaacaaataaataaataaacaataataataataataaagctttagccattcctagctatctatttccttatctcatggtattttaaaatataattctctattgcctatatttcctataaataggaagttaggtctaaatattcatatttttgggaagaaaacttagatgacatcatgtacttcattctgtattatagctagaagcacataatactccttcatgtcactactaattatgctaaactcaatcacttgattgaggtggagactgacaaataactccaaagtagaggtacatttgttccttcacatttaccaggtaatccacagggtgatgtgttggtgccatggtaatattctttcaaccaacagtgttagtatccatttacaatccttgttggaatcaattattgcactggaggttacaaaatggtgatattctaattctacaattccttttacacttattagctagcattcttctctaagtacaagttttccttcatcaaatggagatgaactgcatgtcttcctgaaaaaatatggcaaatgcttaattctttccctttcattatcaactttcagaacagttagttataacagccaactgcaatggctgcaaagcagattttttcctttctctctaccattatgaatcccacgatttttatttattcaaatctttgcaatcaattatagtaatcatgtgttaaaatatttctgtactcttcatgttttataggtttttgctggcaataacaaattgaattacataaggacagagtgtttaaagattaccattaaagtgacaaagaagagtgtaaaaaaagtgatgatataaaaataaaattaaatttttattttcctgccattatcttcacattatattatgtcatgttacaacgtacacccagctgctgagatcattaggctggttttatcatttctgttaaattttaaaacaaaacttttttttaattgcattaaatagtgaatcaaatgctaaaattcaaatcaactcacctgctgaacaggactgtcaactgtaaatgctttataaactgccaatgcctggcttttacttcctttgctccatatcaccatatttccagcaacatagagttcctcatcatagtccacatcttctccaatttcacttactcctttccttaactgccagctttccttaaaaattaacacatgtaaaacatattcaagcactctttttttgttcttcaaaaatctggaacaaaatttatttgcccatggagtaagactcaattcaaacacaactcctacaaagtttggtacactgattaacggaggatgtggatatatgcattacactacagaattacatgaagaatttactcaataattctctatattgaatgttttatattattcctctatattactctgccaaaaacaaaaacgaacaaaaagtacaccttctctatagttccaaaagtcaaatcacatgcttgggagactaaaaggacatattaagtatatgaggtagggtagggaaaggacagtgaggtgcacgtgggaatcacttggggagttcacacacaaatgcagacttcctgcttcgcaatcacatatatattcaccttcttttcctttgtcccacccaccaaaatgaatggaagaaagagaagtttccatttgtaactacataggctttccctccccgagattttagtatcccaaagggatatgacaatggaataaggcaggagggattcattttctgacacacacttaacatctcattcctctacttaagaactattactcgccgggtgtggtggctcacgcctgtaatcccagcactttgggaagccgtggcaggtggatcacctgaggtctggagtttgagactagcctgaccaacatggagaaatcccgcctctactaaaaaaatacaaaattagctgggcgtggtggcacatgcctgtaatctcagctactcgggaggctgaggcaggagaatcacttgaatccaggaggcagaggttgcggtgagctgagattgtgccattgcactccagcctgggcaacaaaagtgaaactccgtctcaggaaaaaaaaaaagctattactctacctacttttgtggcatttcttctctcctttagaaacatgtaaatcttctgcagcagggactacttctaatctctaccatttaatcattagataacatgaaatctggtccccacatattaagtgaaaagaaaaaggtttaaaatggacaacaatcatactactgaacctgactcacattataacaccacaagttggccgggcacagtggctcacgcctgtaaacgcagcactttgggaggccgaggcgggtggatcacctgaggtccggagttcaagatcagcctgaccaacatggagaaaccccatcactactaaaaatacaaaattagtaggggtggtggtgcatgcctgtaatcccagctactcgggaggctgaagcaggagaatcacttgaacccgggaggcagaggttgcggtgagccaagatcgcaccagtgcactccagcccgggcaaaaagagcaaaacttcatctcaaacaaaaaaattgaaaaataaaaaataaataaaaccacaagttatagagggtatctaaataagtcgctatgacaatgtaataaagtcattattttcaacatttattgaaattaccacaccttaactctactctagaagtggcatcacaccgatctctcagttgcatcttagtagccttaaattacaagtagattatatcactctacatttcaaaaacacaatgggaaactcaatggaaccttctgtttctcgtggattgtaacctcctgaagggatcccaccaagccagcagcaccatcagaagaccataattcagaagctggctgcagctggcgaagttgaaggttcaaagcattagggtggtgcttgcagtggtctcgaccaaaaggaacaaattcctgcaaatcccttgctgcaatcatcgttgtcctttcttcatagaagttcgacatgggttccaaatatcaacattatttctgtatgaattcaaacacattctggtcagcttccagactcaaaactagaataaaaataccataaacacacaagtcattaatccttacatgggtgtcaagtaattatatcagactggtaagtatataagttggtcataacataaaagggcattctagatctgattcagacagttgcaattatcacattttagtcacagactgacagttaccactataggaaaccactgagatgcaacaagtacttatgtcccgcaccacctatcccgtgtttcccactactatacgctaatttttccatactttatatatgaagtatttagacaagttgtattctatggtcccataactacatggcttttcaacatttaaggtcatttctggttagatgccagaacctcatttgaaaagtacatctaagggatcattgtcatattggaataaaacaataaaaaaccacacattactctaattcatcagaggttgaactgctttcagctgaccaatctacaaaagacataggttttcaaatgtcttaagtagctgtgacacccccaatcccacctaaatatataactacaatcaatttcaattattggtcgaaacccaaagaaccgaggcatgaataactctagccatggaacagttatgcttgcagatttaagggtactaggttttaattaattattacatctaattaatctaattattaatctattacagtacagtttattactaaaaaaatgtggatgaactgttaaagccttcatcacaaggttaggtagcagccaggctttagacaaaagtacagataagcataattagattgtccttcgatccactttcctgtacctgtttatatataccatgttcctatagacagcatttttaatgttaggagcctaagacttttgagatgatgcaagctagtcttaagaccccatcaaggaaccacattagcatgagaatgtggtttatctctctgtcctatgacttcatccttcattctctgaccaatcaataccttaacccactaccctctctttaaaacctctggaccgggtgcggtggctcacgcctataatcccagcactgtgggaggccaaagcaggcggatcactaggtcaggagatcgagaccatcctggctaacatggtgaaactccatctctactaaaaatacaaaaaattagctggacttggtggcgggcacctgtagtcccagctactcgggaggctgaggcaggagaatggcgtgaacccaggaggcggaggttgcagtgagccgagatcatgccattgtactccagcctgggcaacagagcaagactctgtctcaaaaaaaaaaccaaaagcaaaaaaaaaacctctagaccttaactctttggggaggctgacttgaagtttcctcagtctcctagttcggtggccctgcaagtaaaacactttatctgctgcaatccccgttgtttccgtgtattgacttgctgctcatagggcaagaatcctatatggttacacaaacagccaaagcctatgtagttcctttgcagctcctccaaagccacaaagttattttgctgtgaattaaatgttattcttggccaggcacgatggctcacgcctgcaatcccagcactttgggaggctgaggcgcgaggatcacctgaggtcaggagtttgacacaagcctggccaacatggtcaaaccctgtctctactaaaaatacaaaaaaaaaaaaattactcaggcatggtgtgggcgcctgtaatcccagctacttgggaggctaaggcaagagaatcgcttcaacctgggaggcagaggttgcagtgagccgagatcgcgccattgtactccagcctgggggacaagagcaaaactccgtctcaaaaaaaaaaaaaagaaaagttattctggatataattatgtcacaaaacatgacacaagttttgttcttcctcctgctagaaataaatgagtactgggacacttgaacttggaacacaagtaaaaagtgccttataaaacttacaaggggcagggcgtggtggctcacgcctgtaatcccagcactttgggtggccgagacgggtggatcacgaggtcaggagttcaagatcagcctggccaagatggtgaaaccccatctctactaaaaatacaaaaattagccagacagtgatggcgggcgcctgtaatcccagctacttgggaggctgaagcagagaattgcttgaacacgggagccagaggttacagtgagctgagatggcgccactgcactccagcctaggagacagaacaagactccttctcaaaaaaaaaaaaaaaaagaaaaccccacaaaaaaaaaaaccttaaaagaaaacaaaattcagctggtcttcctatattttattcaacagaataaccaacatcaacgaacttttgactttatgaaactttagttctgcaattttataatgttattttcttataactttgagagaaaattacagaattgttaaagaattatcattttgtaccgattaatgccacatatttaatactttttcagtaccccaaacttttagaaatgtttttacttgttaggtgcaacataaacagctacacgtaaaaatactattaaatttatatgctataaataacagtatcagcaatgattcctacaaacactaccctgccaaaaaaaaaaaaaagagacccaaatgcacactaacgggagcttaagtctccacaagagcttccccagcctttctagaggacggtgaaaacaggctgagagcccgaggctcagaaaaacagctcagaggggctggaggccagtctgaaagctgaggctgcacatgggatgctacgcacagctcaggaaagaggttggcaagcaggagccggaaggagcaccccagcccgcaggccaggagcgcccgcaggccccctcagccccggagcacgctcaaggccctccctcgggttcccagtaccccgggtttccagacctacggccaccaggggaggctcggcctcgggacgggtgcgagagtcacgcggcgcgcgacagaccaccaagtgctgcggtacggcgcccgcacctgtataactcgggacgcgtcaggcgcggcgagccccggctgctccccggaggcgcaggggccgaggaggcccgagggcagcggcggggtccttcacagtgactcttgggccgcagcagcttctcattccctctccctcccctattctggaggaagaacgggcaacagcagcgggctcgagtgctaatggcaggaaggcgtgcgagacgttcaaatggacgcgtccatcttgactttcccgtcttgcctcgcgccggggcggggcatcgcgggaggtgcgcggcgtcctagcagtcctggcgcctgcgctgttgagggaagaccgcggcgggttacaacttgggggctatttccaccttccgtgcgactgatgcgaaccccgaagccggactctgtctgctacagtcctggcgtccaagttctctttagctcatgtcactagggacctgaactgccttatagatctcagggttttttcttctggtttcgcttccgcctcctgaccccacgtggaggtaggcacctcaggctgagggtggggagcaggggttgctgattttctctacgtgcagtgaatgctctatgcctttttcggtccatactcttcgaagagtggatgaactgtgtgaaggtcctcacagaaacgttgcttgcaattcccagattcagagacacttcttaaggcgattcaaagacccaagttaagaaccccagcggccactcgcgcctgtaatcccagcactttgggaggcgaggcgacaggattgctggagcccaagagtttgaaaccagcctgggcaatatagcgagaccctgtctccacaaaagaaaaatttttttaattagcctggaggcgtggtgcgcacctgtagtcccagctgcttgggagtctggaggatcacttgagcagggagtttgaggccacagtgagctatgatcgcgccactgcactccatccagcctgggcaacagagcaagaccttgtctcaaaaaaaaaaaaaaaaaaagaatgggttataggagaaaggttagaaacaaagattcatgaaacagttaaatacaaatatacctaattgatattttaaacttttgtttgtgtgtgtgtgtgtgtgtgtgtgtgtgtgtgtgtgtgtttttcttgagacagagtctcgctctttcgcccaggctggagtgccgtggcacaatctcggctcactgcaacctccgcctcccgagttcaagcaattctcctgcatcagccttccaagaaggtgggattacaggcgcccgccaccacgtccagctaacttttgtatttttagtagagacagggtttcaccacgatggccaggctggtctcgaactcctgacctcgtgatcctcccgcctcggcctcccaaagtgctaggattacaggcgtgagccactgcgcccggccaatattttaaacttttttaaaaaaaaaaagtttagcaaccccatcaaaaagtgggcgaaggacgtgaacagacacttctcaaaagaagacatttatgcagccaaaaaacacatgaaaaaatgctcaccatcactggccatcagagaaatgcaaatcaaaaccacagtgagataccatctcacaccagttagaatggtaatcattaaaaagtcaggaaacaacaggtgctggagaggatgtggagaaataggaacacttttacactgttggtgggactgtaaactagttcaacccttgtggaagtcggtgtggcaattcctcagggatctagaaataccatttgacccagccatcccattactgggtatatacccaaaggactataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacccaggaaggggaacatcacactctggggactgttgtggggtggggggaggggggagggatagctttaggagatatacctaatgctaaatgatgagttaatgggtgcagcacaccagcatggcacatgtatacatatgtaactaacctgcacattgtgcacatgtaccctaaaacttaaagtataataataaagtttagatttacagaaaaactgcagatagtccaaaaatttcccacataccctatacccagtttctacatccagtttccctattattagtattttacattagtatagtacatttgttaaaattaatgaaatatcaacacattattagtaattaaaattcatactttattcagttttttttaagagagtcttgctgtgttgcctaggctagagtgcattggcacaaacacagctcactgcagccttgaactcctgtgctcaagcagtcctcctgcttcaaccccccaagcagatgggactccaggtgcaagccactgcattagtttgtagaatatcccttaactgaaatttgtctgatgtttcttcatgattagcctggggatatggatttcaggaaggaagatcataaagtgtcattttcatcacatcatatcaaaggtacttatcaacagtatcacttatcgctgctgatgtcaaccttgatcacctaactgagatagtgtttgtcagatttctctactatgatgttacatttccccactttccatattgtactctttggaaggaagacaatatgtgcagccctcagttacagagtgaggccagttgattttgttgttgttttacaaacttgcaaaagcaaatgaaggagggaagcatcttttcaacagttagtgttgcaatatttgtatattcagatggaaaaaatgaatcttgattcatactacacaccatatacaaaaattaaagtgcatcaaagacccagatatgagagtaaagctgccgggcgcggtggctcacgcctgtaatcccagcactttgggagaccaaggcaggcggatcacctgaggtcaggagttcaagaccagcctggccaacatggtgaaaccccatctctactaaaaatacaaaaaataaataaataaataaaatagccaggcgtggtggcaggcgcctgtaatcccagctactcaggaggctgagacaggagaatcacttgaacctgggaagcggcggttgcaatgagtcgagatcacgccattgcactccagcctggggtacaagagcgagacttcgtctcaaaaaaaaaaaaaaagagtaaagctatacacttagaagaaaacatagctgtaaatcttcataaccttggattaggcaatgatgtcttaaatatggtacctaaagcacaaggaacctaggaaaaaatttgataagttggagaaaagttttaaattttgtgcttcaaaggtattgtcaagaaagtgaaaagacaactcacagaatgggggaaaagatttgcaaataatctgataagagtctgttatccagaatatgtgaagaagtcttacaactcaacataaaaagacaacccagtctaaaaatgggcagaggatttgaacgacattttgccaaaaatatattatacaagtggccaaaaaggacgataaaagatgaccaacatcattagtcattagggaaatgtaagccaaaaccacttcacacccagtaggatagctgtaatcaaaaagacagacaataacaagtgtttatgaagatttggagttatttgaccccttgtacataattgataggaatgtaaaatggtgcagccgcttggtaaaacagtttgacaggttctcaaaaagttaaacgttggtctcttccaggagctaccgccagaagatggcagcagccgccaagttgtcactactagagaagtccctgggactgagtaaggggaataataaataaagtgctcaggatgagtgacagattctggttcttcaaacaaacaatggtccaagtctaacaggattgactactatagcagctcatctagtcaagcaagctaacaaaggatatttgctagggagtactgcagaagaaaaagcaatagttcagcaatggttacaatacagagtcactccagtaaaaatgatagccacacactggtttttttttttagttttttttttttttgagatggagtctcactctgtcacccaggctggagtgcagtggcgctatctctgctcactgcaagctctgcctcctgggttcatgccattctcctgcctcagcctcccgaatagctgggactacaggcgcccgccaacaacgcccggctaatttttttgtattttttttattagagacagggtttcaccatgttagccaggatggtctcgatctcctgaccttgtgatacgcccacctcagcctcccaaagtgctgggattacaggcgtgagccaccatgcccagcccacaccctgttgaaggatcttatttcatatcttgaagataaagtctaccttacaggatataactacctttgcagatatcctattgtactatggacttcatcgctttatagttgacctgacagttcaagaaaagaagaaatatcttaatgcgtctcgctggttttgtcacattcagcattatccagatatcaggcaacatctgtctagtgttgtcttcatcaagaacagactatacactaattcccactagaagctatccgtgccgtacagaagatgtattaaaaatgttttaactggaaaatgtattctgaccacaggactaatataaattaatatacagtcattcattatttgttgaaatctatagaatttttaaagtgtcaacttgtgtctgaatgttttatttgttctttagttgaagctttttttgtttgttttttttttttgagatggagtctcactctgtctcccaggctggagtgcagtggcgcgatctcagctcactgcaagcactgcttcccgggttcacgcattctcctgcctcagcctcccaagtagctgggactacaggtacccaccaccacgcctggctaattttttgtatttttagtagagacggggtttcaccatgttagccaggatggtcttgatctcctgacctcgtgatctgcccatctcagcctcccaaagtgctgagattacaggcgtgagccaccacgcccagcctttagttgaagttttgcaatgttttatgtaaaaatttaactgctattaaaaaaacaagttgagatcaagttacaaaattaaccttgtttttaacaaatgacatttatttcaataaaagttgcaaatcagtggtttaatctaaaataaaaataggtgtcctttcaatggttgacatatttggctatttattaacctctttcatattctcaaatttcttttccccttttgggtatttatggaagtttgttaagaactgtgattaaaagaaaaaaaaaaaaaaaggctgggcacagtggctcacgcctgtaatcccagcactttgggaggccaaggtgggtggatcacctgaggtcaggagtttgagaccagcctggccaacatggtgaaatccccatctctactaaaaatacaaaaaaaaaaattagccaggcacagtggcaggcgcctgtaatcccagctactcaggaggctgaggcaggagaattgcttgaacccaggaggcagaggttgcagtgagctgagatgacgccattgcactctagcctgggggacaagagcgagacttcgtctcaaaacaacaaaaaaaaaattctgtgtgtctacactagatacccctagatggcacatataggtttgtgacctatctgtctccaaagttgagaaacagacagaaagagttacaaacaagatattataaaagattaattactataccttgcttttatgaggaagggaaaaggctttttatttttaatttttacacacaaaaacaaccacaagcttaggttttacaacttcagccacaggtccaaaggaaattcagaactcaaaaactcaccaatctagcagcagctccatcatgcacacacatttttttttaattttttccccttcctcccttccttcctgccttccttttctcctttctttctttctttgacataattgtgctcctagtggcaagcaaacaagagaaataccataaagaatgccaggagcttgcagtgagccaagatcgcaccactgcactccagcctgggtgacagaggagactccgtctcaaaaaaaaaaaaaaaaaagtcattattgagctcagtgcgttggctcatgcctgtaatcccagcattttgggagaccgaggtggcagatcaccagagattaggagttcgagaccagcctagccaacatggtgaaaccccgtctctactaaaaatacaaaaatttagccggacatagtggctcgtgcctgtagtcccagctactcgggagactgagacagaagtatcgcttgaacccacatggcagaggttgcagtgagctgagatcttgccactgcactccagcctgggcagagcaagactctgtctcaaaaaaaaaaaaattattatcagttgatttcctgttgtctgccacctgacagatcaccaaatcaccagccattcccaggaaatgacaagagccagacctctaatttcagtgtgttgtacagcaaatggaatctcttatatgtaacatctccatttctccaacaaactataagaagaagaaacttatttccaagatggttttggcaggtagaatggaatccttttgtatgcgccatctcaactcctctaaaactacaaagacaaagcacttagactactgtattttgctcaagaaactaaatggagttgcttacaggcattatgtggtttcccaataaattataagtgcagtttcccaataaactacaaaacctagacctctgtgcttctggtatgttcttcagcatgctgaatggagtcttctacatctgccatctcttgggaacaggccccaaaatctggccataaactggccccaaaactagccacaaacaaaatccctgcagcatggtgacatgctcgtgatggccttgacgcccacgctggaaggttgtaggtttaccggaatgagggcaaggaacacacctgacccacccagggcagaaaactacttacttaaaccacaaacaatagcgtgagctatctgtgccttaaggacatgttcatgctgcagataagtagccagagcccatccctttatttcgaggtatccctttgtttcccgtaaggaatacttttagttaatttataatctatagaaacaatgcttatcactggcttgctgtcaataaatatgtgggtcaaactctgtttggggctctcggctccaaaggctgtgaggcccctgatttcccactccacaccctatatttctgtgtgtgtgtctttaattcctctagccccactgggttgtggtctccacgaccgagctggtctcagcagccatctctctctctttttgtttttttttttaaaaacagagtctcgctttattacccaggctggagtacagtggcacaatcttggctcactgcaacctcgacctcctgggctcaagcgatcctcccatctcagcctcctgagtagctgggaccacaggtatgcaccaccatgcctggctaatttttgtattttttgtagagacggagtttcaccatgttgcctgggctggtctcgaactcctgggctcaagcatctgcctgcctcagcctcccatagtgctgggattacaggcatgagccactgtgcccggcctacatccaccgtctcactttccctcaatcttcaagtgctagactttgtattcccagtatggctttatgctgacttgagacccctctaagcatcatttcagtgccccagtgaaccctaatgtttaaacatttgcacatcatagatattgttcagcatagtgaaaggagttttgtacctatactatctcaagtttccaaaagctataagggctagacactgatccttccactttattgttcacctctcgaaatgcagcctctacatgctctaataattgtacttcccatatgcagttgactgtggtgatttgagccttttaaacacacaacctgactttgcctccccaacctccccccaacaaattacataagctggatactagtatttccagtctgttgttcagcacatggaatgaaatgtcctaggttctccatcattacaccccaacaatttcaaaaactgggctcttggcctcctagtatgtggctgagcatgttaaaggaagtatcatgacagaactctcaattccataacagacacaagtgccagacaaggcaacttccactgtacttctcagcacagtgaaaaaatacactatctcatttttttttttttttttgagatagagtctcgctctgtggtccaggatggagtgcagtggtgtgatctcagcccactgcaacctcacctcccaggttcaagtgattctcctgcctcagcctcccgagtagctaggactacaggcatgcaccaccatgcccagctaattttttttattttttttaatagatacagggtttcaccatgttagccaggctggtctctaactcctgacctcaggtgatctgccctccttggcctcccaaagttctgggattacaggcattagccaccatgcctagcccactagctcatttttcttttttttttttgagatggagtctcgctctgtcaccccagccggagtgcagtggtgccatcttggttcactgaaaccttcgcttcccaggttcaagcaattctcctgtctcagcctcttgaatagctgggactacaggcatgtgccaccacgcctggctaatttttttggtatttttagtggagatggggtttcgccacgttagccaggatggtctccatctcctgatctcatggtctgcccgccttggcctcccaaactgctgggattacaggcgtgagccaccgcacctggccctagctcatttttctaacaaactgtaacacttagatatgcttctcatgcctcttccaggatgctaaataggttgtcacttacccaccaactataaaagctcaacaattggccttctgtaccttgttcaacacaatgaggagcatctttaaatggtgctgccccatttccaatgggatgagagtgagattttacttttaatgagtttttcagcctattggatggattatcttgaaagacactccaagaaaccactaaaggaaatactttattccagtatcgtgttcactgtgctgaatggagtgttttacttgtactatttcactttacaacaactataaaagctattgtactgtgagggttaattccagcaggcctgaaattagcttgaactgttttgaagttcctgcgtggcaatgacccctggccaagagcatgaagcatattgattaataatgttgctttttaaccatcagtctgaggagcttcagggaaacttgtactaccatcaactttgcttttcgaaaacaatgagataaatgatttgcacctggtctcagcgagacccctccaacccctgccacagggctctgctgttgaggctggttatgccttaagactatgccgatgaccagcaaaatataaaaatccccagctgagactccattttcgatcccatttctgaggtgttccatgcacacatcaatggtttttgatccaacagagaaagtgcatcctgccacgttccttacagaaattaggacaaaggagctggcacctggcctatctggccatgaatagcctttgactgagatgcttattcttactttactgctatttgctatattgtgtcctcttactgtaacaaactcgagatgttggatctggtcagtaattttttagcagtgaaaccgtttaacttccacttaacgattatacaactggccgggcgcagtggctcacacctgtaatcccagcactttgggatgctgaggcaggtggatcatgaggtcaagagatggaggccatcctggccaacatggtgaaaccacgtctctactaaaaatacaaaaattagctgggtgtggtggcacacacctatagtcccagctactcgggaggttgaggcaggagaattgcttgaatctgggaggcggaggttgcagtgagccaagatcacgccactgcacaacagcctggtgacagagcaagattcggtctcaaaaaaaaaaaaaaaggcaattatatgactgcacttgtgtatgtgtgtttgattcaatatttcaaatggtttacattacctaaaatatatgcccccaaaggccttaaacctatactcccattatgttgttcagcacattgaacagggtctcttccatgcactgtctgtgttatgcaagaaactacaagatgcttgtacgtccctcaagatttttggcattatgagttgacttttcttacgggcaccattccagttatccagcaaattttaagaacttggcacttacatttctaatatattgctcagaatactgaatgaaggacaagaggtcaaggggtttagaagctgtggtgttgaagtaccatttataaggtaccgaaactaccaaaagtcatggcagggatagtgtaaagggagtgactgtgatgcaggcgctgcatcttcagagaattaggagagactcaggggtccctacgtggctgcagcaagcagggctggtctagtctaatgacatcagagtcaaagccagagactagagagtagggacacataatggtcttaagacagcaaagagaatatcacatccagacccagggacagggaggtgagtgtaggaagcatggttcaccaaaggaaaaccagggtgctattactagagtattgtggtatggatgctagctgctgggtgagtgagtgccaaagtggtctgaagattgcttttttttttttttgagacggagtctttctctctgttgcccaggctggagtgcagtggcaccatcttagctcactgcaacctctgcctcccaggttcaaacaattctcctgcctcagctgggattacaggcatgcgccaccacagccagctaatttttgtatttttagtagagacagtgtttcaccatgttgaccaggctggtctcgaactcccgacctcaagtaatctgcccaccttggccccccaaagtgttgggattacaggtgtgagccactgtacccagctgatgggatagaagatttctgagggaggtgaactggggggtctacatggtagactagaggcaggagggggaaataaattacaggtatagctgtagacagagctgaaaggggtaggggacaggggtaagaggacaaagagaagcaaggtatgggtttagacatagggtcattgaggactacgtcttcacacatttcatttgtgtgtggcctggcgcgctcctatgggaccttcaattggaagcctcaagtcctgtcactgatacgttgaacatgtttgacagatagattgtgaccacaatgccactttaccttggttacagctctttcacacttgaatcagtgggggtaatcttccctagcccttagatgaacactgcagcaggcctttaacattctctctttttcttaggtattaaacagtaggggctcctacttgtagcacagagtcttagctgacacaggagacacagtgggcattggagaatgggttccaggtaagtgtcttcttgttgaagttgcacaacagccttggaactagttatgtaatatggggtccgggttgttttttgtttgtttgtttgtcgctcatattttcctacatgtagtctgatcacttgaataattaggacattaaattgcaatatcatttggatgcacaagtacaaaattaacattgtagagctgacatctcacagtttagctaaattttggcatttgcagatttttaaaagcataactgcaacttctttgacacttctatcttcaagaggttgggcttgaacctctatggctcctccccatgagggtggggttgtgactgcttccatcaagagagtagggtggagttatgtgacctccgaggctaggacataaaaggccacgaagcttcctccttgtttactggaatgcttgctcttggagccctgagctgccatgcaagacttccagctactccaaggccaccatggagaagcctagtttaggtgctccagttagtctgcagccctagtgcccaagtcatcccagtgcagatggcagctatgtgagtgaatgagccttgagatcggggttagccaactttttatctaaagggccagattgcatggctttgtgggccacataatctctgtcacaattaccaacatgaatgactgtgtttcgataacgattatttgcaaaaagaagccataggcctgcaggttataatttactttacatgattctaatccccaaccatttgagcctaaggtcccaggcagatatggaggagcaaggacaacctatttcccctgtgctctgtccaaacctccgatccacagaattcaggaatctaataaaatggctgacattttactcccactatgtttggggtggtatatcaaacaccggtagatagctgaagagtattgtacaaggcaggcctcaacaagaaagtgagatttgagctgacttggaggagagccaactgggaagctgtgtgtctaggggaagagcatttcaggcagagagaacagccagtgcaaacctttgggcggaggagtgcttggtatatgtgagcaatagcaaggaaattgcaggagaacagctctgccgaggtgtccttggcaatcttgcacatctctcgaggccatgtaggcaaggtatgaccacggtctgacccaagtcttgttggactgccctgtgatttcccctaaagcagggatgggtaagcctggtgaggagccactggtaggcagtttcctatccctaccccatgggagactgctgcaaggccatttctcttccttctccaacgtttcagttgactgcaggactttccatatccctccctccaccgcccagcccgcttccctccaagcatacagcggcaggctcctgtgaagtctataaaactgcttggtgtaatttagacttggctactcagcggcagggctcatgttgtcttatttatttatttatttatttatttatttttgttaaattatgtagacccataggataacactgacccttccagtttggtgttatcttgtaggcctaaggatgcatggagctgacaccacactgattttgcttttgctgtcggtgtaagtaataacctgtctaaacccatctgggctgcctgtctccttcccgtagccaaatctacgggaagtgtccagccagtgtaggggtcaagggaccgcttgacgagaccaacgtaaattgaagaggcgtaaggagatgaggccaaagaggaaaggggaccaggtcacgtagaacctcgtagaccactgcagaaccttggcttacgtacgcagagacagcaggaaccactgataggtttagggagatttgaggagagggacatgatttggcttatgttatgttgttaaagggaccacattaaaatacattcattctaaaagtgttacctttaagaaactacgtatataaattaagttactgttgccattattagcgtaagtagttacatttctcttacgactcactctctgctactgcctcttggaccctgcacaccttgtggaggcccatgagagtgacgtgctgtggttccccctctccccactcctgctctgcactttgtcattcacgttcatctccctccttgagtgtcacctctctctggctcgtcacggagccacggcaaagcgtcctttcccaggaacccctccccctggggaggtgagctcctcgccgccagggccgtgtcgcgcacctcgggccgggtacccaggcggcgctcggcggcgagcggaatggatgtggaggagcgctcggcagggagcgctgccgccctggccttggcctctgggagcggcgcggccagggttttctgtgtcagccaagcccggaatgcgggggcgcctctggaccctcctcttgggtctgggggctgcctcgggcatcctctactcctctcccaccttctgtccttccccatctcccacccacacgtgtggggccccggacccgcgcagcggccagagccttccgctgtggacctccagtccacccctccccttcacttctctttccggctccctccgggtctctcagccccctccccttcctctccgcccccttccccgccgtctgcccagcggcggccttcggcccgccccttctctccaaccccctccctttcccctttacgcccctcctccccctcgtcctcccgccccctcccaccccaacctgctgggcccgccgggactcgcccccctgcccgctcctctcctccagccccggccggcctcggctcggcccccggcccgccccttccagccctcggcacctcccgccggccgcttggctccgccactcggcactcactgcccgggccgcccggacagggagcttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagaggtgagtgcgcccggctgggggccaggcgagggggtgggggctcccaggaggaagcaggggcctctggggagggagcgcgtccacaggggcgcgcctggctgctggacaagtttgcaaacaccctccacccactgcggtgccagaggagggggcgtaggcgaacctaccgtccactgaccgcggcgcctcaagcgtcccgagggcacccagcctggcttgcgggtgcgcatcgtggtgaagccgggtcggggtcggcgttgcaggctcccctcttcaccgcagaggaggaaatcgagctcggccgggcgcgctgcaagtcctgaagttccgacgagtggaacgtaggtagcaggtctggtctgggatgcgacgagaactttccactagagttgcatggtggggccccgctctggccggagtcccgggggccacagatccggtctcccgagggaccggcgcggggcgaacgaacgggctgcgggagtcggagccgcagtccgggagccgcgatagactgaggccgagcgacgggccagggggggacggcagtcctggctgctcccaatgggcccttacgggcattattagtatccctttttaggggcacccagagagtgtgggaaaaggggagcgttcttttcactcctgttatggcagaacagaacttacagtgctcggcagcgtttacgtttatctggattcagcgaagtgttgttacaggcttttttttttttaatttgagaccgagtctcgccctgtcgcccaggctggagtgccgcggcgcgatctcggctcactgcaggctccgcctcccgggttcaagcgattctcctgcctcagcctcccgagtagctgagactatagacgcgcgctaccacgtccggctaatttttgtatttttagtagagacggggtttcaccatgttggccaggatggtctcgatctcttgacctcgtgatctgctctccttggcctcccaaagttctgggattacagtcgtgagccaccgcgcccggcttgttccaggcattttaatacaagatgctggactgatacgtggaggcaaggaaggccggtttcattctgcttgaacagcttatttggggagtgagtgatgaacagatttcaagtttgatcgctgatgcacttcttgaggaggctggaataaacttaccaggctttacccaaaagaaaaagaaaggggaaaaatgctaaataaacacattccaagtattttctctcagctaaaaggtttctatttccattcagcatgtagattttctctcttttgatcgagaatgcacttgactagccttcacctattacagtcaaagatgttttttaggaatacctggaaagctcagtttatagtcaagtaagttacttaaaagtttttcctttgagattttcctttgaaagctcatttactcaaatgaaaaattcttaaacagtgcacccactttttgcacgttaaattacataagcaatttataatttggggcaacatagcaatttgaaacaaactttaagagccaggcaaagaactaaagcagttctgttctccactgcccctccctccaccaaaccttcaaaaattcctcagcatttctgccagccccatttttcataatctgctgcaaatctgttatttgttgctactagtgaggactggccgtgaatagtcttggaggtagtgaatgtggtgagaactatggagaaagtaatgggaacaatagttttgtgttaaatacttaaaaattggagtgcttttgtttttctaaaattttaaaaggctgtaataacaaatttttgtagctgacaatcaactttaatcagacaatcataaaaaggccttttaaaatccacccagctggaagaatgaaaagtttcaccaatcgttcttgcactttttgcttttggttttgaactttacctatgagatgtgtgacagttttacatctcaccttgtgaaaagcttaaagaatgggattctcactggcagaattacagcacaaaggagtgctgtatgaagaaattaaacatggaaattagactcttcatctaattttaagattttcctattacacattgtgggtctgagtgctttgctgaccacacaggggagacagagagagagacaatgagaatatgtgtgtagattctacactgttagcagtatagaagaatgggtaaataaaatttaagcatcactttaacccaggaaatcccctctgccccccaacacacatacacactacacgtctcacaaagacatgcacacacagaactggaactgccaaaccaggagcatttcgaggctttccagtctttcctttctgctcagtctctgatgggggtgccattgagcagcaaaatgaggcaagcggtggctctctgaagggccagggagaggatggagcaagataaatataaatgtggataaaaatgaatgcattatgaggacttagctcatgacgaggctgtgtgtgcagctaaactcaacccttagagtaaattaggcttttaagattctttaatgttaatatttcttttccaaactgatattgtaacatgtattccagtatattgtaaacatcttcccagagggaacttttaagttgttctgttgcttgtgggctttattccaaaggcttcaaatgctttttgaaagtacatcgtgcatattttaaaaatgaatacttttagaaaattattctgacccattaaagtgctgagtggaattcttttcttttctttctttcttttttttttttttttggcaggttctcattctgccacccaggctagagtgcagtggcaccatcacggctcactgcaacctcaaccttccgggctcaagtgatcctcccacctcagcctcccaagtagctatgaccacaggcacataccaccatgcctggctaattttttattttttgtagagacaggatctcactatgttgcccaggctggtcttgaactcctgggctcaagcgatcttcccaccttagcctctcagagtgtggggattataggcatgagccaccatgcacagctgaatacaatttttaaaaaattaacaataattatgtttttttgtttttgagatagagtttcactcttgctgtccaggctagagtgcaatggcacaatctcggctcaccgcaacttcccgcctcccgggttcaagcagttctcctgcctcagcctcctgagtagctgggattacaggcatgcaccaccacgcctggctaattttgtatttttggtagagacagggtttctccgtgttggttaggttggtctcgaactcccaacctcaggtgatctgcctgccttggcctcccaaagtgctgggattacaggcatgagccaccacacccagccaataattatatttttaaatcttaatttttgaaataatttccagataattgtagaagggccagtgagttactagtcagcattggtcaagaagaggttcaatctttttatgcctgtgaattgggaacatgctgctgggtagaaaaactgagctgggaccttgaacacacatgtgaaacagtcgctttccatataatagccagaatgagattttggaaacgaatctgattgtattttccatttgaaaatcttccagtggcttcctgttccctactagaatttgcagagactcacagcgaacctctttgacccatttccattcacttccctcttgttcctaccactccagccacctgtgtcttctttctagggcctgagcagcctttgcagtgactcttccctctggctggaacctttttcccaagatctcggcatgctggcttcttctcatcctttgggtttcagttcagaggttctccttgagaagccttccccaataaccaccccctgccaaagtatcatatgcatacaccccactatcccttaaatttaatttcctgataatgcttctcacaacctgatcagttccttccttccttccttccttcctccctccctccctccctctatttctttattgacagagtcttgcaatggcaaattctctgctcactgcaacctccgcctcccaggttcaagcaattctcctgcctcagccttcccagtagctgggattacaggcacctgccaccacagctggctaatttttgtatttttagtagagacagggtttcaccatgttggccaggctggtctcgaactcctgacctcaggtgatccgcctacctcagcctcccaaagtgcagagattacaggcgtgagctatggcacccagccttacctctttgtttactccttttcctccactgtccccccaccacaaggtaagctcctggtggcagggctgctgtctttttcactgctaacacagcatggagctcatacgggtgctcagtgagtatcagagcacagcatgaaggaaccaagcccctgcatgtcttaccaggtgctcttcacccttatcttttcctactggcttttccagaaacagaattgctggagctcccatgccctcacattcggggcttggttaatagaaaacaatcttttattttgctgtgatgccaatgtgatttcattgctggaggagctagtcaattaaaaccagacagatttttgggctgtattaaccccaaacatattttacattgtcctaactattccaactagaaaaaaaaatgtcagaaggtaatttttcatgttaaacacagttctaacaactccttgctcaggggcaggtagccctgggtgccttgactttggcccttgccgttagtttaatcttaacccaaagcacatggctctgaattggtatgtttctcagcaggagattaattattataaaaactgaaaggggtctcacactgtgtgaggcacactatgcctctggggactggaatgaaagtgttaaccgggactggcttctggggctttgggggtggtgattaactttcaggacctctgttcctttttgggtacagtgggaggctcttttcatagaattgttaggaggacgtaatgagctaatggcaggtgatatgtgcttaaaatatatttgccattattaccaatggttctcctccattcttctgaactcaagtatgggggaaatgtttttcctagacaaaaggtgttgggaggagggttcttttcttattgaagtgtatcctgaatggtccaccctccattgttcagaatgctttggtgaaggggccctccggtgtcgccctagagtgcccaagtcctttgctgcagctctttaggtttttgtttcctagtagtttgagcaaaacccacccaggaccaagcagttctccagagaagcagggcccgccctgactgccattcccctcctactcctgcccccataccttcccttatggagttcaaacttgacatagtacaggaatagcttcttgtcatgtgcctctcaggaaggtataaaaatgaagtccagttcctgttcaacttttcccacataactcttttccaaactgggtgtggtttaaatttttttatttttattttttgtgtttgttttgttttagggtttttgagtgtgaacatccagaaaattcttttttttttttttgagatggaatcttgctctgtcgcccaggctggagtgcatgtggcgcgatctcggctcactgcaacctccgcctcctggcttcaagcaattctctgcctcagcctcccaagtagctgggattacaggtgccctccaccagacctggctaatttttgtattttaagtagagacggggtttcaccgtgttgggcaggctggtcttgaactcctgacctcgcgatccacccacctcggcctctcaaagtgctgggattacaggagtgaaccacctcacccagctcagaaaattcttttcctttttaccacatcgagctaggttttcccaatgaggtcagttggctgcaacatagagaaaatgaggctttggttcttagagtagattccgtgtacaggcgtgagtatgtgtccgcaggtggtcttgtaggaaatgcaaagggcgccaggtgcactcctggcttctggtacttcctgcttaatggcatgggtgagccaaccctcaggtgcccgggagggagccctgattactctccctctggcactctgggcattggctaacccgtgaccggagttaaaccagttccctctcttttcattctatgtctcccactcctgcctccagccgaagtgctaaaaatgcagcctggcaggggcagagaattccattaggatcagcaggccccttttggagaacaaggatactaagaatacctgccatcctggcacttcctccctcctaggccttacttttctctgtctgaaccatggctgttgaactgggtgattcttagccacaggaagggagggcctagatcttccctagttttgtgagactctgcagctggacagccatcccttcatgggagctgccacattttcactctcggggcctctgacaggcactaggatctagggacatggccggcatgtgaaaccctgggctgctatggccaggtcacctcctcaggtcctggtgtttcagagtgataaagaagaaagggtgattatgtctcaaacatttcattgagaaacctacactgttctttttttttttttttttttttttgacatggaggctcactctgtcacccaggctggagtgcagtggcgcgatctcagcttactgcagcctcctgggttcaagcgattgaacccagggttcaacctcctgggttcaagcggttctcctgtctcagcctcccgagtagctgggattacaggcacccattaccacacccagctaatttttgtattttttagtagagacaacgtttcacaatgttggcctggctggtctcgaactcctggcctcaggtgattggcccacctcagcctcccaaagtgctgggattataggcgtgagccaccgtgcccagccagaaacctacactcaattctaaagcattttatttcatccttcttggctagttcttcaattatcagtgcttctttcactcaatggtaaatggattttccatgagtcttggaggtggcaggcagggagaaggggcagaaggaaagagaaagagagaacagatgttggctttatgtttggaataaaattacaccaaaagctaagaacatttatatttgtgcttagagaaaccccatttcatttcagaagctcaatgcctggatttttttgccagcacattttacacttgtatgtttctccttgtactctgtgcctccatgtatttctgttggtcccttgaaaacaagatccaatcatcacagggttagtgctctgccctaggtcactccagtaggggtccatcctccggatttagatctcaggttggcacttatgcaaatgctttctgacaggtccccttttttgtgtaatctgctttttctttgaggatctagatacctcagcattcagggacagtaaacatcttagaacttgccttagctgtggtcttgcctctcattagatacacaaagaaaagccttgtttattttggagaaggaattgttttgttattttaagccttagggccttgtggttagagctaccaatagtagattggcttcattatggttttgaaaatgatcactttcacaagtaagaacaggctgtcttagtggagaatattagaacagagactcaaacttaactgaaagttgttttctgtcactgtgccgcttagggaattctcagtgcggtgataaatattcatggacttcccaagtgttgtgtgtgcctggaggccagtttttcacttgttccaattaacggcaggctgcctccacacaggaagtgaaaccagcctttaagcctttttacaattctggcacatgatttgaagatttggtgatgaaagcaatgttctttgaaagttttggagcaaataaaaaaaagaagctttttagattcactcttagtttaaaaaataaccacttggggagttgaaagatgtaagttctcatcctagctttgagaggaacctgcagggacagctggggtatagtgtgtcctccttctaaaactccacatcctcacttgtcaaatgggaaagcagatggatgattctaggcccctttggggcagaacactgattccatctaaaggggagaggtgggaagggatactttctcccatgccgtttgggacacagagcctcagcctgagtttgaccctcagccctgtgcgtgactctcggtgtgaactttcttagacatcagcccagaaacggagatggaggctgtgtgaagagtttcattaaaaatgagtgatgcagccaggtgcggtggctcacgcctgtaatcccagcactttgggaggtcagggtgggtggatcacctgaggtcaggagtttgagaccagcctgaccaacatggtaaaaccctgtctctactaaatacaaaaaattagccaggcgtggtggcgcatgcctgtaatcccagcaacttgggaggctgaggcagaagaatcacttgaacccaggaggcggaggttgcagtgagccgagattgtgccactgcactccagcctgggcaataacagtaaaactccgtatcaaaaaaaagagtgatgctagtgggttctttgctgttgacagttgccattccctgccacctgggctgtctgttcctccagtaagtaccccctccaactctggggcaatagaatagtctggaaacatggaggtatatttctgagaatattggatctccccaaacacatatgacctcttcctgctaaatcttctgagagacagagggatggactaagctttttccggggtggatggagtggggcatatcccccctgagggggaacagcagaatcttcaggatcagggagaatgatgtcattttcaaaagtttattcattcaatattattatgtcattttataattggaaatttaaaaaatattttgtgatataaactgtagaatgcaacgctcttaaatattctggctgggaagataaggataaagacaatgattcatgacaggggttctcaagaagaggtatgcttcagaactacctaggaagcattttcgcaaggtagaagctcaggttcccaggacccgtggactcaatctttggggctgtggccctgccttgtgtatgtccaagctattctgtgccacctctttcgttacactccactgatgcagtatatctgatgtctgattcttgggcagtggtggggagcctctctctattaccccatcccaggaggggtatgtatcagaacctggccattgagggtaggagtaagctaattatgcttatccaagggaggtggcaattcctagacaaagtgagaatgttgagctggatgattcattaagccaagtgcccttaggattttaggacctgttggtggaaagagatacagctaatcaggtgggccaaccagtaaatagtaaggcctttccctttttaccattatattttttcctctcagctactctttatactcacatcttattataaaatatttaggatacacaaaaggatttaacaggtaataaaactcgcctgtgtactcactacttgacgtaagaagtcagacattaacactacagtggaagtccccggtcgttcctctctccagtgtcatcccctcactcccacccagagaaaaccattatcccacattgggtgtttcaattcccatgcatgtctttatcctttgatcatgattgacatgattatgttggtaacactctatagtgttgttttgcaccatgtcagttacatttgattgcatataacagaaaaccttacttcagtggtgtaaccaaaatgggagtatttttctcatacaacaagcagtctgacagcaaccaggttgggattagacagtggctccatgataaagtcaatgacctggctcttggctctgacatctatagtgtatgcttttagaacacattgttccttaaatggctgctgtgcttctgggcatttcatttgcattccaggcagaaaaaagcagaagggaaaaggacaaaaagtctcataccagctgagtctgtcctttttatcaagaaggtgactggaacatctcaacagcaaaaaacaagcaatccgattaaaaaatgaacaagtgatctaaacatatttctcaaaagaagaaatacaaatggctaacagataaatatatgaaaaaatgcttaacatcactaatcatcagggagatgtaaaccaaaattacaacctggtttcatttcattgcatttaggatggctatgtcaaaaaggcaaaaaataacaaatgctggcaaaggtgcagagaaaagggaactcatacactgctggtggggatttaaactatcacagccactattgtggcaggccaggtctcggtaacgcaggcctctgtaacaactgtttcagcactgagtggttaagttaaatattaaaagctaatagagccggtgccctcatacaaaggctggaatgtaatgaaagcccaccagaagttttgcccaggcctttcctgggccttgactcatgacaagataacaaaggaattcttaacaggcctcatttaggattaaacaagttttactggggatcttaagaaattccccagacctccacaaacaagtttattgggggtctgaaggaactcctcaaacctccatgatttagcgggagacaagataataaggataatcaccccagcacctggattcacttagattaagtacatttactgaggctccagaagaaggtcctcaggactcagaccttagttatagattagaagaagttaatcacttatgtctttaaatgaatgcacacttccatgtagacatatagcttagaaggtatataatccctggaaaacgtaattttgagttgatgtggtgatgttttccaggccttctccctgtacccagggagaaataaactcccttctttcccagttcatctgcatctcattattgggcatgagaataagcagcccaaccctcagttcggtccgggaacactatgaagaatggtatggaggttcctcaaaaaactacagatggaactaccatatgatcctgtaattgcactactggtcatttatccaaaagaaaggatatcagtatatcaaaaagacatctgcaccctcatgtttaatatagcactattcacaatagccaagctaaggaatcagtctaggtgtccatcaacggatgaatggataaagaaaatgtggtataagctttggcaacatggcaagacctggtctctactagaaataaaaaaattagctagacattgtggtgcatgcctatggtcatagctgctcagcaggctgaggtgggaggactccttgagcccaggagtttgagactgtactgagctatgattgccttactgcactccagcctgggcaacagagtgagaccctgtctctgttttttgtttttttttttttgagacaaagtctcgctcttgtcccccaggctggaatgcagtggcatgatctcagctcactgcaacttctgcctcctgggttcaagtgattcttctccctcggcaccccgagtagctgggattacaggcgcctgccaccacgcctggctaatttttgtatttttatttgagatggggtttcaccatgttggccaggctgatctcgaactcctgacctcaggtgatccacccgcctcagtctcccaaagttctgggattacaggcatgagccacctcacccggctgaccctgtaacttaaaaaaaaagtgtgtgtgtgtgtgtgtgtatatatatatatatatacaaatggaatactattaaatatttagccataaagtaatgaaatcctgtcattggtagcaacatggatggaactggaagacatttggttaattaaaacaagccagaaacaaagttaaacaccacatgtcctcactcataggtggaagctaaacaaaaaagttgattttgtagaagtaaaaagtaggacaaaggttactagggcctggaaaggataggaggaaggggaggataggaagagatttgttaaagaattcaaaattacagcaagataggagggataagtttagtgttccatagcactgtaggattactatagttaacagtaatgtgtaatgtgctccatagatatgtacaattatgttaattaaagcagcttttaaaaaagaaggtgataactcaatacgaagccctatgctatggacttcagctaacctttccctgattattccaagctgccaggaagagtggcaagtcaagtgtgctagctgggcaagttgccaccctgaatgagattgggtcccctttgtggaaacaaggggaaatgggtgctgagcaggacgctagcagcagcttaccacatacatgttataaaatttcatataaatagtatgctttcttcttcagcttgctttttcactgtttgtgaagtttgctaaattcatctgagttgaaaagtgtaacctttgttcatttatcttcatagacaaatatgtaaatataccatagttttatttatccaatctcctccttttgtttttttgttttctttcttttttttgagacagagtctcactctgttgcccaggctggagtgcaatggcgctatctcagctcactgcaacctccgcctcctgggttcaagtgattctcctgcctcagtctcccgagtagttgggattacaggtgcacaccaccatgcccagctaatttttgtatttttagtaaagatggggtttcaccatgttggccaggctggtcttgaactcctgacctccagtgtgatctgcccgtctcagcctcccaagtgctgggattacaggcatgagccatagcgcccagcctttttttttttttttttttttttttttgagttggctgttgcccaggctgaaatgcagtggtgccatcatagctcactggagcctaaactcctgggctcaagtgatcctcccacctcagcctgttgagtagctaggactacaggtgcatgccaacacagccagctgtttcttaacttttttgtagagatgaggttttgccacattgtcgaggctggtctctaactcctggggtcaagtgatcctcctgcctcggcctgccaaagtgtggggattacagacatgagccactgtgcctggcttccaatcgctttatttatttatttatttatttatgacggagtctcacgctgtcaccccggctggagtgcagtggtgcgatctcggctcactgcaacctccaccttccaggttcaagtgattctcctgcctcagcctaccaagtagctaggattacaggtgcccaccaccatgcccagctaatttttttttttgtatttttagtagagatggggtttcaccatgctggccaggccggtcttgaattcctgacctcatgatttgcccacctcggtctcccaaagtgctggaattacgggcatgagccaccacacccggccccagttgcctcttaatgggcatttaggttttcctgaatttttctattacaaacaacgttgccatgaacattattcttttctattgtgaggtttcctttgccataattaaatgtgcagattttaagtgtggagtctgatgagttttaataaatataggtatcaaaacccctatccaagttaagagcccttaaccttcttacatgtctccctatggacatgtgtgagtctaggagtggaaacactgagttgtaggttatatgcaatttcagccccattatatgttgccagtcctgcacatcttataggcaggttattgccatgggagatctggactaagatatttcttcccaagagtactctaaacagatctgagaatactcctcagggcaggttgcaactagattgtgaagtgagtgatgcaactggctctttcgccactcatgcttatcattcagtgccccatcctcacccttggctgtcacacactggagccttccctcagttcaaccctcagaaccacctgcaacccagggctcagtagctggggcttgtatgtggactgcaaggttagggtagttggtggctgtgagaagccctcttcattccttcctagccatggagagctgggcaagtcgtttagcatctgggaacctcaggatcctcatctatgaactggggacaattccagtgatacacccttcacaggattagagaagactgtctaggtaaaaggcctggcgaaaggtgaaaaagtttctgtgtgggttgatacaggtactgggtcctttgctttttacccagtagaagatattgaacatagatttgtaacattgcttaaaggacctctatgccaggaatcaaggacaaaggccaaatatatactttgaaattatactacaatctgtatatcaatttggggagaattgatattttttctaggttgagatttccaatttatgaacacagtatatctctccatttagttatatcttcttgtatttctttcatcagtgttttgttgtttttagcagaagagttctgtatgtgctttgttagatttatacctaagtatttcaccatttggagtgattgtaaatggtattgtatttttaatttcaatgtctatgtgtttattgcttcatatgtagaaatacaataatttgtatcttgcaaccttgataaaataacttatttgttccaaggagacttttttatagattccttggaattttcttttttttctttttctttttttgagatggagtctcactctgtcacccaggttggagtacagtggtgcaatctcagctcactgcaacctccgcctccagggctcaagcgattcttgtgcctcagcctctggagtagctgggattacaggcgcatgccaccaccatgcctggctaatttttttgtatttttgatagaggtggggtttcaccattttggccaggctggtgttgaactcctgacttcaggtgatccacccacctcagcctgccaaagtgctaggattacaggcatgagccactgtgcctagccttccttggaattttctatgaagataatcatatctgcaagtagcaatccttttattttcttcttttctgatcttttctttctgatgtgttttacttcttttacttgctttattgcattggttacaactttcagcacggtgttgaataagaatggggaaagcagatatccttgccttgttcccatccattttttttttcagatctttattaagttgaggatgtgcccctcttttctttctttctttctttctttcttttttttttttttttttttttgagatggagtctcctctgtcacccaggctggagtgcagtggcacgatcttggctcactgcaacctctgcctcccaggttcaagtgattctcctgtctcagcccccaagtagccaggactacaggtgtgcaccaccacgcccggctaatttttgtatttttgtttgtttgtttgagacagagtcttgctctgtggcccaggctggagtgcaatggtgcaatcacggctcactgcaagctctgcctcccgggttcatgccattctcctgcctcagcctcccaagtagctgggactgcaggtgtgagccactgcgcccggcctaatttttgtatttttagtagagacagggtttcaccatgttggccatgctggtcttgaactcctgacttcaggtgatctacctgccttggcctcccaaagtgctgggattacaggcatgagccaccatgtctggcttcttcctaattttcttagagggttttttttcccccatgagcgaatattgaattttgttaaatgaacaatatgatcatgtgatttttatttttttagtctgttagtatgctggatgacattgtctgattttcaaatactgaactagctttctatccatggcataaattccacttgattgtggtatataattatttttatatattggtgagttctatttgttgatattttgttaataatttttttgtgtttatattcatgaagaatgttgatctgttttttctgtatttttgtctggttttggtatcagagcaatactagcttcataaaatatattaggaagttccaccctctcttctaatttctgaaggagattatgtggaattggtgttaattcttctttaagcatttggcataattctccaatgaaaccatctgggcctggagatttgtttttcggtagtttaaaaaattatgaattcaatttccttaatagttatagcctgattcaaattatctatttcatgtggggtacattgtgatagtttatgttttttgaagatttaattcacttcctctatgctaccaaattcatgtgtggttatttgtactattcacttatccttttgatgtctgcagagtctatggtgatttcccctgttttattcctgatattaacaatttgtcttctcatttttttctttgttggtcttgttagaggtttgttaattttattggtcttttcaaagaatttgttgtttgtttcattgattctgtattgctttttttttcattttctttttttatctattattttcttctttctgcttgttttgggtttattttgctctttccctgtgttctaaacttaaatgatggatttgagacttttcctctattttaatactataaattttccccagcactgctttagctgtatcccacaaattttgacatgttgcgtttttattttcatttagttcaacgtattttttaaaatttttttcttgacacttctttgacccatggactatttagaagtttagtttgcggctgggcgtggtaatcccagcactttgggaggctgaagcgggtggatcacctgaggtcaggagttcgagaccagtctgaccaacatggtgaaacctcatctctactaaatacaaaaaattagccaggcttggtggcacgtgcctgtaatcccagctatttggggagctgaggcaggagaatcacttgaacccgggagacagaggttgtagtaagctgagattgcactattgcactctagcctgggcaacaagagcaaaaactccatctccaaaataaataaataaataagtttagtttgcaagtgttgagaatttctattgtgtttctgttattaatatctggttatttccattgtaattagagaacatagactatatgatttcagttatttttaatttgttgaggtttgctttatatcattgatcttcgaaagaatgtgtattctattgttgggaagagtgttctataaatatagattatatttttttcttttctttatttttttgaaacagggtctcattctgtcacccaggctgaagtgcagtggcactctgatggcaccatcttggctcactgcaagctccgcctcccgggttcaagcaattccgcccaccttggcttcccaaagtgctgggattacaggcgagagccaccgcgcctggcccttcaagttcccttttagccttgctttctttctcctctcctttcaggacttcagtgatacggattttagatctttaatagtagtcccagagactctattcatttttttcagtctcttctcatggtcaaattgaattctattgttttgtttttagtataccgattctttcttttgttcccctttcattttactgttgaacttatccattgagtttttaaatttttggttattgtatttttttagttctaaaatttccttttgatttttaaaaagatcttctatttctttactgagactttgtatttctttgctgtggctttctgttttttcatgtttcaagcatgttcataattgttcatttaaatatttttatgattgcttctttaaaagatttttcagaagatttgtcattttgatgttggcatttcattctgcttgagatcagttttatttatttatttatttttttggcacacagacattttgagaccctggatcttagtttagtcttctgttttacctgttttcctctgacttgctctggctggggaagagggcatgctgcctcgttgctgccaggtaggggtagaattctaggttcctcactcagcctccattgacatctgagtgtggggatatcttcattactgctggtcagaggtcaggtggcagttccggctccccaccaggcttccactgatacctctctggctcagaggggtagaagtgcctcatttctgttccaattcttccccacctggcctccccaaacactagagtagggggaaggatggcctcctttctggttggcagtgaaagccctgactttctgcaggccccagatactgccccagtagggaggaggagagatgcttcattgcttcattaatgctgggtggggatggaaggcctggctcccacatggtcctcacaccagtcagtggggctagacatcttagttctctacttcctctaggccctttctgacgccaccctggagggccacttgtagtacttctctatagcttggtgagggtggaagtctagatttctcacttgacttttgctggtgtggatggggacggggccgtgatgtgttttgggttgcttgcctggagtagagcagtttattgtctaaaagttttctgtctggctgggctgcccctttccttgtctttagctcctagtctaggacatatggggcaaaaggaaaccgatttgttcttgagtcctgaggttcctagccagtctgcctgcttctctctacctttcagagttttgtcttgttttttaaaattatgctaaaagacgaggccaggcgcagtggccgacgcctgtaatcccagcactttgggaggccgaggtgggcggatcacaaggtcaagagatggagaccatcctggccaacatggtgaaaccccgtctctactaaaaatacaaaaattagctgggcgtggtagcgtgcgcctgtagtcccagctactccggaggctgaggcaggagaatcgcttaaacctgggaggtggaggttgcagtgagtcgagatcgtgcgactacactccagcctggtgacagagtgagactctgtcttaaaaaaaaaaaaaaatgccaaaagacacataacatataatttaccatcttaaccatttgtaagtgtagagctcagtggaattaaatatattcataatgttgtgcagtcgtggccaccattcattttcatcctgtaaaactgaaactctgtaaccattaaacactaattccccattccctctccccttagccactggcaaccaccatcctatctatattctgttctatgtgatttttgactactctaagtcagagttttgaaaatgcttatttaatatctagtgttctggggtgtacttagtgggaagaatagggaaaagtacatctagtctgtttttggaggggattctttgttctctgttacttagggaggactttaacaaacttcttgctaacaggtctggtcttccggagatagtcacattttaaaagaaaattgttttttccttaaggatcggctttttagtaatagtaatttacgtactggtaggctggagtatatgttttgggagtggcatgatggaaaagttaacatgaactgagcatctcatctgggtcttatgaaagccacagttgggcctccggcagtatcaaccccagacccccagaggggaaagcccctttgagaccctggccagacagtattgcctcagagcctttctgtgacaattggcatgctgccagtggagaaagcagagggaaacctttggttaagtaaacatgatattgtatacagtattcatatttcattgcaagagttgaatggtctgagtcagcataatcagttccatatgtttggcattgatagtccaggcatgactagttgcacctttgaaacaagacagatcagatgtttcatgttaggaaaataatagctgccatttattgcatgtctgtggatgccagacactgtgcattgtttcacgtgcaatattccactcttatcttggagagaaaacaggtactgaagtagagaattcaggtactggtgagctggagggtatgttttgggagtggcatgatggagaaattaaacttggggactcagcatctcttctgggtcttgtgaaagccacagctgagtcttggggagaatcaaccccagagccccaaaggctggagggaaactgtctcattttacagaaagaggagagtgagttttgaatggacaggtgacttacacaaggtcacctggcctctacgtggctgagctggggctatgccttgtccctctgactttagggttcttgttctcaccccacctctcctgcagcctcctcatctcctaaagcacgtgcagtcaaacctgggccctctgcatgaggatttgcgagctccatccaggccattcagtgccccccatccctggccttccgcagccccctggcccaccttagagtgatctgtgccactgaatctattccctaaagtaggggtctgaccctggctgcacattagaatcataagaggagatttttttttaaatcccagtgcccaagctgcaccctgagccaataaattcaagccctgggtgggacatgggcatcagaagcttaaaaacatttcctggaagattctgatgttccgctgggtttgacagcatagtgggagagttggaagaagatagtgaaaagtcgaggtcagattctggaaggctcttttctggttgcattggtgccccccatggtagggacatggacattgcagtctgtttgggaagcttcttttgcaaagcaccaccaagaaaaaggcaaatgccccagtgaaaaagtgggggacaggctgaaagggatgatgagagggtacctaaagccctttggggcccttggggcttgccctgctaacatgtgtgttcaaggccaagcagagaggtacctctgctcattttgttttttgatgttttttctttttcttttctttttttttttttttttgagccaaaaggaatgtattgggccaggggcagtaggaaggtcaccccactgataagcaagccccttgtgcttttgctcagatgtctcagccccttcatgctgcaagccttggttcagagaggttggatagctttcctggtgtgccaggtccctgtttgcccctccagacccactctccatgctgctctaagccccaagaagcagcctgtgggaagggcaacaatgaaatccctagtgctgtggctccagctggttttgactaaatgatactaagttatatttgttcctctaagtaaatccggggtgttcccatattggttgcttatctgaaattcaggtgtaaagggctgtactgttttttatctggcaacccaatgccaacaccgtgttttacaggcaacttcacgttccttccaccgtgcaggcatttctgggctttcactggcacttgggcttttctcctcctgtggctgggctgtgacctcttggggcacacactgcccagccatttacttcctttccttcctgcaagcgccaggcctgttctctccagcactgactcagagccagccacccgctttctcttgcagggctttgctacacttagggcaaatgggtggcgtgatcgcctcttcctcctttaacattctccaagtggcccaagggtcactccagtgaagttaataattaccatttgcaatttaggactgatccatcaggtcaagtgagttctgattgaaggttgttttttttttttctttttcttctaatgaagtgttgctactctgtttgtttgtttttcttctaatgaagtgttgctactctttattttatttatttatttatttattttccgaaacagagtctcactgtgttgcctacgctggagtgcagtggcgtgatctcagctcactgcaacttctgcctcccgggttcaagcaattctccctgcctcaccctcccgagtagctgggattacaggcgcctgccaccaggcctggctactttttgtattttttagtagagacagggttttgccatgttggccaggctggtcttgaactcctgacctcaggtgatctgcccgcctcggcctcccaaagtgctgggattacaggcgtgagccactgcgactggccactacactttatcaatcaggaatcctttgggtattgcataaatagtactaagtagaaaatttccttttgtgctatgtttggcctcagctagctgtgggggtaaagggagtggggtgggagtccttaacctgggtgacagggcagctgctcaggacatgattcaaatatcagcctggtgtgtgcacacagaatgtggggtgggggcactggtctaggttctgcgttttctcctagagagggtagggaaacagggataccagcatttacaggattccagatgcaaaagcctttctctgaactttgggaggtgaaggcgggcagatcacctgaggttaggagttcgacaccagcctgaccaacatggtgaaactcggtctttactaaaaatacaaaaattagctgggcatggtggtacctgcctgtagtccctgctactcaggaggctgaggcaggagaattgcttgaaccctggaggcgaggtttgcagtgagctgagatcacaccactgcactccagcctgggctgtgacagactaagacgcgatctcaaaaaaaaaaaaaaagcctttctctaaatcacaaacccacctgcagaagggctgtagggctgtttgatagcaaataccttcagcagacagcaagactggtgaggaaacagcatacctctggaataaggtgcatcctcttggccatgcatttatgtgccatatgttcatgtgtgcttgagttgggaagcaaagaacctctaggaactgaaagataagccctcactcttttgcagcctcctctgggcctcgtttttcttttatttctatttttggtagagacttgtctcactctgttgcccaggctgatcttgaactcctgggctcaagcaatcctcccgcttcggcctcccaaagtgctgggagccaccacgcctagcctgggcctcttgagtttgaggctgaactttagagagctcagctgatgcttctgcccattttattgttggggaaggaatagaaagagcaggagtaatgggtcccacaggctggcactcactcctgccattactgtaactctggtagaggagctattcctctctcttcccaggtgcctgggatcataaagcaggctgatggcacacagcatcctggggtagctggggtggggtggaactgaacagggttcaccagccagcaccctcagtcccacagggctgccacctgccctgctcaaccctcttcccacagcatggagggactccagggccagggaggctgcttgctgccacatccccacccactatcatgggacctgcaatttcagttgctgctgctttctttagtcacctcggtgatcaccttgggctgtgatcaccaagcttcaagaaaatcaaaggagctcatgttaggaaaggctggtggagaccatccctggagagattgagagatgccttagagctaagagcccttcgcatcccaagcccgatgtatattttttcctctcactcatggctggcaattatattactctagtattgcccttccccatgcattgtccaaggcagacatcactaattaaactcagcccttatccccgcagggcccagacctggctttagaaattcctactttaggtggccagcaggccagggttcagatgcaagccagtaacagccatgtcagccaatatttttggagtgtgctggtggactcgatgcctatcagctcctactgctgagatcctcttgtcctcacaagagttcaaagaagttatagagctttcctgaggccataccttgaggtggtgagggactgggtgggcctcagccctctgactgcaaagctgctagctaacctctgagcagcactgcccaccagcccttctgcctttgcacactgcatttgacaagtgctcagcaaggattcatggatttgagggtaggatgcactagttgatcacatggaaaataacattctttactggcttgccctaatgaacgaattttgagtctaagagactattcacaaagtccctaaatgtctgagccactgtaattgtgtgtcataggcatgctgacagcctctccaagttctgtctccagccacagcagtgtccttgcctggaccacctctcttccctgctcacccttcaggacctctgcacgtcacacccgtttattctgtaaatgtttgctgcatgtgactccatgccaatcatcatgatgggttcagatgatgccacctccagccttcaaggaagttacagacaagtatgttcagaaaaacagggcaaactcacacagaaaaatgggcagtatgtgaataaacattcactaatcaggtcccttgggcctgtcctgtactgggtgctgaagaaagatgatggagacaaaagccctgactttaagaagcggacgctagggctctggtcaagggctgcatggtgattggaaacacatgggcacagtgcaggggtgctgcaccacacaagtccaggactggatggagtggcccctggagttggtaaatgcagctgctggagcagctgggcggctactctgggacctgagtgggaggctagtgatccaaggcagcttagcagcactcgtttatgtgaagttaaaattccactccagctgtttatccagtccacatgaggaagcaatcctggaagaaggtgggagggataaggtggagatttcttgtgaattccacccaaattacaaccagaggcaccccacttttccatgtgctgtgtagaaaggaccacatttgcattaagtctttgatgtgggtaagcctttcagtctgaattcatctgcaatcactacccaaaaataattttgagagtattccacttctgtgggggaaaaacagggggaaaagatacgttatacaaccaaagtaatagaaacaatgaaaaatttagcaacttaaaatataatttctaattcatcattgcccaaacccttgggtccaaaaccttggaatggtttttgttttggcttttttttcttcacattttgtataatcacccagtgcccccacacagggctggtgaggttatgcattgcacagctctagagaacaatttatacagccaacaacgatgtgaatggcaataccaccccactaaaattgtgcagtacgagcctcaccaatctcaccagccacgtgggggtccagcctcagtcccaacagttctcaagggttagaccatggaagatttttactaactcataataaaatgagaaaataattaaaataatagctaacattgagtgcttactgtgatccagacagtaataactcctttattcccgttggcaaccctatgaggcaccatggttgccatccccactttccctgtgagcaaactgagcctgagcagcctcgagccaccagctgtccactcctgagaactctcctttatgccaggatcgcatctttcctcaatatctggtgtcagactgactttcctttgtggaacactggtggtagtgaggatgctgttgctgtcagccccctcttcttggtctcctgtatccttcctactcttcactgactgcccctgtagtcaggtcttcactgccttcctggaaggttcccacttcctgctcttcttcctcctactcagccagttgctggtgccagaatccccctcatcaagcctagctctgagccttgctctcccttgctcagaagccttccaggaacttctcctgcctcgactgggattcagggctctccacattcaccttaattttggtttatctcccatttttgttctagcagagtagctctactcttcagctaaattgctgttcccaaactggttgggctacttcctgtctcttcagtttcccaccacctttgaccctggcagccccaggcaccttctccatccctcagatccatcctttactcactcattcaacaaacctattttgagcacctcctacatactggctgtagtgtaggtggtaggtatcatggagctttcagtccggcagtggagaaagaactggatgagtaatcgtaagatgtattacaaaagggtcctagcacctaacctgggggtgctaactataggaggttagtcagagaaggcctccctgatgctatgggcagcctcccctccccacccccagttagccatgtccatctcccctttagctcctgggacccactgtggctctgttcctgaaataagtctctttctttatcccatttgactgtcgtagcaaatcttgaacccaggaggtgctatataaatatctgttggcaatcaaatcattctatcaacttctggtaaatcaaattgtacagatcagatatatatatatatatattttttttttttttttttttttttttgagatggattttcgctcttgttgcccaggctggagtgcaatggtgagatcttggcttactgcaacctctgcctcccgggttcaagcgattctcctgtctcagcctcctgagtagctgggattacaggcacccaccactacgcttggctaaattttcgtatttttagtagagacggggtttcaccatgttggccaggcttgtctcgaactcctgacctcaggtgatccacccacctcagcctcccaaagtgctgggattacaggcgtgagccaccgcgcctggcccagatatcttttaaaccatctagagtgttgagtgatttcagggtaggtttcgtggctcccggacttcagtgatgtcactttagtgggtggccttgcccctaaccaagttaacactttgtttggtgaacagcttggctcatggaaaactgaagattataccccaaattgtaatcagaggttattatcttgcagggttgggcttacaaaacagactttattattattttttttaatttttttttttttctgagacagagtctcgctctgtcccccaggctagagtacagtggcgcgatctcggctcactgcaagctccgcctcccgggttctgccattctcctgcctcagcctcctgagtagctgggactacccgtgtctgccaccatgcccggctaattttttgtatttttagtagagatggggtttcaccgtgttagccaggatggtctcgatctcctgacctcgtgatccgcctgccttggcctcccaaagtgctgggattacaggcgtgagccactgcgcccagccccagactttcattttatattgtatatgcttcaataaatatttgaattttttcacaacaaatttgttaagttcctaattaaaaatttaaaatattcttaaataaattaaaccaatgaaggtataatttgcttctcccacttcccatttttgccttctaagaaagggacctatatttaaatgggggaaaaaagtgatttggattaaacccctaactcctgagtcctctgtagctcagtgaataggaagaaccacagatgagtgtgcccacccaagtggcaaaggtgaattgtcaaggcttcaaagtacatgaataaagggccaagtgtggtggctcacgcctgtaatcccagcactttgggaggccgaggcaggtggatcacaaggtcaagagatgaagaccatcctggctaacatggtgaaaccccgtctctactaaaaatacacagattagccgggcatggtggcgcgcacctgtagtcccagctactcaggaggctgaggcaggaaaatcacttgaacctgggaggcagaggttgcagagaactgagattgcgccactgcactccactccagcctggtgacagagcgagactccatctcagaaagcaaacaaaaacaaagcctacatgagtaagtagagcacccttgagggagctctgcaggtatgagacaaacagccagaacatgcattgctgcagaaagcatccacacatcagaggaaggggagccccctcctcctaccaagagcataggtccacccttgtgaaggtttgcctggcatgtgggctgtgagtgactggagaggcaatggtccctgtctgttgtcatcctgatcttcactccctagcataagtgaacactcccatgatggcacattcatctgtctggacagctgggctccaggccagcccacagctgacccacatagccctcccctaaagcacacagaaggccctacactcccacactcaccaagacctcaggataaggaaaagtcttcctgtatccttgtaggaaaatctcttctcttctatctggcattgatcctgactcactaaggaggcagttcccaaaggcaacagccatgagagttggcccccaacatcaaaggggcctgggagggagcagttgctggaatgggagagggagctgcatggcaagggctcccagacaggggtatgcccttcagttgaggcatatgtgctgtccagagtggcttggcagagaggaacctagaggaaaaattcccagatcccctcccttctgccccacgatttcctacttatatctcccattagccaattaaatacttaactgaatacttaaatttaaaaaattccagcctgggcacatacatagccagactccctccctacaagaaaaaattttaaactagctggacatggtagcacgagcctatagtacaacctactcgggaggctgaggtaggaggatcgcttgagcctaggagattgaagttgcagtgagttactgtaccactgctctccagcctgggtgacagagcaagaaggccctgtttgtttaaaaaacaattatttgttgttcatctgaaattcaagcttaactgggcatcctgtgttatttgctaaatcgggcacaactctgagcaaagaacaccctactccctgcacacacacactcaggagcccaggagggcatgatgtcctgagcatggcaggaggccagcccttgagcaaggatggagcccccactgtgtacccccagtcaccaacccataatgtagactgctaggcctatatctctctcacccacctgtctcactcactccctcccaacgtatttgaatagataacaaccagtgtagaatctgtgtccaaaaatgccactcagaaagctaaaagtacagctattatgagccttcccttgctcagaaaccatctaaaatacttgtggaccagatgaaataaaaacatttccaggtttattccagcaagcaagcattttcctggaagcttcagtattctatagctggtaacttaagaacactttttttgttgttaaggcacaaaaattgtaaactcatctctttgtggccatgagcagctttttttttttttttttttttttttttgagacagggtctcactctgtcacccaggctggagtgcagtggcacaatcttggctcaccacagccttgatctcctgggctcaagcgatcctccttcctcagccccccaaatagctgggactacagatgcatgccaacacatctggctaatttttggggtggtttttttttttcgaacctcaatcagctttttaaagactatcagccaaatttgcagcatagtctctgacagagcagacagtaagaaaagttatttattttgagacagggtctctctctgtcacccaggctggagtgctgtggtgctaccttggctcactgtaacctccgcctcccaggttcaagctgttctcctgcttcaacctcctgagtagctgggattacgggaatgtgccaccatgcccagctaatttttgtatttttagtagagacaggtttttgccatgttggccaggcttgtctcaaactcctgacctcaggtgatcctcctgtctcgacctcccaaagtgccaagattacaggtgtgagccaccgcgcctggccaagaaaagtgaccttgagccctgctgtgtcatcaccttcttcttatactgctgagttgggcatgaaggacttggaatgagtcagtaataagaaaatttttatttttggtgggggtggttacatttcttcaggactcttccagaggcgagtttacaaacgaatgaactggtgaataagaatatgtccagatgtgtgtgttaatgaattctgcttatcttttcctggggcacagaggacaccccagtgctctctcttcttggcctaagaagttgggaacctacttgggaaactcttcttatttaaaaggctaaaatttggatgttctgttttacagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccaggtgacctctgtcgaatcaaagcccctaccgcctcttgccttcaaacacacagttggacacataatactttctgaacataaaggtgtcaaatttaattgctcaatcagtgtacctaatatataccaggacaccacaatttcttggtggaaagatgggaaggaattgcttggggcacatcatgcaattacacagttttatccagatgatgaagttacagcaataatcgcttccttcaggtatgtgttctttcttccttttttatttttttagttttaatatttatttatttatttacttattgagacagagtatcattctgtagcccaggctggagtgcagtggcacgatctcagctcattgcaacctccacctcctgagttcaaacgattctcctgcctcagcctccggcgtagctgggattacaggcgcccaccaccacacccagctaatttttttttttttttttttgtattttttgtagagatgaggtttcaccatgatgcccaggctggtctcaaactcctgaccttgggtgatccggccacctaggcctcccaaagtgctgggattacaggcatgagccaccttgccaggcctcttcctttctttttaaatgtcattatgctaatgctgcctcaaaagcaaaagccttttgttttctatttaagcaaaccactggtccctttagagagttgaaggataactgacagtgtgtgttcaatctgagcttggcagtgttggaactgttggttaacagatactcaggggctgggcctgggaggctacttcccacctgacctacatatcatatcaagtacagctggacccaagagctctaccagtgagtgggaacagtgtttcttaccgggtaggaggagacgttaaaatcaccctggccatgtggggctttttaaacagtgcaattgcttgagctagagagttctgggctatagtgtgctatgccaattgggtatctgcatcaatatggggattccccccactaccaccaaaagcaggggaccaccaggttgcctaaggaggagtgaactggcccaggtcagaaacggagcaggtcaaaactcctgcactgttcagtagtgggatttcacctgtgactagccactgcattccagcctgggcaacatagtgagaccctgtctcaaaaaaaaaaaacccccaaaaaaaagccagtgcagctctctcgtcccttcagttaccctgccgcccctgccttccacctctccccaccgcctcccagtgctgatgtagcccccgtgcaccgtggggcaggaagagatggaaagtctgtctctggaaatgagacaggccctaagcctcagaccatcatctcagtactccactttgttttttaagagcaagctagatgaggtggagggttgtgtgtgacagggataagctaagccaggacttatatctggaatactctgttttcccagggacccagctgtcatgtctcagaatgctgcagacgggcaggtagatgcttctcttcttgccaccccttttgtattctccactctttcctcttagccaggaggtgttttgcttttctgtttttgtttttttgcatcaggacttcgttgcgtgcacagttttagaattgggttggcctgtggttgttaaaagcacaaaatgaggtcagagccacacagggtggaagcaagagcctttttcctgcaatttctccactttggagtggagccttctttgatctgttacattttcactttctgtgacatgatacttggcaccatcccatactgtgtcatgccttttagtgaatcattttgtttccttttcagaaaaccacctcacaattaccacagacctaactactcaggttagtgtgccaacacttccacaagatgtgcccttttttttacattttttcccccaggttgtaggcttgcttagtggataatcccttagcctccaggcagaaaatgcaacttccacattactctggctgagtctctcggcagccgttctcagccagtggctaagactgcttaggagatttgactatattttttctgcatcaactataaaaagcagatgtcttacaattacatagacatagcttctgaagagataagtaaaactatcatttaataataagtgaatgaccgaggcaggcggatcacgaggtcaagagatcgagaccatcctggccaacgtagtgaaaccccatctctactaaaaatacgaaaattagctgggcgtggtggcgcacgcctatagtcccagatactcgggagactgaggcaggagaattgcttgaacctgggagatggaggttgcagtaagccaagattgcaccactgcactccagcctggcaacagagcgagactccatctcaaaagaaaaaaaaaaaaaaagaagtgaatgaggagtagtttaaagatttcaagaacagcaagctggcacattggtctcattgggtgtcacctaggaggggagcatagccctaccttgctgtctctctggacttggccagtgtatgactgtgggtgagctgcctcatcttccctggtctattttccaaaggaagagatggacttggaccatgtgactgccagctctacttctgctctcagatgccatgagctgttcagaggacttaaattgtagagttttaaaattttgattagtcagtttcttgttttggacccatctctttagagtacagaagatgacctgggtattattttgagaactttagaaatttggagtagaatttattctactgtgtgttttcagcttattatatataaactcattctaaaggagaaaaatcttatttgacctccaaactaagcctgaaagcaaatttagcgatcagaatttttgcaaatgatgagcatttcttttttgagacggagtcttgctctgtcgcccaggctggagtgcagtggcgcgacctcggctcactgcaaactctgcctcccaggttcatgccattctcctgcctcagcctcccgagtagctgggactacaggcacccgccaccatgcccagctaagtttttgtatttttagtagagacgggatttcaccgtgttagccaggatggtctcaatctcctgacctcgtgatccacccgcctcagcctcccaaagtgctgggattataggcgtgagccaccgtgcctggccatgatgagcatttagttgaattaggtagcatacaggatgataccaaatttgcctgtatatgattcttcaactttattaagataatgttcaggggcacagtagttgtacagtgattcagtgaaataaattatagttgtaagagttaaagaaagaggaaagaaacatgaaatgcagcttaacagttaaagatgggtttattttagagaaataagcctgagaggggctcctggccaattttggtgaggagcattatcttttatagactaagagtatatattagtttcagggtagggggcttatcacaagcttggaatgtttgtatgttggggagaagtttatagcagggttggaatgtctctggtcagatgggaggttatcttggggctgacatctctctggccgaaggggacgttatctcagggctggcatgtctcaggtcagggaggggtttggagtgtttttggttggagatgttatttgttttttatggtcatgctgaccttagccattaggctgatgccctttagatttaggcggtttttaatcaaggtgaactttagaatgacagtgcttgtccaagatggcgatactcctgctctgtcaatagttacttaatcaagatgacaaatatttatataatttcttggcaagagaggatgatgttggagttgctaaatgtgcattgttttttaggtgaggacactgagccccatgagcagggtcactaggcagtgagctagtcttacttaaacagggagcctgatttgcatacctgcagtgacctctcttctcacatctcctgggccctaaggaaatctactgtggctcccaggaacagtgaagagttaaaaaatagttttaggctttcaatataagtaattttgttagaaattcattagcctgcaattttgctggagttgccattagcgacatctatgtggactatgtttattcaagagaatgtgcaattaaaatcactaggggcagagaacatagatgtatattggcagaggtcaaaaggactctagagagaaacacctggtattttcagtttggtcatgggaccttttttttctaaaaggtattaggatcacacatagaaattcccgtaagaataggcagaatttatgtgaatttttaacatgatgaggtctctagattgaggaccccatactttgtatctgcactcattctttaaatatggcacaatcgtgagttactagagactgaccctgtgttttatctttcttttcattatactttaagttctgggatacatgtgcagaatgtgcaggtttgttacataggtatacacgtgccatggtgctttgctacacccatcaacccatcatctacattaggtatttctcctaatgctatccctcccccagcccccccaccccaacaggccccgatgtgtgaaagttcccttccctgtgtccacgtgttctcattggtcaattcccactgatgagtgagagaatatgcaatatttggttttctgttcctgtgttagtttgctgagaatgacggtttccagcgtcatccatgtccctgcaaaggacatgaactcatccttttttatggctgcatagtattccatggcatatatgtgtcacattttcttaattcagtccatcattgatggacatttggattgattccaagtctttgctattgagaatgatgctgtaataaacatacgtgtgcatatgtctttatagtagaatgatttctaatcctttgggtatatacccagtaatgggattgctgggtcaaatggtatttctggttctagatccttgaggaattgccacactatcttccacaaaggttaaactaatgtacactcccaccaacagtgtaaaagtgttcctatttctccacatcctctccagcatctgttgcttcctgactttttaatgattgccatttaaactggtgtgagatggtatctcattgtggttttgatttacatttctccaatgaccaataatgatgagctttttttcatgtttgttggccgcataaatgtcttcttttgagaagtgtctgttcatatcctttgcccactttttgatggggtcgtttgtttttttcttgtaaatttaagttctttgtagattctggatattagccctttgtcagatggatagattgcagaaattttctcgcattctgtaggttgcctgctcactctgatgatagtttcttttgctatgcagaaactctttagtttaattagatcccatttgtcaattttggcttttgttgccattgcgtttggtgttttcatcataaagtctttgcccatgcctatgtcctgaatggtactgtctaggttttcttctagagtttatatgatttcaggtcttacatttaaggggaagagaagggaaagcatctggtctttggtcctaaaacagcacctgtcctagttgaagatgtggtttagagtatctaatggcccagagctttggttactcctcacaccttccattgctcttacaccctctttcccgtagtggcccctgctgttatatagctctctcccttccaaaggaagaaaggactgtgataaagtcatttactctaaggaaagctgtaacattcactggtgatgtcattttagacaccaagaaatagagatattgtaaaaatcaatacacatatgcaagtacacactagttatcaaaatggccatccttgcacatgaaggtgttttccggcaattcattatttgttggctgcatagttaactgagggatggctgaacattgaggcaagttgggcagacctggtccctgtcctcctgctcatggttgtgaacagaatggaggggaagggccaaatcaaacgtcaggtgcggcagcgctaaggtactgttgccttcagattttagatttgtccctgacgtattaatttagaggaggaggaactggcaccaggactgggggaggtacacttctgcctctcaggagcaaccgcatcttgcaatcaaatctcagttaattgaaacttggggaagaaagatggaaataataggagctcatggacatttaagtacgaatcccatgtactctggaaagactaagggagatttggcatcatgcacaagagtgtccctgaaagatttttaaactacttggtcttggctcgtgtgtgtgtgtgtgtgtgtgtgtgtgtgtgtgtgtgtgtgtgtgtgtttaaattattttaatagtaatgtatgtattttgtcaaaaacttggaaaataccaaacatacaaagaaagaaacaatggcttataattgcaactctgagaaaaattttccaattatatataaataaattaaatgttcttgaaattaatcttttattgcatagatgattatatatcctgtttcattcagtttatattatgaatatttctgtatattattaaaagtcttcaaaaaaatttttttgttttttgagacagagtcttgctctgtcacccaggctggagtgcagtggcgtaatctcagctcattggaacctccacctcccgggtttaagcaattctcctgacttagtctcctgagtagctgggagtacaggcgcccgccaccatgcccagctaattttttgtatttttagtagagacagagtttcatggtgttagccaggatggtcttgatctcctgacctcatgatctgcccgcctcggcctcccaaagtgctggtattataggcatgagccactgcgcccggcaagtcttcaaaatattttaaggtattttattgcatagatgattacatattctgtttcattcagtttatattatgaacatttctgtatattactaaaagtcttcaaaatattttaaggctgctatatgccactgtaatctgctgttgtgaaataaaagcaaatatagaaggatgcaaatgaaattataaaattaaaaattttttaatttttgtaaatgaaaaattctttttaaaatgctgagtttggggtatatacaagggaagaaataactgatgttctgctcctagcctaggtgccctcttgagctatgcttgttttatgctaataatctccctctttttttcctgtttcacttggatgtctgttattgttgatggagccaggagtcatctttgattaataggtgtagaaaacattcagtgtctgctacaggttgaggtccctcgagagcattcacctggcctcctttatgagacttgagtcagtgggctgggcctcctccttggtgctgtagccactaacctgcctcacctgtatccaatatcagctcgaaactagcatatccgtttgtccaggttccaggacactgcttggccaagacctttcactggagtctccaaagaagggtgtaatttgggatatatattataattagctctgatgtctagtatagcaagtaaacagccctctagcttgggtggaaatgtgccctggtcaggcgcaacactccagaagggcagcagccaccagaccagacgacagggaagcccagctcccaagcaaaaccaaaaactggtgggagtcttgtggtgaggggaaagtatttgttgttttctgtttagtctagggattcacactgctttttaaattctggcatagttcccagtggctaaagctggaatgattctactgtttcattaaattttctttataaaaatgttaagttggggccaggcatggtggcttatgcctgtaatccccgcactttgggaggccaaagagggaggattgcttgagccagggagttcgagaccagcccgagcaacacaataggaccccattgctacaaaaaattaaaaaaaaaaaaattaggcagacatggtggtgcacacttgtggtcccagctactcaggaggctgaggtgggaggatcgcttgagcctcggagtttgaagctgcagtgagccatgatccactccagcctgggcaacggaacaacactgcctcgaaaacaaaacaaaacaaaacaaaagtgggtagtttgcgtctcctgacatcctgtttcctttggggcccccatctccatgcatctccatgcaggctcctggtactgtggatgctgtgttttcggggcccccatgggctctctgtgctgggcttttccctcccatcttgccttactggggctgatgcctgttgccggttctttattctgctgctcttggtggcaatgagaacagaatctagaaaataaaaatctaatttctttaaccaaactatctgctggaaaagctgttattaaccacagatgcctgatactttctgacttgcgacctgttcacaagacttcctttcagctcgaacttccttgcccttggcttaccctgtcggcaccatgtgaacggtggcaggtaaaaacagggcgcttacagtggacctatttcttaaaattatttttttcatttttaatttttttgacatggtaaaacatatatataacataaagtcccccatttcaacccattttgagtatacaattcagtggcattcacgtttttgtgcaaccatcagcacacgttgcacatccatctccagaactccagtagagtaaccactactctattttttatttttattttattttatttatttatttttcttgagacagggtttcactctgttgctcaggctggagcgcagtggtgcgatcacggcttattgcagcctcgacctcccaggctcaagcgatcctcccacctcagcctccccagtagctgggaccacaggcatgagccactgtacctagctgttttttgtttgtttgttgtttgtttttttgtatttgtagagacagggttttgccatgctgtccaggctggtcttgaactcctgggctcacgtgatccttctgcctcagcctcccacagtctactttctttctctgtgagtttgactactacaactacctcatataggtggcatcatacaatatttgtcctttttttgtatttcttttaaaaagactctagagcataactgctacttccaagtcatttctgagcaggctagactggtagtggtaaggactgagggttagagacatgctgtgtgtgtataagatgtgcctgggctaacccagcctgtgctgccctggggtgatgggtttctgcagctgctggccatgcagctgtacccaggtggttcctgtctagacaccatggctgagtatgtgccatttcttttgtcttccctcattcagatgtttgtatttggccaaaatctgatgagatttttataccattttttttaagcagtggtagaacattctgactattcaaaaagtcttttttccactccagcccccagccctctccctgtagggaatggagattacccatctcttgggtatctttccagagatattcaatccctatgtaatcctatgtatgtctgtatgtgtgtgctagtctccagcatggtgtgttaatctaatagaatgctactcatagctgtggttaaatcaatacccagggtatttttttgtagctatggaaattctgttttcagctgaatcatgtaatatgctataattatattttacttcttgtcttagtctgttttctgttgcttataaaagaatacttgaaactgagtaaattataaagaaaggaaatttatttctcacagttaaggaggctgggacattcaaggtcaaggacccccatctgataatggtcttcttgctgatgcgactctgcggggtcctaaggcaacgcagggcatcacacggcgagggggctgagcgtgctcatgtgctagcttaggtctctcttcctcttcttataaagctgccagttccactcccattaattctttatcccattgttaatccatgaatggattaatccattcatgagggcagagtcctcatgacccaatcacctcttaaaggcctcacatctccatactgccacattggggattaagttttaatacaagttttgaagggaatattcaagccatagcacttaaggacttagcacttaattaattaattaattaatttgagacagggtctcactctatcttccaggctgcagtgcagtgtgcgatcatagcccactgcagcctcaaattcttgggcttaaacaatcctcccatcttagcctcccaagtagctggggctacaggcatgtgccaccatgcccagctaatttttaattttttttttttttttttttttttttttggtaagagatgggttctcgttatgttgcccaggctgatctcaaactcctggcctcaaatgactctctcaccttagcctcccaaagtactgggagtgcaggcatgagccactgcacccagccccatagcgattcttgagtagctttttgattatcttgaatttaatagtttcctaagtatcaatcactcattcttctctaaaggaatgtatgcatctcctcacaccacaacaaaattatcagtactgatattcatttatttatttaggagatgcctgtcctggcttcttcccttctgcctctgtctaatcaggttccctctgggtctggggtccagctatctttactactattctgaggatcctctatgcctcctgtggtccagctcctgtttcctagagcccaggtcctctttcttggcttctactcttttttttttctactttcctaaactttattaaagaaaaaagtaatggtggtaaacctctagaacttactcaattttctgggattcctcccccgagaatgtgatatattgatttccaaacatgccggaagtatacatggttcccaattgtactaaatagactaaataggtgaaaagctgaagtcctaaagtgttcatcttccaacttttcccagcctgtggtctgtccttgcatcagcaataattgcctgaacagctgctatggcttcattaatttttgtctgtagctgtctgagctcttctgtatacagcagtcacagaatttgagtagcttcattaagaactgcatctcctgtgtcaaaaccaagaatatgtttgtctaaagcaacaggcaagccctcttttgtttgatttgctttagcaactgcatcctgtgtcaggtgctcctgaaccaaaatttgaattgccttaagcattaccaggcaatcatcatgacattgaacctgaagcaggttagccaaagccattacaccaggcttaaaatcaggattatttacgtccaaatttatcaatggttctgcatttttagttgcattgtcagcagtttttgcattatcaggtactaagtccttgtatttttcagcattatctccatattcaaatctaacagctaaaccaagaagccagtcaatagcttcttgtcgatcttgaatctttaaacgacagttaacatctctgagatacttttgaaagaactcgggccagtcactgctgtggatgtttcttaaattacctctgtcttcagtcttgtagtatctgattttctggtcttcaagccaaacagtgaagtttctaaattctgtttcatctttgcagttgaaaccggcggggttgtggtagtcaagagccgtcagctttcattggaacatgctccccgcttctcactctctttggcttttactcttttactttggcaaggagcttatccgtcactaacttcctgggacttgcatgcctgaaaatgccattctttttcctaccttcaccttgaggtagtttggctgggtacagagttcgaaaggaaaatattttttgttttaactttgaagtcactgatatatttcctttgagttctgggttgctctagagaagcaggatgtaattctgattcattcataagtgatctgcttctgttctctctggaagcttttgggatcttcacctcatcttagagttgtaacgttccctgatgaagcccccatgtggtgggtcttttttctcctactgtgctgcccagccgggggcccggttaggaaacacccatatcttcagtgctggggcactttcttgaacttccccccttccgcatccactctccgcgtttcctctggagctcctcttacatggtggttgggatgcctagattgctgttctgagcccggagcctttctggttgagcctccacagagactgagcctcctgtttttctgggcagagggaggagagccagggacagcccctccagtctccagccccaccccacaccccaccctcccagtgggagcctttcccttggatgtctagaaagcgacaagtataatgatttatggaaaatctttgctgtaatataggtggcatgggtcaggccttgctaattaatgcaggtgcctatttttaccagacaactgctaagcccttcctgccttgaatgactaaagacaaacttccgattgagttctctttgcattctgcatgctccttttctatttctggtgtgtatcctccttgctggttggcttaaggttctcctgggcatcttacgcagtctgatttctacagtccagggtgagctgccagacggtcctttgtgcctcatagtttctcggcttctgggggctctgcacctccgctttgtacctctggtctgggtgcagtcccctcaggctgccttcctggggctgtgccccacctccctcccggccttcactttctctctggtccctgtctccctgagtccagctgcaagcctgctgccactcccgggtcccagaccttgaggcagagccggtcttcaaaggcacaagtgtcctcagtctgtccgatctcatggttcactctgttgagcccctgggtcttgcctcaagaaaatgatgcctcttctaaagtggatttgtgaaatatgtagaagcaccccctcttcagtagccttggtttccctttgaactccaaagattagatccatctgttgtgcaggatcttcaggaactgctgaaagccagggtcaccgctcaaccactagtcattgcccacgatgggcaggacatcattctaggcacagaattctcccatctttcttcagcccttcctgtcaccatgatatccagggggctaccaggagagggtcagccagctccttatttggagatatttgtcctgtgtattctcttttcatcttctcctggtaacctctaagcattgtgacatccagccactgccccaaagcatgaaaggatctggcctttccttgatccctgggacctcccccatgcccaccattcattcatcaggtgcattccaaaattatattgctcctacaaaagaacgaggggaaaggggaagacagagcatttcaagtcaaagggaagccactcagatttacacatcaggaaatgcaatgacaggggactgttaactcctggatcctgggaacagtaaggaagtaatgttaacctgagtagctctgaccccccgagttctgactgatgccattgttgagctgtgtcttagctgctctatttatcacaggccaatgaggatctgcaaaatggtattgttgggaagaagtaaatttaaaatgtttagtgttcagaaaactgaattcaacctaaggaaactctgtctcattcagacctggggacctcactcactaccacatgtctgctccagatgctaaccaggctgtgctatcctctggcagctgccacccctgcctatcaggccatggttcaggatggagccccctctacccttgacagcttcctggtttcttttaagccttaagcctcagcccttcacaggttgagggatgagatttattttgtttagaaataaataggttatacagggaagcaagcttctaggaaggaaggtggaacttccatgtttttcttctttttcttcgttcccctggtcatggtcttctttgctgtgtttaaagaggagtgtctttgagccaataaagaaatcctctggagagcatctgaaagtatttaaaaatgttccccggctgagaacggtggctcatggctgtaatcctagcactttgggaggctgaggtgggaagatggcttgagcccaggagttcaaggctgcagtgagccatgatggtgcaactgcactccagcttgggtgacagagcgagaccccatctaaaataaaataaaataaaatgtgcatttcaacatgtaaacaccgggcatgtccaccccaggagagatcattaagtacccagggacttgcaccttaggtgcaccttcaagcacttgacctgtgactgctgcaaatacagtcatgctgtcagtgagagaccttacaaaatgatggctagggccccagaaagttctaaacaggacaaaggctaccagctctccatttttatagtcattgcagtcctggtaaattaggtgaatattgaaaccatacaagtatgttaaatggaattagggtctagtctcaggaggtcatttgggatatggaacagttgcccttggcccctaaaaacccatggagcccccctagtcattgtgaccaccaaaaacaactccacaaatttccaaaatgccttgagggggcagtaccccaatgcagagaaccactggtgcagagtctaccatagaaatcaagacaggtggccgggcatggtggctcatgcccataatcctagcactttgggaggccaaggtgggtggatcccctaaggtcagaagttcgagaccagcctggccaacatggcaaatccctgtctctactaaaaaatgcaaaaattaatcgggcatggtggcgcatgcctgtaatcccagctactcaggaggctgaggcaggacaatcacttgaacccaggaggcagatgttgcagtgagctgagatcatgccattgtactccagcctgggctacagagtgagacagaatctgtctcaaaaaaaaaaaaaaaaaaaaaaatcaagacaagtgatagcacatatattagtcagggtttttccaagaaaccgaacctataggatctgtgtctacagctttatctagaaagagagagaaagaggaattattttaaggaattttccttagttccttaaattaactcctaaattatttattaattcctaaattatgaattccttaaaataattcctctgttttaaggaattagctcacacacagtgggggctgacaaatatggaatcaacagggtgttgggtggagacccatgaaagacttgatgttgcagtcttgagtcctcaggcagtttggaaacagaagcccctctttccctggggacctctgtctttttcttataaggccttcaactgtttggatggggcctgcccccatcatgaagagtaatgtgctttactcaaaggctgctgctttaaatgctagtgacatgtgaaaagtaccttcacagcaacatctaggctagggtttgaccaaacaactgcgtacaatggcctagccaagctgacatataaaattaactatcacagcatatgacaaagaagttgaagaagtttccatcctataataggaactcaaagggtagtcactgtaaatatcttcatgtgtttttctttgcagcataaccagtgtgcagcgttcagacaatgggtcgtatatctgtaagatgaaaataaacaatgaagagatcgtgtctgatcccatctacatcgaagtacaaggtaagtccacagaccagagtcccattgccagagaactgtttgttttagggcctgtgttaaatgttttgtgtataatactctagagttttgcctgcctatttataactctgtatgcaaaccttgcaaatctatcagcactgaaattttacaaggtactccactttgtagtctataagtaataatgaaatgaattcaattcctgaagtttgagctctattataggcattacaggtgagataaaaagagattttggacttccttgtccacagattattgacaataaaaataagctgaagacttctttttaagaagcaaaatgctttctactatccagtttccagtactggtaccagataccactcacctggtcaagtggctgttggcttattattcagcatcttttcctgtcttgcctatgcagacagtgaaaccctggagggtgagtggttttcctcgactggctcaacagctcagcctgagacttcttttgggcactggtatctgtcaggtgcatggttcagagaaattccatgacatcatatgaaggtccatggggatgaagagtgagacatcaggctaggaaaaggcaatctctgccctcagggaacttgaactctaatgggcaatgtgagctgatgcacaggtgaaccaggccaggtgagcccaggtcctggtttggtgccctgatttgggggtttgcatgcctggttctgcaatggcagtgctgcaaggaggaagcatctttattatcaccctcagaggtcactcctcactacccctgggggcttccctctgggggccttgtgcccctcctctctgaggtgcccctcttagcagagccattaggtcacctcccttttctactttatcctgaccttccttgtcacaggctttagagcaggtgattagcttttcagtcagaaacatctcccactgaaagtctgctatgctacccattcttttgtgaacctgaaattgatgcccaccaatgtggagggaagcctcagggagcacagatggaaggaggaggagtgagtggggaagacagaggggagggggaagagactccctcagaggagtctcttcatgacctttgctctaggcccatcccaggctggacagctctttctcagggttacgtcaacatcagccaaagagggggtttcctacatttgcagctaatttgggaaaaaaatatttacaggagattttatttgtcagaatcccagaaaaatgcccagagcaggaacatattaagtccaaacagagtttcaaaaaaaccttgaaacaggataaaagaattccatttcacataactgccacgtcattcctgctggaaccagatctgtgagttcccaatccccaaaagaacacaattagctggactcgttatatttttgaacacctgccccaaatgagtactgactggctttctctgagcttccttgggaccttgattttggaaagtacggtagatttaaggattgtaactgcaactgtgtttatacagttttcatgagaatttgctttgaaaagcactcagccttatacaaggctgtggattttaaaattccttatgacccatctgaaagtcacacacataatagaatgtcttcgtaccatggacagatctattacatagctttgttttactctgcgtttattttggtaagaaatactgaaaacctgccaactagtcagtcccaggagtttgagcaacacctgatgtaagaactgcctgtggcctgccttctggtaaaaccagttctgagtcactatttatagcccctttggcaaagcatcctagaaagctggcttaaagtagactggcaggaattagcctctgtgctccttcttatccaacttaaggaggtgaaaactgattaatacagacctgcctgaggctgtagataaagaactcttgtttgccaaggctgggcgcggtggcacgcctgtaatcccagcactttgggaggccaaggggcaaggatcacttgaggtcaggagttcgaggccagcctggccaacatggtgaaaccccatttctactaaaaatacaaaaattagccagacctggtggtgtgcgcctgtaatcccagctacttaggaggctgaggcaggagaatcacttgaacccaggaggtagagattgcagtgagccgacatcaggccactgcactccagcctgggtgacagagcaagactccatccccacccgccccccacaaaaaaagaaatctattgccaagttctagtccagtttccattcccctttgggctctgtctctgttttcagatctgaaacattcttttgtgtaacgttttctccgcaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatccccctccgtgctaactgttccaggtaagtccgagctgtgggcttattgatttattctctaatagcggacaggatcaaaagtttggcgacccttgctgtgcaccactagcaggcagtggagacagatgaaaatacaggtgtggcagcaaagttatgggaccaggtagacgggaaggcaggtgggaatcacaggtgtgagaattcacaggccaaggtggggaaacaggtgagggcctctgggggtacatagggttaagttgttgaagtggccagaatccctgagcccaggcagcaggagccctgctcgcatctcccattgtagctgtggccttgctggtctgtcaggtcttgcgtttatggaaccactgacgtgaagacctcagtggatttgacaccgagagagtggattcatcatggggagctattgcaggaagtgtgagcccttgggggattgtggctgaatggacattccatggtcgtcttgatttccatccaaatgaaagtggcccagttttagtcccgcacatcactgatgatgctcttgtcaataccactgacgtttcccatgcactgaagtcagtgggctcttctgtggctcctctcattgcatctttcagcaacatcaggcaaggttaccacactccctccctccttcctttctccagggactgctgtatgcctgaggctgttctaggccttcaggacacagcgtggacttttggaaacactgtcctggcttccatttcattgagtgacaccaattcattgctcctcctttgtcattgactggagttttgaatggcagggctcaatcctgggtccccttcttttactctgagatgcttccccttgggagagtttctttgggcccatggtttaacaccatctataagaaatgaccttgaactccagcccagacccctctcctgagttgcaggctcatgtatccaaccgcctccttggcattgccacttgctgggtacataggcatctcagaatgaaactcttaaccccagacttgttccactccagaattctccatcttagtgaatgatatcaccattttcccatccttcctttttctcatttttcatgttggcatcagcagttctgtcagttctgctcctacaatacatctgaaatctgtcttttctccaccctgctgccagcaccctggtccgtgtcactgccagctcttgctgtcgcctctgcagtagcttcctaactgggcctttttgctcccagccttgtccccactcccaactaccctcctgggtggcagatgacatcacctgcctgctgaaaaccctgcagtatctcccttctgtcttagactgtcacccagtccttcctgccctttccctaggggctgcgtgtcctagctccttcctatctatccaacccagccccatcccatgctctccatcctgcttgttaggcacgagtcacattgattgtctttcacttctctaggcacatcctgttccttcctgcctcaggacctttgcactgtctcttctatctgcttgcagtgttcttccatcggccctttgtcccatgacccaactcatcacttcttcagagaggccatccctgatcactcttaactgttttaggtcccctcaatcccatattcctgtgtactcctccattgcacttgtcaccgtctataattacccagtttattcattgggtctccttgtctagcttcttagagaacatatgctcagtaaggacaagagctttgtctctcccattcacctctgcactgccagtggctgaaaaggtacctgcctcctagtagtactcagtaaatatttatggctaggatggatcagtaagtgaatgccagcccctacctattaactctgaatcacttttctaacccgtgacttcaggaggaatgttatggttttctctccttcatctgagttttctttgagtttttttagggaattaagtaactttttattcaaaatcaattttaaaaaatagactctaccctttataggatgatcactctgaaatcccataaagacttattttcattgaggtaaaattgacatacaattaagtgcatagaattcagttgtacaactcagtgagttttcctaagtgtagacacccatgtagctaccacctcggtcaagatatagaatattgccatcacttcagaaagtccttcatgatcccttccagtgggtcaccatctcccataggcaattctgttcttatatctgtcatcatagaataattttgcctgttcttgaacttcaaaaaatggaatataaagtatgtacttttttgtgtcatacatactttccgtggcttcttccactcaacatgatatctttgagattcatccatgatgttttatcactagtacatcatctttatttttatttttattttcagaaggagtcttgctctgttgcccaggctggagtgcagtggctcaatcttggcttactgcaagctccacctcctgggttcaagcgattctcctgcctcagcctcctgagtagccgaattacaggcacctgccactacgcctggctactttttgtatttaagtagagacagggtttcagcatgttggtcaggctggtctcgaattcctgaccttaaatgatccgaccgcctccacctcctaaattgctgggattacaggcataagccaccgtgcctggccagtacatcattttttattgctgatatagtactctgttgtattaatgtgttaatttggtttatccatttgtttggtaaacattttggatatttgtggcagttggctattatgaataaagcagctatgaatatttgagtgcaagtcttttggaggacatatgtttttattttgtcttggataaatgcctaggagaggaattgctgcttcatatgtttaacttttaaagaaactaccaaatggttttccaaagtgattgtgccatctttcattccagcaacagtggatgagagagttccagttgctcatcgatatgtttaccaacatttgatttggtcagtcttcttaagtgtagacatttagtggatttgaaatctagtagattattgtggttttagtttgcatttcatttccctgatgtctaattttagacaagacttagagaagattttagtgtctcttcttgtgcttattaatcagtcatgtctcttttttggtgaagcgtcacttcaggtcttttgcccaattctataaaaatcctagaatccacttgacaatgtttacacaaaaatacctgctgtgattttgtctgcaatcgtattgtttttatagataagtttagaagaaaaagacatcttgacaatattgagccttccaatcaatgaatacattatatctcttcatttatttaggtcttctttaatttctctcagcaatttttgtagtttttgttgtagaggtcttacaagtcatttgttaaatttttttttattttaaaattggaattgtatgtacttaaggtatacaatgtaatgttttgaaatacatagtgaactgattattccagccaagctcattaatatagctatcttttcacatagttaccatttgtggcggagttcggggggcggggagggagggaggcgacaggggagggcatgtaggaggatgagaacacttaagatctaccctcttagcaaatttccagtatactgtgcaattttgttaactgtgctgtacattagatctctagaacttattcatcctgtggactaaaactttctaccttttgaccaagtcctcacccacctccacccacccttttaaaccacggttctattctttgtttctgtgagtttaacttttttagattgcacatgtaagtgagaccatgcagtagtttttcttttctttgtctggtttattcacttagcataatgtcttccagtttcatccatgttgtcataaatgccaggattttcttttttgtacacgctgaataatattcccatatatatatatatatatatatatataccataattttttaatccatttatctgtttatggacacttacattgtttccgtgtctaagctattatgaataatgctgcaatgaatatgggaccacagatacctctttgagatcctcataccatttcctttggatatatatacccagtatgggaattgatgaatcatatggtagttctatttttaattttctgaggaacctccaaactattttccttaatggctatgccaatttacattttcatcaacagtgtacagccaatcagaatgcattaatttagtacttatgtactaataaatagcatatttgattttatttcccaattatttactattagtaaatagaaaatagatttttgtatgttttataaaaatagggacaaaatctgtccatctctgtttgtctagaacttttctgtatgttttctcaaaattagaagtgtgtttttgtgacaagatgtgcaaactattttaatacccaaggctgtagtttgtcttagcttggagatctgatttatttctaaaaggtcagttacacccttacaacgaccacctattttgcatttcaagttctttacaatttaattttactttttaaaatttgaagcttttttttttctttggtagagaagacttgggctcacgtttttttccagggtgttacgtgaaaattctcaaggtggactactaggtttagctggaatcaatctgacagtgttcatatcatcagtaccctttaaaagagtcattggaattacatgatgatctgaaaagtttaggagacagacccagacagcagggcagcctaatccaatcatccttaaaaatctgaacagtcagaatagaactgtagcatacagcctgttggtcacaggaacaagaactatttgttcatttgcatctcaccaaattcttacatgcactgatccaacaaatgagccaaaacttaggctccaaaaatgttcattttcgtcttctaaaactctgtaaagtctatccagggtagatacctgtctgagtttgtccagctgaccagtgcacggggtggtggaaccgagtgttgttgctttcccactgtacacactcatggaatccacagtaccacatgctgtcagggcaatggctccacactaatcttccctgttattgttccagttttagtgtatgtgctaccaaagcgagcaccaccagtatttctttaggagggatatctaaatgggagttgaagggaaaagtgaacatattttaaattttaatacattctaatctccctccaaaaaggccttgcaagttggcaatctttttagtggaatatggtaatatgtgccctatatcacatacacacagtattcagtcttgactttttgccagtctgatggcaaatactctcatctgtcagaatatctgatttacgcctctgcctgtttccatgagaccaggggggctcttgaaggcaggaactgaaggattttttggccacatattcaggggtctggttcagtgcctggaacatggtagttgtagaaatgaccagtaggagagcacttgcggcagcattcaccagaaggtgcttctgaatgtgggtgtgcatgatgaattcactctccatcaggggccatcgggtaccaaaaaccaaaaactgaaccatgatgatggaaatcctcactaacatttcaccagctgttctagagtttttagagtagtgacaaatgtgtctgtaaatgaagaactcttacttaaactgctgagtcgaaattctagtttctaaatcaatacgcagtataccgcactgctcaggcagttttcctatttgtgaagggtttggaaagtggggctgctgactttatttttcttagtgacagtatttattaaatgcctgtttcatagtgaagatggtctagctcatgctatacagtgaagtgaaggcctggaggagtaatcatatattcaagccagaaacctgaaacttacccagattcttctctctcgcccatccaacagtcatcaccaagatctgtacattgttctctcttttttttttgttttgagatgcagttttgctctgtcgcccaggctggagtgcaatggcgtgatctctgcttatcgcaacctctgcctccagggttcaagtgattctcccgcctcagcctcccaagcagctgggattacaggcacccactatcatgcccggctcatttttgtatttttgtagagatggggtttcaccatgttggccaggctagtcttgaactcctgatctcaggtgatccacccaccttggcctcccaaagtgctgggactacaggcgtgagccactgtgcccaggccctgtacattgttctcaaatgtcaattgtgctcatttcttcctctgcccttccaccaccatggccttaattcaggctttcctggttcatcgccaggactgttgctgtcacctcttacctgtggtccaatctttctcgttctcatccccctaccccaccaccatagtgagtgatgctccaccttgtgattaaagaggttctcctaaaatacagagcttctcattcctggcatgactccccactacatgcaggttaaaatctaccattttaccctgaagtctgagacccattggggcttcagcctaactttcccacggtctccgcctgcctcacctgcaaaggcacctgcttgtgagacctgatgaacttttcgcaggcccatgagcgactgtgccttcttgccaagctgccttctcattgtctggcaaacccctgttcacttgacacacagatcacggctctcctctgaaaaccttcctggtcacccccttgtctgtatattcacaaggcctcttccccattgcattgaagaacaaaccctctatctatttgtcaggcctccaagaagacttactaatcaagtgattattatgtatgatttattagttaggttagccccatcacccagcacagtgcctggcacataagaactatgtgaatgaatgaatgaactaatgagcaaacaaatgaattacaaatagtccccgagttttaggtcctttcactgggacaaagggacatcatgataatgaagtaacttgtatttataaaattatttttacatttaaactcttatctcttttctcatttatatctccagctggtcctgtaaaattaatagaacaggatctttaatgtccattctgtagacccaaagggctaaaacaagtccagggaggaagggcgtggggcccaggctgctgactgtggggattgtgctgggctcacaggggttactctcaaaagtcagctagttgctgactgttcccttgtgtctgcgttttgtaacattataaaagaactacgtaaaaacttatttttaattaatttttttttaattttgaggaagctttagtttgatacctgagtcccttccagtaattcatgtatgaggaactaggtgctgaggtcagctttggggggccttgtgcagagtagctgcccctgacatgctgatgtaaataaagcagtgagtgttcccaggggacgccattctatctgaaattgacccctaagtaaactttgccgaccccttctactgagggaatgctaagtggtttaaatagccgattgtttggactgctttgagcaagcattgtttatggaacaggaaggtcatatgccttttccctcttgatacaagtttttatttttcctctgtgttgtatgagctttctttaagggacatgaaaagaagtactttgtctaaaggacattattctgagtgaacaaagccaatctcaaaggttacgtgctgtacaattccatttagataacattctcaaaaggacaaaattttgctaatggagaacatatcagaacaatttcaggggttaggtttgggggtaggatgttctataagggggtagaagagggagcttctttttggcaatggaacagttctgtagccacaaatctgtacctgtcataaaattgcataaacctatacactcattcttccccccaaaataaaacaaagcagaaactggtaaaatcttaataaggcctgtgttttagttaataatattgtaccaaagtcactttcctggttttgatcattataccatggttatgtaagatcttatcattgggtaaagctgggtgaaggatgtacagtaactctgctatttttgcaacttcttgtaagtctaaagttatttcaaaataaaaagtttcttttttaaagaattttatcatgggcaaaaccaaatcccaaaataaagagcagaactgcaaagagctttagcttcatggtgttcaatggtggagtgctttataagttagtgggtaagcatgttctcactcataggtgggaattgaacaatgagaacacttggacacagaaaggggaacatcacacaccggggcctgtcatagggtgaggggaggggggagggatagcattaggagatatacctaatgtaaatgacgagttgatggatgcagcaaaccaacatggcacatgtatacatatgtaacaaacctgcacattgtgcacatgtaccctagaacttaaagtattaaaaaaaaaaagttagtgggtaagagctctagctttggcatgtagactgatgccactttgctgtcatgtatccctgggcaagttactcaacttctgtatataaaatagggataatagcagtgtctactacataaaacatttatgaggtttcagtgaaataatgaatgtaaagcccttggtaccaggattgcctataggaatgattgaaatgctacctattatattttttgtgttgttatttttatatgcaatagttactaactcattgtcaattttgacctgcctttctgttaacagtggtgggcttgcgttgatctttcaggcttttcttttttaaaaaatacacattttatatttaaatccacatctaggaaacagctaagctagcttttgttttagttagctggatataattattaatatccttgtaataacagaaacaacagtaataactagaatttatacaaattagttcataatgcccacagtactttctgtaaagaattactttgaatcacatagcaagctgtgataattaggcagttttgttgttgttgtgtttagagacaaggtcttctctgtcacccaggctgatgtgcagtggcgtgatctctactcaatgtaacctcaaaactcctgcactcaagcaaatccccctacctcagcgccccaagtagctaggactacagggataagaagcttttttcaaattttttgtaggacgggatctcactatgttgtccaggctagttaggcatttttaatacccattttacatattagaaaaacatttggagctattaagagacctgccttctttttttcttttttcttttttttttttttatgtcacccaggctggagtgcagtggcgtgatctcagctcactgcaagctccacctcccgggttcacgccattgtcctgcctcagcctcccaaatagctgggactacaggggccagccacctagcccggctaattttttgtatttttaatagaggtggggtttcaccgtgttagccaggatggtctcgatctcctgacctcgtgatccgcccgccttggccagtgctgggattacaggtgtgagccactgcgcccggcgagacctgccttcttaaggtctattctccatgtggccgctggagcaatcctgatacaagtcagatcatatcagccctctgctcagagctctgggttttctacccaactcagagaaaaaggcaaaaggcctctcccacatgttgcctctgcctagaacctccccaggcccccgagtatcaacttggcccatttcctcactcctactctttcctcagaggccatttctcaaggaaccacctctgatacccccccgcccatcatttaaaattacagcttgcttccccacccatcctgaccctctgatcgtcttctgtttttccatagtacttatcaccttctaatatatcatacatcttacttatcaaggttattatttattgcccatttctccccctgaaaatgtgagctctataagggtggggatcttggttttattcatggatatatcccaagtttctggaaaaaatgtctggcttgtagtacatactcagtaaatatttgtcaagtcgatgaaagcagagcagatagagaggtccaagttaagaagctacctcacttatgcagcatgatcttccatttgttgcttcctttggtagaaagatggacactagggaaaaaagaaaaagaagggacagaattgtttatctagttaatttgcgggattgcttaatccagaactcaaagaactggctcaactgtgctcttaggagttgctccctcagcaattcggattgtccttctctcaagggaacatcctgttactgaatgttccttaaaaatatctgtcagagctgtgtcataaatatcttttctcaaaccagcagaggaccaagcaagaggggcgtgaaccatcataatggagttgggtgaaaaggagaaattgctctaagagggacgacctacccactagaagaggagttggctcaggagattgtgggggttccagtgcccggggccattcaggatagagtgggtgggagggtggagacttagggagttggatgctttttctccctggaaagtcacaagggtttggggctgtaaatgtcaaggtctattccagtctggtagttactgttcatccacacagagagaactggcgagtgagagggagctgtcttctcctagtgtacactcattgctatggtcaatccaggcttataaacgagtgtctagttgggaagccagtgccattaagccattaaagtttagctgaaaaattaagcaaagaagactatatttggccctaagtgctgtctggttttggagaaatttacctttggtttgaactagtttcctcttctctctactggtatctctttggcctatgggcaccaaccacctgaccttgtacactgttttaatacattgtgtggttactgccaggcaattcagacttggtgtaggtgtcttgtgctaggacatttgctatagattgtttttttgaccttgggtgcactatgaaaagaaacacacaggagaaatgactgtccatttgacctgaagtcatgttctgtgataatgtttccctttcagcattaataaacctgttaggactaaagatcactgggcctgaaatctgctactataggatcctactataggttctataactggataatggatctcagtgaaataaacctccggttttaccacagggctggctcttccccttatgacaagtttggaatgtaattttgtagtttgtattcaagggtttcctaagagttttgataataattgaagtcaaatgactaattttaaactgccaatgtctcctccaatatataaaaaaggtaagttagtaactccctgtatcttctgattgagccaaggccaatttttctaaatataagccaggttttgcaagttcatgcagcctggtggttgaaatgggcatatcacttgggagcttaggatctggaaggttaaaagtgatgccaaggcatgaaaatcaaagtgttaaaggcctcactgtgaaacagtgatcagcagagcatggaccccttagtgggatcagtgtctccatcctcatcctatatgtatcttctttcttaaaatcaatgcttgacaacgtgcccaaagtccagttacttcgccagttctccctttccacctccctattttcctttcatctcttccttgcattacaaaagaaaaaagacctctcttgcttgtctggaatcaccactatgaagcatcagttctcaatgctttggtctcaagatccttcgtttgtttgtttgtttgtttctttttggttttttgtttgtttgtttttgtgtgtgtgtgacagagcctgactctgtcgcccagcctggagtgctcactgtagcctcaacctcctaggctcaggtgattcagccatctcaacctgccaagtagctgggaatacaggtgcatgtcaccatgctcagctaatttttgtgttttttgtagagatggggtttcaccatgttgccccagggtggggcaacttctggacttgaactctcgaacttctggactcaagcaatcctcctgcctcagcctcctgtagtgctgggattacaggagtgagcccactgtgcttggcctcaagatccttttacagtcataagttatcaagaaccagagttcttgtttatgtgggtcatatctatctatatttactgaattagaaattaaaactgaaaacttttaaaacacaaaaatacacaagcatacacttcattggctaatacatctatgctatggcatcatcatatatcatatagcctctgggaaattcttttggaaaattccatcatatattcctgagataatgagaattaaaagagcaaacaatatattattattatgaaaatagttttgactctgaggactacagaaggggtctctggaatccccagaagtctcttgaccatattttgagaatggttgctgtggtgcattgtcttggggttaagaaatttccagagacagaaaattccaaattttggctggacgtggtggctcacgcctgtaatcccagcactttgggaggctgaggcaggtggatcacctgaggtcaggagttcaagaccagcctggccaacatggtaaaaccctgtctccattaaaaatacaaaaattaaccgggcgtggtggtgcatgcctgtaatcccagctacttgggagactgaggcaggagaatcgcttgaacctgggaggcggaggttgcagtgagccaagatcatgccattgccctccagcctgagtgacagagcgagtctcagtctcaaaaaaaaaaaaaaaaaaaaagaaaagaaaattccaaattttgtccagcaaagaaattgctcttccaataaagttgtacttatgtttaagaatcacttacattgttttgattaattgcatcctaataatgagtataatcaattcagaagaaaatatttttgcaatttcaaggtatatatatgtttttgttgccaataagttcccatggtttaagcaaaaactttcaaatgtgtaccattaagatgaaattcttggggctggtagaagagtcatggtggaaaacttgctgctggggaagagtcgttacagtgggtgttggtgtcaagatattcaaggtacctcaaattacattttttgaagatgtttaaattacgaaaaatttaaggatgcaaacttcaaaatgtgtcagagtccacgtatatttttcaaaattctctaggagtaatacaagcagaagatataaagaccccgaggcagagtatcacagggatccttttatagatgtgtgtgtaatgggtgtgagagaaatattcctcctcagtgcaataaatattttctaattcactacacaaactagtagcagtttcatgcctcacttgagaagaagtgaccaaaatatgaaagtagatggcttctaccaggagtttttgtttcttagcactttaaattttctttctttttttttttttttttttttttgagatggagtcttgctctgtcgcccaggctggagtgcagtggtgtgatctcggctcactgcaagctccgcctcccaggttcagccattctcctgcctcagcttcccgagtagctgggactacaggcgcccgccacaacgcccggctaatttttttgtatttttagtagagacagcgtttcacagtgttatccaggatggcctcaatctcctgacctccgcccgcctcagcctcccaaagtgctgggattacaggcatgagccaccgcacccggccggcgttttaaattttcaagagaatttaattaagcaatccagcttagggtttcctcccatctgagggaagtattcctcgtctttgaaaattaagatactgtgaagtagcagtcaaatcctctccataataccatgttatttttgaagaaatgaaaggttaccaccgaatcataggacagagatgtatgggtttgcttttccctgagggacccgtgtgtagtcagggaaacgcagacactggtgacaaccttccatctagatggaaaataacaaaaacccaccagcactgattttcttttttatgcacatttaacccctcaggagaagcactaatataaaaaggatcagacatgcattttttctacagcgtctctcagtcacagctctctgccatgtagtgaccacttggctgcagccggggcgcagtcgtggccatgcagacatccgaccaggaacagcttttctaggctgatgcctgctgtgcttccctcagcaagtttttttccctttcattcttcaaatattttattactgttattagtgataagctttgagtttaaaaatatctgatggaaaatttcctacacatgtagacagaagacacaaaataagcttttctgccaagaagcaaatggtggcatattttcaacaattttatgaagatactactgtatgtcagatgatgtttctgtgtgccacagatatagaagtttccagattcaactacatagtaaatacttgtatagttgtaattctaaaaaataaccattcaggtcgggtgtggtggctcacacctgtaatcctagcgttttaggaggccaaggcaggtggatcacctgaggtcgggagttcaggaccagcctggacaacatggtgataccccgtctctactaaaaatacagaattagccgggcatggtggcaggtgcctgtaatcccaactacttggaaggccgaggcaggagaatcacttgaacctgggaggtggaggttgtagtgagccgggattgcaccattgcctgggtgatgacagagtgagtctcgacctcaagaaaaaaaaatttcaaattttaggattgttttagacttatagaaaaacactggggataatacagtgatttcccataaaccccacccccactttcccctatcgttagcattttacattggtgtggtgcatttgctacaattgatgaaccaatacggatacatcatcattaactaaggtccatactttagtgatatttccttagctttttacctcctgtcctttttctgtcccaggatctcatccaggacaccacattgcatttagtcatctatgtcttattaggctcctcttggctgtgacaatttctcaaactttccttgttttgaatgaccttgacagtgaaggggtgggttgctcctccacacctgtgggtgtttctttttaggtggaacgagagacttggaaaagaaaaagacacagagataaagtatagagaaagaaataaggtggcccaggggaccagtgttcagcatatggaggatcctgccggcctctgagttcccttagtatttattgatcattcttgggtgtttctcggagagggggatgtggcagggtcataggataatagtggagagaaggtcagcagataaacacgtgaacaaaggtctctgcaacatagacaaggtaaagaattaagtgctgtgctttagatatgcatacacataaacatctcaatgtcttaaagagcagtattgctgccgcatgtcctacctccagccctaaggcggttttcccctatctcagtagatggaacatacaatggggttttatacggagacattccattgcccagggatgggcaggagagcaatgccttcctcttgtctcaactgccaagaggcgttccttcctcttatactaatcctcctcagcacagatcctttacgggtgtcgggctgggggacggtcaggtctttcccttcccacgaggccatatttcagactatcacatggggagaaaccttggacaatacctggctttcctaggcagaggtccctgcggccttccgcagtgtttgtgtccctgggtacttgagattagggagtggtgatgactcttaacgagcatgctgccttcaagcatctgtgtaacaaagcacatcttgcacagcccttaatccatttaaccctgagttgacacagcacatgtttcagggagcacggggttgggggtaaggttacagattaacagcatctcaaggccgaagaatttctcttagtacagaacaaaatggagtctcctatgtctacttctttctacacagacacagtaacaatctgatctctctttcttttccccacagacaggttttaggtatcactggtcaggtgttttgtagaatgtcccacaatttagaactgactggtatttttttcatcattagcctggggtttttttgttctcgggaggaaggccatagaggtgaagtgacattttcatcacctgtttccaagggtacattctgtcaacatgatatagcacttgatcatctggctcaggtagtttgtcagtttctccactcaaaaattttctttcttttttttttttgctctttccataatgtacttgttggaaggagtcactgtatgcagcccattaaggagtggggagttatgctccacctctttgagggcagaatatccaataaactatttggaattattctgcaagaaggtttgtctattctctccaatttatctaattatttgttgatatcagtagagactcctggatatttttttcttctttgggttataatccaaagctactttattttcctgctcaaattgttccagctttggccattgggaactctttgagttagctgctgtgtctctttgacatgccccatcattgtctcgtgtgtgtgtgtgtgtgtgtgtgtgtgtgtgcgcgcgcgcacgcgcatgtgtgtgtgtgtacgttgtgtgttgtgtttgttttatattttactccagacttatatatttcctgctccaatctgagaatcagccatttctccaaggagccctggttccatttattggagaatggcattagaaaacaagatctggctaacttgtcttcctatttaaaattaataaatcaattttttaaagatgtcttcaaacctctgaaatgatagaatttttcatttagcactagtgtcttctcttcgattagttataacgccttgcatttatatgatgcatccttgtgaattgaccagtttttactattaaaaaaggattcattacaacacatcatctgagatttttaaactgtggcttttattttgctatttctggtattctgaaatatgcatagcatagtggccctgtatgtactggggggttaggcagcaggatcaggtgagcctcagaacccactttccttgatattggggctagcgatttgcagtaaaaatctaaatgatcctgctttattacctaatgtctcaccattcaggatctgaataaatgaaagcagctgccttttgggcccatggctaccttgctcttggtgccttgggtttaatcccaggtttgtttctccatagctagcacaccttttaaattaactttgcactaatgcccaaaagccatgaaccaagaaataaaataatacaaagacaaccatagaattgtagtgaacagcagcctgtttctctgctgctggtctcatgagtctccttccattccaggcctgacggagatggcggtcttcagttgtgaggcccacaatgacaaagggctgaccgtgtccaagggagtgcagatcaacatcaaaggtaagcagcaaggctaggctccccatgcatgttctgggagctggtgagggtacagcatgagcttgcagctggctgcctgggtgtggatcctggctttctcactgtctcaaggttctttgtgaccttggacaactcacttctcctctttggtgtcagggttcccctctgaaaagtggagataattacagaacctacctattgttgaggcttattgatttaatacaagtaaattactcagaagtgcctggcatataggtctttgataaacattcactcgtttagctctgcttactccaagaagaaaacaagctaaaatgttttctctttcttagttcctattttcacttttccctcttccaccgtgaactactcattaacccttgaagagccctggggatggggctttcttggggcatgatctaggaaatggaccctgtccttcccaggtcagcggggcctgctgactgactccctgccacctactgactcagggagacagaggaaaagcaagaagcagatcactctttggagcccaatgctcctatccctcttcctcctaaactccctcttcctcttgtttcctctgagctaggatttcactaggctgagcttgcttggccgtgagttatgataatagaattaaaggcacacatttgaaggcctccaagctagtggagacatttcaatccaatctaccttattctccttctgtgtgatcaaaggtgttaaacttgaaatttgaaagaaaagaaaaacctacaattaggtagtatctttttatttcattttaaatcatcctccttagtgtgtcatagaaattcaagcaaattttatgttttactatttaatcatagtttaaatattgagaagtaattatttggctcatgttcttttcctcttgtccttagggaaacagtgcaaggaaaaaggagaacttgtttaataatgaattaaaggttgggtacatacagaaggagactcaaaattacaaaagaagttatactcaaaaaagatgctaattttagtttcagcaaatcaactggacaaacgctatgaaagggaatattctaaaagttcactgggataaaaaaataaccaaactaaaagttattactggaggaagtgtataacttccttccttcatcacaattcccattattacaatttccaaaagacatgttgggaatgtcaaaaattcatgagtgtgtgtgagtttgtaaagacattttcatgaagtataaacctcttaaaatttaaaaatgtataaaatgaaaagcacttctccaattttatgcttcagaatctcagctaaggttttattctattagatcattccccaaacttctgtttttggctttcatttattataaaatttatgtcaaagctaccaagcctcccttcttctaatgtgtaattactatggtatatgtggtcaaattttggtctggaaaggcagatgctttagggcagttccacaaataatctgtggaggaaagtgagtcaaaccttattcttccccattcccaaggctttgtgtgtactaatcaaacccaaactcctaaatgtggcccccagggcacgcttgatatggtcttgacacaccttcctccttctctcctgctcattccatcatcaccttcatcctcaccacaccctccctgggcctcatccacagttccccacatttattcctcaccacagctccatggagcagtgctggtactatccccatttatagaggagacaactgtgtgtagttgtagatagggcgtgtgtagctgtgcctggggccatacagcaggtcaggtggtaaaccagactcacagtccctgctggtgttcccactgtctgcttgctgcccttggcaataggcctccagtgtcctgttgagggacacaagctccagggtcaggcagaccagagttcaagtccctgttgtactgcttacaacctctctgtgacttttgccaagcttttaacttctctgatcctgtttccttatctatgaatgtggattgtaagactacttctctaattggattctaggaatgattaaagaaagccctcaaagtgtctggcacatagcaagcacaggaagtgttagccttcatttttaattatgagtgtaattattattatgaattaaattcagcacaaagaaataagattccccaaatttaagatccttcttggattctaattgaaatagctacccttcacccatctgtttccaaggtcatagcccacccattcgaggacacacaccccttcccctcccccagcagatgcagctggctcttttgcttgaactgactcttagtgtttcctcggcctggaaagctccccctacacatgcacacatacacatgcacactcatgcgtgcacacactctcctgtggcacccctctcttctggtgacagggcgctcttattcttggttaacgtgggtctcctataccaggccatgtgctccacgagggcagggctatgactctgtctctgtttagtaagctagtgcccagccaggtgcacacagtagggtccatgaacatgtactcagtaaaggacatgagtatttccacatcttttccagttcaaaggtctcctcatttcattagtgaataggaaagtgggtctgcgttcacttctttggcccttcactggaagacttctttggcccatccataggctaacacaattaccctcaggcatagggaggctcctcttgaaaacatgtttccctttactaatctcaaggaacgaaaacaggtattaatgcatttgtttggtagctgtagcctgtcatctataattgtgtttgtgtgtgtatgtgtgtgtgtgtgttttgttttatgcagcaattccctccccaccaactgaagtcagcatccgtaacagcactgcacacagcattctgatctcctgggttcctggttttgatggatactccccgttcaggaattgcagcattcaggtaaagttccagggtgaagagggaagtagctgtttggtgctctctgtgggtttaaggatttttcttccttccaaggatgggcatggagggcatttctccatctctgtacagagtcccctgacctccctgcttcagtgtccagcatgcatgcactattccatgtccatgctctgcccatgatactgtgtccttcctgtgcaggattcagggctcagtcagaagcaaaacgtgtttccaagggagaacatcatgagaccagggagagttcttcttctttttttttttgagacaaagttttactcttgttgcccaggctggatgcccaggctggagtacaatggtgtgatcccggctcaccgcaaactccacctggttcaagcaattctcctgcctcagccccctgagtagctgagattacaggcgtgcatcaccatgcccggctaagtttgcatttttagtagagatggggtttctccatgttggtcaggctggtctcaaactcccaacctcaagtgatccgcccgcctcggcctcccaaagtactgggattacaggcgtgagccaccacgcccagccaagaccagggagagttcatttttaaggtcccgaaacacatgcttgtgaccaagagttgaggaacccaggcactccccagtgtggctccttctgggctggtggccatgaaggacagaagggccaggacaagataggtcgtctgtgctactgagcgtagcaccttacccagtgtcaccgggggatcctggtcattgcaggccttgtggaatcttcagccatttttcactgctgccttgaatgggtatgaaacggtgctattagccatcctaaaatgataacttgcccatgatgtaagctgtgctcttgagttttcacttcataaaaatgaaaatggtggcagtaacaactgtttactaagggaccacaggggctttgcaaacattatcttacttaacacacgctgcactgcaggctcagagtactcacacagcctgtgagtggtagaaccagaactcaagtccaggaagctccagtgcctaaagcagcggtcagaaccatcagctcttccgtctcaggagggacatcgcatctgggagcaggttaccgaacatgcaggaattatccactaaaagtattaatgcatcctgcctggtacttaatcatacagtagggtcaggaattagtttactaaatatctggtctcattagttaaaaatatgttaacctgacacaggccagtcatgccaacacagctcaaagaattttgtgttgacaactagatgtttttactcgctagtcaaattaatttctctgttcttaacgcctcccacttttatctaacaggtgttccttccctgaagagtaaaagcctgtattatccgtaaaatagcctccgccctcacccaccacctccagcctttcttttttttttttttttttttgagacagagtctcgctctgttgcccaggctggagtgcagtggcgcgatctcagctcactgcaagctccacctcccgggttcacgccattctcctgcctcagcctcctgagtagctgggactacaggcccccgccaccgcgcccagctaattttttgtatttttagtagagacggggtttcaccgtgttagccaggatggtctccatctcctgacctcatgatccgcctgtcccggcctcccaaagtgctgggattacaggcgtgagccaccgcgccctgcccagcctttcttaattcttgctcagttttgttttttgttttttttcctgtaagcctcccaagcactggtaagtgttaggaattcttactgcatctacaattcctcaccaggaatggtcttttttgtgattgattttttttaacacctttttttgagatatagtttactttttttttttttaatttgagacgtagtctcgctctgttacctaggctggagtgcagtggtgtgatctcggctcactgcaacctctgcctcctgggtgcaagcaattctcctgcctcacccacccgagtagctgggactacaggcgggtgccaccacgcccacctaatttttgtatatttactagacatggggtttcaccatgttgaccaggctgttctcaaactcctgacctcaagtgatccaccagcctcagcctcccaaagtgctgggattactggtgtgagccaccacgcccagctgagatatattttatataccattatattcacccattatttaaaatgtacagttcaacggtgtttagtatattcaagaattgtgcagccattaccactatctaattgtgtctatattcataagagatatttgtctgtagttttcttgtggtagctttttctggttttggcatcagtgtaatattgaccttctagaataagtatgaaagtcctcctcctccttctcctcctcctccctcctcctccttccacctccctcctcctcccttgtccttcctccccctactcctccctcctcccttctcctcctcctcctccctcctcctcctcctccctcctcctcctcccccctcctcctcctcctccctcctcctccctcctccttctcctccttctcctcctccttctcctccttcttctccttcttcttgttcttttcttggaagaatttgtgaaagattgatgttaaatcttctttaaatatttaataaaatttgttctctttgtggaaagttttttcaatattagctcaatctttttacttggtatgagtctattcagattttctattacttcttgagtcagctttggtagtttctatgttataggaacttgaacatttcgtctcagttatctaatttattggtatacaacatagtacatagtattccattataaccttttttattctttgaggttagtaataagatcccctgtttcattccaggttttagtaatttgtcttctctcttatttttcttagtcagtccagctaaaaatctgtcaatcttatttatctttttgaataaccaacctttgattttgtgaatttttttctattgtttttgtattctatattttctttatttctgccttaatttttgtttcttttttttctgtttgctttggtttagtttgctctttttctagttttgtaaggtagaggttaggttattgattgtgttcttttatatataaaaaaaaataggcatttacactctacatttccctgtaagcactgctttagctgcatcccataaggttttcgttgttgttgttgttgttcatctcaagttttctgtcattttccttgtgaattttttttgtcctcttgattatttagaagtgtgtatttaaattgtcacataattatgaatttcccaaattttcttcctttactgatttctaatgttattttactgtgtttggagaatatacttcacatgactgtgatccttttaaatttattaaggcttgttttatgacctaagtcctatcctggagaaagttttgtgtgcacctgagaagaatgtacattcagctgttgttggatgaagtgttttgtgcatgtggtttaggtcttgttggtttagagtcttcagtcttctgttgccttgctgatactctgtctcatggttccatctgttattgaaaatggggaattgagatctcagctcttatttttgaattgtctgtttctcccttccgttctatcagtttttgcttcatgttcttttggggctctgttgttagaaatatccagggcctctttccctagaggtagacatttatttatttgtttgtttgtttgtttgagacagagtttcgcgcttattgcccaggctggaatgcaatggcacagtctcaactcactgccacctctgcctcccgggttcaggcaattctcctgcctcagcctcctgagtagctgggactacaggcacctgccactgcgcctggctcatttttgtgtttttagtagagatgtagtttcaccatgtcacccaggctgaggtagacatttatatacatggacataactgaagcatgggccagccctttttaaaactgttaccaaagtgctgagttgtttgaagagcctgagaggacatgaaacatgaggatggtgagcttcagggagactctcaggaagagtaccaccccaccttgagacggcaggtctcagtgacgtgaggtgggtaggatggttgaaaagtctgaaaacaccaggtcacccctgatgatggaagatgatcacacacaagatttacctgctctctttctgccatggttttgggtgttcatggtacacatgaagaagcatcctgagacagccaaagtccagtgttttcttgcccaccttggattctgtggtgctggatatgatgattctgttcttgtcccccttggctagctcagcctccattcatcctttctcctttccatctctggtaggctttccagatttggcaaataagaatacaggacacccagttaaactgcatgaataatgtcgtgacatacctatactgaaaagttacttgttgtttctttgaaattcaagtttaactaggtgtcctttatattctcttgcagtcccactggggttaatcagcacaagctctaaaagttatcttttctattctgtcattaacagtgtattcccagtttttgaagggaccaagtatggctttgtaaaattataattttaaactctgactcgggaccaaatgaatgttttggatgagattcagatccatgcactagcaggacacaccctctcacttcctttggtcctgatcttagctcttttcttcacccatttttgggccacacactccatttctaattttagctctcccatgtacttcttgccacttcatgcctgttttccctgaggacccactgactgagaaggactgttatagaaactctgttttcctctaggaacgtgctctcagacagtgtccctgagcctggaagtgctccccacatgtctctggaagtggggcggggaggagagccaaaggtttcctccaccttcgctttggtggttggtcaccaggaagtaggtgcacactctaaagtgaaacaaacaaaaagtgatgtctgccaacagccaccaccaagacaagcgtctgggttctcgtttctcctctggtggctcctcaggccaaatgataccttcttgtcacccacggggtctgagtcagaggtgaaactcaacccccacaccgtactcctggtatctgccaggggatttggaattccagaatgtttatttctggttcattgacctaagattcaagcacacatagcctgaaattacagtactgtatatccagagcccagaactgcaagcccattattaacagtaatacattttgtggcctgaggatttttcccaaattgctctcagttgcatgttttacccgatatcattttgtctgttctgattttataagtgccacatattacagaaattttgaaaaagcatgtaatggagaacaaaatcccatactctcccttatccccatacccagacaggaggtatgcgaggaaagagatggaagtttcgcccaggactagacttgtgctgggaatcgccctctcttgcctatgtatacagagatttggagggggatgtggagagactggtggagttatggagggaaagataaggcagtatgtttaaaggagatttggagaaaagttttctgaaggaggggcaaatgaccctttgctatatctcctcatcaaaaaaaaaaaaaaaaaaaagccaagaatctacatttcctgtgtgtgcctctggaattcaatttctgttggggtcgaaggggttaagaataaaggacacactaaaattagcctcaggatgagtgcattggctcacgcctgtaatcctagcactttgggaggccaaggcaggcagaacccttaagatcaggagttcaagaccagcctggccaacatggtgaaaccccacctctactaaaaaaaaaaaaaaaaaaaaaaaaaagttagccaggcgtggtggcaggcacctgtgatcccagctactctgaaggctgaggtgggagaatcacttgaacctgggagacggaggtcaaaccattgcactccagcctgggcaacagagtcagactccatctcaaaaaaagtagtaataataataacaataaaataaaataaagttagcctcaaggcaagagcagtgttccttaggttacataataaaaagaaagattaagaaacgctgggtgtggtggctcacgcctgtaatcccagcgctttggaagtccaaggcaggtggatcacctgaggtcaggagttcgaggccagcatggccgacatagtgaaaccccatctctactaaaaatacaaaattagctgtgcgtggtggcacatgcctgtaatcccagctactcaggagactgaggcaggagaattgcttgaatccgggaggcggaggttgcagtgagttgagataacaccactgcactccagcctgggcaaagagagcgaaggtccatctcaaaaaaaaaaaaaaaaaaaaaaagaaagaaaagaaaagaaaagaaaaagaaagcaagaaacccatcctctaaaagcagaatttgggaaatatttcctttaaaaggcaaaatagtaaatatttcagggtttgccagcacatattatatctgtttcctctgttgcatactccatgaagcagctgaaagaggtcaagaatcgaagaggttctaagagaggagaggctttattttatagtataatatgaattctaatcatcataattatttgctccgttacctgccacagtgagaattgttaattgttattttaggcgttttcctcaggtgttcagttattgtccgagggcatgagtaacacacagtgatgctagcggtaaaatgtgtgtgtgcccagaaaggaagcaggtccttccccttagcgtagaggaagggccacgtgcaccgaatgcacacaggccccgtgcctgacattcccaccaccttactaatgcccggtcctcatgtttactcttcgtttaggtcaaggaagctgatccgctgagtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggaggtaattcctggggttcagaatgtatattgcccccaatgacatgtgattcaacaaacccttcccagtggcctgactgagagttgaaactttgctttgtttggactttgtctctggaggagaaaattattgaggcgactgatgaaaatgggaaagatatttcctccatactgtaaaagcattcagtgacaaaacttagccgtgttatgtataggtaatcttttcttttacataggagataatagcagcacactttaaaacatgctctctcacaacacaacaatcaatacatgttaccaacacagtggtcaatacagaagccttcggccactccaatatatgtggggatttctctccaccagcaagcagtcggctctgcagcggagaccagctgagtgtcctccattcaagtctgacactacatggagatagcttcagatcccataggttgaggactcaatccccaggcctcccctccctcccaaccccgtccccagcctttagatgccaatcacaagtctgggcctctggaacttctgactaagtgtttcccatgacctcagctttgtgtccaattaatttgctagaacggttcacagacctcagggaaatacttatatttaccagtttatcataaaggatattacaaaggatacaaatgaagagatgcggaggatgagatatagaaggaaagggtgtggagcttccatgccctccctgggcgcaccaccctccaggaacctgcacatgttcagctatctggaagctctctgaaccctgttctcttgtttttttgtggaagcttcatgatgtcagcattccttcctccaggttatgggtcaggaccccctttgtaataagggtcttatgacccacagtcagaaagatggggaagattagagtcctgcattgaggcaggtgaaaggagggcgggaagaggtcagagagattgttttctgaggcctgcccctgaggcgtaaagcacccaacatcatagcaaaagattgtaaccagggctatgggagttgtaagccagaaatcatgacaaaaacctgtgtgtgtgtgtgtgtgtgtgtgtgtgtgtgtgtgtgtgtgtgtgtgtaggttattatatatatgtacatatacacacatatatacacataaaataacccacaagtccattaaaatgtaatcgaatcattcaaatggataggtttaattgcatcgtattttctatttgttctatctgtaatttgttctccttttcttctttttcttcatttaaaaatattatttttatatttttaatattaatatttttatgattctatgtttaatatttttatgattcttattttttattctttgtttggcttattagccatagctctttttctgttcttttagtggttgctttaggattcacagtgtacatatttaacttatcacagtgtaccttcaagtgatttataccatttcacatatattccattttctccttcagatatttttggctactgttgtcaaatattttactttaatgtatcttaaaataccattgctacactgttgttatttttgttcagtcagtaatcttttacaaagagatttatataaccaggaaaaacacatgtttatgcattatagttaccatttctagtggtcttcattttttggtctttatattttatctgacatcattctccttcttcctgaagaacttttttaaaaatcatttcttctagtgtggatctgctggtatggtattcagctcctgtagtctggggaaaaatatttattttacttttgaagtgttcttatttttatttttagccttcatttttgaaaggtatttttatgaggtatagaactgtaggttcacaattttagcttttgtttgtttgtttttactttcagtacattaaaagaagttgctcccctatcttctcgcttgcattgtttcccacatgaaatctgtgatcatcctaactttgttcctctgtatgtaatgtgtcttttgttcctatttttacccttatcactgattttgagcaattgaattgtgacaggctttggtgtaattttatttatatgccttgtgtttggagtttattgaacttctggggtctctgtatttgttgtttacatcaaatttggaaaaagtttggccattatttcttcacattttttttctgtttccacctatcctcttttttaaggactccagttacatatatattagaccatttgaagttgtcccataactcactgatgatctgttattattttccccttcttttatctctacattttattttggatagtttctgttgctatgtcttcaatttcactcatcttttttggtgtagtatctcatctgacattagtcctatccagtttatatttcatctcatacaccgtaatttttatctcttttttgcatttttatgtctctaagttttggaccatccagaatgcagttataattactttccttttttctttctttcttattttcctttttctgtcacacaggctggagtgcagcgccaatcatagctcactgcagtcttgaactcctggcttaagcaattctcccaccttcaccttcgccttctgtgtagctggtactacaggtgcatgccaccacacccagctaatttttggtttttttttttatgttttgttttttggttgttttttgtttttttttttgagatggagtttcactctcgttgcccaggctggagtgcaatggtgtaatctcagctcaccgcaacatctgcctcctgagttcaagcaattctcctgcctcagcctcctgagtagctgggattacaggcatgcaccatcacgcccagctaattttgtatttttagtagagatggggtttctccatgttaggctggtcttgaactcctgacttaaggtgatctgcctgccttggcctcccaaagtgctgggataacaggcatgagccaccacacccagcatgttttttgtttgtttgtttgtttgtttgtttatagaaacagggtctcactattttgcccaggctgctctcaaactcctgacctcaaatgatcttcccacctcagcctcccaaaatgtttataggcatgagcctataataggggattataggcatgagccaccgtgcccagccttttcataactgtttcaatgtctttgtttgctatcctaacatctatgttatctgtgggtggtttcaactgattcatttatgtttccactctaggtagtatttttcaggttctttgcacgcctgataatgtttgattggattacagacattgagaattttacagtgttggatgctagatattcttctatttctgtaaatagtgagctttgttttgagacacagttaagctagtgggaaaccgtttaatcctgtagggtcttgcttttaagatttattaggcagaacctgataagggctcagtctcaggtcggttattacccactgctgacacaagaccattctgtgtgccctactcagtgcttcttgaatcattagattttccagtctgattgatgggaacaggcactattcttcccccgtgtgaagcctggataccattacctttaactgtttcgtgtggttctttttctattttcctttagaggcatcctaaggattctggtgccttctcctgggtatttgcctttcttagtttatgccctcgtttttatggagcccattctcaattagcttccacaaaatgtatacataaaaagtaaagattgtgggaacttgcatatccttatgtaatactggcttagtaatttttccaaatatagaaatttaggttgaaattattttccctcagaagtttaaaggcgtttttgtatcattttttagcttcatgggttgctgtggaaaattctgatacttaagttttctatgtgaactgtttttcagttttagtttttaaaatatcttttctctttaatcctggttctgtgataagctgtgatgtgcaatttgttttggtcatcaagggcattcagtggcccctttgatctggaaatgcaagtcttttggtccttaaacttttttttttcctttggaaatgttccactctctgttttttccaggaattgtgttagacgattgttaattagacctcttcgattgcttcctcaattttcttttttcaaattggcctattttctttgcctttttattctaccttcttggagatttacttgatttatcttccaattcttctattaaatgttttattttacttatcatgttgctaatttcaagtttttttcattgaaaatttttttctggttctcaatcataagagtcttttctggatatctcaattattttttgtttgtttgtctttagtctccctagttccctacactagctttgtctcctctaagccctctgttctgtgtggttttttttggtccctgatattcagtggggaggcttcgccagacctctgctaatttctgctgtctgctcctatggaagagtgaagaatcattgatttgattggaactctgtgggtatgggcagagcttgtaggcttcactataggtgattggacagtgacctaagtgttttgatctagatacgataccccccaactgtcaaaattggtttctttcctctgtagccgctcacttcctctagaaaagaagtgtcctgctccaggaattaaacgtggctgctgatattctagtagccaagtgggggaggaggggaaggtagagtccttgttatttagtatataaactttcacttattttcccagttttcagcctggctccttatcatgcctccattctacaggtgccctaagtttagtggctttctgcttcagagaataaatcaccctgtgtcctatggatatttgagggcatacttgccaggtgtgtaggcatggagaagacagactttgagacgcaactatttcttttttttttttttttttttttttgagacggagtctcgctctttcgcccaggccggactgcagtggcacaatctcggctcactgcaagctctgcctcccgggttcatgccattctcctgcctcagcctcctgagtagctgggactacaggcgcccgccaccacgcccggctaattttttgtatttttagtagagacggggtttcaccgtgttggccaggatggtctcgatctcctgacctcgtgacccacccgcctcggcctcccaaaatgctgggattacaggcgtgacccactgcgcccggcagagacacaactatttgttaatcagacttccaatcattctttccagttttagtccccattttactacctgggcccacagcttctgagctgctctgtgattctttgggagaatattggcttgctgagttaattataccttcttcatctctttttcagctttcaaatatgtgttgaaatctctcttctactgttgactcctctttgccttgtgagtttatatctttttaaattctttattgccatcatagaggggttttgggaggaggcagacatacagacatgttgtgttggccatatttatccacaaattctacaacaggtttgaaagtgtgcgactgatttcataggcagctttagttgtgtgatgttttctaagctgaaattcattttaacttcatgattactgtttctggaatcagcagagaaaaagagggttatagtatcctttcacacatatctgaaatatagaatttaacctcccctcattcaactacaggcaacagtttggtgtatattattctaattgttattattctttctagatatagaaggtttattgttttaatttctaaaatggatctatatactttttacaatctgatttttcccccattggatttttttatatcaatacacatgacctaattctttccagtgacgaggtagtaagtattccattggaaaatgtatcaaaatttgtattattattattatttgagacagagtctcactctgttgcccaggctgaagtgcagtggcatgatcttgactcactgcaacctccatctcccagattatatcataattattgaccaagcattgcatttatttctatttgtcactattatgctgcaatgaatataacatcacctacagattaaattcctggaaataaaatatttggtcagagagcatattattttcaattttaatagatatagttaagttattctctcccaaaaaagactgtagtaatgatcttgacttgtttcccaaattattttatacacgtacactcgtgtacacacacacacacacacacacacacactttttaaatgtgttgacagattagctctgttcagactgtcagtaacttgcctctggactttaaaatggtggctgcattctgagctcagcagtgtttcctaccttgtgcatctcaaatgccaccaagctgatctctagctggccatgttaactttctgccccacaggtttatgctggagaacattgttcaagttgtgtctgcttcacttccccaggagtccagagcaccacccaccctaccttccctgccttcttcttctttgctattttactttaggtgctcatgaaatttcctttttttttttttcttttgagatagggtcttgccctgtcacccaggctagagtgcagtggtgcaattacggctcactgtggccttgactttccagggtcaagtgatctttcctcagccactcaagtagctgggactacacacctgtgccatcacacccagctaattttttatttttagtggtgattggagtctcactatgttgtccaggctggtctcaaactcctgacctcaagcaatcctctccctctggcctcccaaagtgctgggattataggcatgagccaccatacctggccaacattttcttcttttctttctctttctctttctttccttcttttcttccttgcttgctttttctgcccaggctgaagtgcagtggtatgatcatgtctcactgtagcctcaatctcctgggctcaaggaatcctcctgcctgtctcctgagggactggaactacagatgtgcaccaagtagtcagctaattttttagttttttgttttgttttgtagaaagggtctcactatgttctggctgatattttcaacttaagaaatgaatttctaggcttcagtaacctaaaagggctcacttatttaaaactcactgatatctcagtgaaaatcttagttgaaaaggtgaaaatgtgctataagtcttggtctcatttgagtgcttttcatagagcatttgaaaaccaaacacttgaaaacccagatgagaatacatctgtgtgtgctttgtggttcttcattcttctctccttttttcttttgtagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccgtaagtctaaaccctagaagagcacgattagtcatctcctttcaacttgctggtttacttcagttttagaagctttcatttggttttgaaaagacctggtgtgattgagttaggcaaggcacctttcaggggaacataaagaatatagtaaatattagaggtgactgaacagttacaaaattctaaggtatcttttgggactttcctcacttactcattcattcattcattcttttacttattcatgagatagacatagaattcatcctctgttatcacctgacttttgccctcatggaatttaggctcttataggatgacagtgtggaatacccaagttgtagcattaggtcagggagctacagggcttagcagtccagcaattcatggccttttggaaatttcatgggactttgcaaaagaagaagataagggaataacctcatcctcatagagaatggcaagaagtaagcagacaccaaaggaggagaccgagcaagctctctggccagcctggcacagctgcgggcaagccgaaattagacatcagaattactggatcaggacatgcagtctgacactacataacacaaccaggtgcatcagccaggtggcacaggttccctgctccaccaagtcccattgggcaatgtgatgtacccacttggtggattgtgcacctgagggtactagggtcaagggctcagcaccctgtgtagtgaacagcaaacaagctgatcctctgtgcagttgcacggtcgtcatgctgtggccaccttgacctacttcactgcccacgtgactagccccagcatggctcggggttggggatggttaggccttgcagtttgtcacactcagcaaggatgaacaaagatgcttggagcctgtggcagactgcctctcccagaaaaggtggtacttgaattgggcttgtgtgttagtcaagattctttagagaaacagctaattgaacatgtatgtatagaaggagatttatgataagaaattgactcatgcaattacagaggctgagaagtctcacgatctgccatctggaagctggagacccaggagccagtggtgtaatttagtcagagtctgaaggcctgagaaacaggggcagtggtgtagatctcagtccaaggataggagagtactgatgtctcagctcaagcattcaggcagaagaaaaggggagaattcctcctttctttaccttttgttcttgtcaggccctccatggattgaatgaggcccagccacactgaagagggcagtctgcattatgagtcccctgtttcaaataataatctcactggaaacaccttcacagacacacccagaaatcatgttgagccacatagctgggcacctctgtcacccagtcaagttgacacataatattaaccatcgcagcttagagtaattttgacagatgaaatttgaggagtctcagatgggaaaagataacatgagagaaggcacaacgtggcagctttaaattctgactcacttgaaggtctggaacataacgcttttgtgagagcgaggtgtgagatgaagctggattgaggagttctgaccctaaaatgcagggccctgaaagtgaagccaaggcaggtagaaatttgttgatagcaggggagccaatgataagcatgagctcaggagcacaacttgagacttacagatcatgatgatgacctagatgattcttctttcatgaataattacattgagtttgctgatataagtaaccttctaacctgccttctttccaccagagcatatttgctgagcacattccactctggtcttccaagactgagcaggcaactcagcagcaggctcctgccagctacagaggttttcttgcttcctgaaaatgtatatcagaatcatccacaatgtttatttggaataccactgtgtgcttggaactgggtaggggtatcgtaggggagcatcaatatgtcaggtaattcctgccttataatcaatctaaagctggcaagatcctttagatttttgctaaagctggcaagttcagtgaagactctctagtgtaagtactggtttcatttcacagtggcaaacaaaaggcaaagggaatctatgtgtgaaatagtggcttcctccccaagtaccagccagtgcccttccaatgactttgctaggcatgactccagtcaaacccagagggacatttgattttgatttctatgaagtctaaagaccactgctatgatgtgaaccctggacccaatacagcagcaggaaaggcagctgggtgatgatgcctgggtgtgattaggtgggcagcttctagacaggttcccttcccacctgggaaaggaagagagtggggtattgctgcctccttttgtgacacagaacatccgtggaagggcagatgcactggtttcattatcaagtctgtctcttctttactgtgatcatggaaagcatgcttcttctgtgttgccatattcctgatcaatctaaccctagtgacagattgtattagtctgttttcacactgctaataaagacatacctgagactaggtaattataaagaaaaataggtttaatggactcacagttccacatggctggggagccctcacaatcatggcaggaggcagagaaggagcaaaggcacgtcttacatggtgacaggcaagagagtgtgcaggggaactcccctttataaaaccataggatctcacgagactcactgtcaagagaacagcacgggaaaaccccgcccccatgactcaattacctcccaccaggaccctcccatggcactacaagtcaaaatgaggtttgggtggggacacagccaaaccatataatagatccaaattttagcttcttcatggtatctatatggagcatcagatatagatgctgcatatagagatgaacagggtgaatgggtgagcagatgcatccactgatgatgctcaagctttgttgtaatcatttttagccacatatcatccagcatttatcaaaactgccattttctgaaaggacacttaaaatttattttaatttccctgcctcagtttacctatcaggaagcagactgttggaagcagtaggtgatggaagtagagaaaaagaaggcttagaagtccgtgttgttctgcctcatagtaaatgatcatggtattaattcattttaagtagcaatcctgcttaaaagtcacagctgcgagagaagcagcctttccttttgtcttttgccccaaggcatttgtgcgaggtgcctctggattaactgcatttctccattggctgagttgcaggaatcaaatgcctctttgagagaagggcttttgttcacaatgctgaatgcttggtatagctatactaagcataaaggttcagtaggaattttatctttctctatttggcagaaaatagtgattaccagcagacacttaggctgtctaaaaacaagccagtttgtttaaagagctgcaggtcatcctttctccttctacttctggcttgggtgaaagctgcttttctgaagggggcctcttgagccgaggcgttctgaagggcagcaatgatgaaaaccttatgaatgactgtggctggagagccttgtgcactaaatgccattagcactcagctaggctgtgcattctcattgccctttgttcagaacggtcccctctgcagggagaacagaactgccacagttaaggctgtgacctttccagtcacttacctccttagggatgccagatcatcccagtgagatcatttattatgctttacactatattttatgcatcatgacagtcttgtgaccacaaagacacagtggctcactttactttggaaaacattctctgatgcagctaagtttcaagcttatgatccaaaactagggacaaataagaacatggaagaaaggtggaccctgggagtcccctgaaacccacacccaaaaggaagtttaagatgatcttggcatctgtcactttgatttccttcaatttccttcatctcagaagggcaaagcttagacaaaaccttgtctcaaaattatccgttcattttcatttttagataactgatactaaagctacttccttatgcaggacagagcagttggatatttttgaaagatatttctcattataactgtaattaagggtggggtttttcatgtgcatgcagtttcagaactttcttggcagtcgtttttccttggcttatcgcagctacacagaagacaggtttgtagctttgcattcccgcaacagtcatgtcactttcagactaagaatcctttgatctttactgaatggatatttattatatctcaaacgatgatacctaccttttttgttctatttttcttgcgattccttgccttccaaatcagagtttaaaatccaaagataaggaacaaatacaatgtgttctctttgaagttggaggcaggtcttgctcgtctttgtactgtctgaacacagggccttgaccttgctttgtaggcatttgtggcactatggatttgatgtgtgggcccagctacaccatctaaaccagctggagaatttctctccatgaatgggacagtcttttattaagtgtggactagtatttcccaacccaccctcattcccgtaaagtgtcagtggatcttctgtgaaaaaagagttcagtgagcaaatagaattacaaaatattgcatattataccaccttgaaggcccaccatgtatactggcaagttcaagcctctttgaagttcaacagaaaataactctgtttaactttgacccagaatcgtctaaatgttaggcagagacacatttttatacgtgcggtttttatggagttcgttgctttgggtttattgctctaatgctagtttactcttcgttttcaaaggtatagatcttggaagtctcatagcagagattattatagccttgagacagcatgatatatagaactaacttttttttttttttttttgagacagagtctcactctgtcattcaggctggaatgcagtggcacgatctcggctcactgcaacatctgcctcccagagaaccaagttctttggagactcagggaagctgcagtgtacttggcccaagacctcggcctcctaacaagctcccctaatgagcagagctatgtgcctggatgttggcatgtgcccaccgcctcttcctgtctccttttctccctctttctcactgtcaaaggagagcagagcatttgaactggtgttgtcttaaagtatgaggaataggcaaggttctcatggccagccagggatctgaacctcttctgaaacccagggattgatcaaatagggtacattttgcctggaggagaaacttaacatggaggtaaactccatgagtaggtcaaataagcttcttggtttggggaactagacagccttgatgattttctctaatgcactaagacttgaaagataccacaagctcaattctgtaagaaggttttgtatttatttacagggaaagaagacccaactgtagcaccaccttgaacatgatataagaataatcatagccaccactgattacttgcagcatgccagatcgtgtactatgtgttttacataaaggaactcatttaacccttaactgtgaggccaggcgtggtggctcacgcctataatctcagcactttgggaggccaaggcaggtggatcacctgaggttaggagttcgacgagaccagcctagccaacatggtgaaaccctgtctttactaaaaatacaaaaattagcccagcctggtggcgggcacctgtagtcccagctacttgggcagctgaggcaggagaatcgcttgaatctaggaggcggaggttgcagtaagccaagatggcgccactgcactccagcctaggggacagagcgagactccatttcaaaaaccactgtgagaaagataatatgctcaattttcagttgaggaaactaaagctcagagatgctgggtaactgccgcagagtcataaaggttgggctaaaaacctcactccgactgactccaaaaccagggcttttcagaacccccctactcgttcccaggcgcccctggctttcttcataatacagtctcattcaaattccacagtgtggcctctccgtagaaagaaggaagaacaggacgtgttttgcagagttagatgtgagagttttgtgttgatgcctgtgaatttgaaacccctttgaacgagtcacctttgttgttgtcatgagacagaaacttttatctcattgaggttatagaacaggccagagtcttaaatacagttacgagttatagggttgtgaattcttttttttttttttcagacagagtctcgctctgtcacccaggctggagtgcagtggtgcggtctccactcactgcaagttccgccttccaggttcacgccattctcctgcctcagcctcccgagtactgggactacaggcgcccgccaccacgcccggctaattttctgtatttttagtagagacagggtttcaccgtgttagccaggatggtcttgatctcctgacctcgtgatccacccgcctcggcctcccaaagtgctgggattacaggcgtaagccaccactcctggacgggttgtgaattcttataaagtagttggggatatttaagtcctttgatcattgaaaacaagtaccaccgcagttgccctgcctaactctaatgccacacataggataaaaaacaaattgactttccaaagatgtgttattacttttctgactgtcaagatacactgtgtcttatcttacatgtaagtaaagttgcaatcaagtgccatattataaatctgattttattaccaggaaatgctttcagatgtttaagtccttgaggctatgaacctggtgttggtgaaaaatgaaaactcactcaatgaaaaatatgcagttggcccgtggcatacaccccatgaccagaccacctcatgtcagagaaatgtccccaacttatgtgatctgtaccctgacagcaccagagataatacacatggggtagcgcctgtgtgcatctgattttagtggatttctctgacaacttgaaaaatcagacttaaatacttggggatatgaattggggcacaccgttctttacatacttggcaccaaaacagtatggataaattacatccattttaaaaaaacatgaatcattttaaaactatatttaagtttaccatttaaggatatccttagagaaaattgttaaacctcttttaaaatatatgtcatatatctttctaatcactatggcaacatttattataattccacccctaaaatgtgataacccttgaccatctccaaaatgtgtgactgataaacactggccagcatctttgtcatattttgatattcagaatgatggcaacggctatgatgctggccatcatcgaacggtgggtgcatttgctctgggccaggcactgttacacatttgttaactcacttaggagaataagaagtggaaattcaaaaagtaacctttctggggtttcctactgagtcataggccctaagtgagtagacacaggttaagtatcccttatccaaagtgtctggggaccagaagtgtttcagattgtggattctttctgattttggaatatttgcattatatttaccagttgggcatcctaaatctcaacttatttacttagcatttcctttgtgtcatgtcagtgctcaaaaagttttggattttggaacatttcagatttcagattttgggatatgggatgctcaaactgtattatagcctacttgaatgtttatttccaaaagaataatttgtttttgttagggtttctattcttctattcatttaattctttcccaatcgtgtaattcctcttattttgagatgattctctcataagtgaggtatcatatttgagcctgcagccagaagcaggccagtgttccgcatcaggccgtgaggcttgtcctttggaggagctgtctaccgtgaagcagatgtgttagttatgtctcagcaatggcctgagtcaccaaacggctccatgaccgtgggggtttggtccatggagttactctacctgatgattttctgcctcgctcccaaattaaacacagaatgaccaactaactcataatcaaaactagtttgcagtaaatacaatgctctatttatgtttttttgttgcttgttttgaaacggagtctcaggctggagtgtggtggcgtgatcttggctcactgcatcctccgtgtcctgggttaacgcttttctcctgtctcagccacccgagtagctgggattacaggtgcatgccactacaccctgctaatttttgtacttttagtagagatggagttttgccatgttggcctggctggcctcgaactcctgacctcaggttatctgcccacctcagcctcccaaagtgctgggattacaggtgtgagccacctcgcccagcccaatgctgtatttctgaaaaaggtatcaccagaatattaaaaaaaaaggttaattattaatttgttcacttaattaacaaaaaaaagtctatggcaaatctcatagactcggagtccagtggggtagaaaaaccaacattcttaacggtcatattttccctttcatcccttgtctgggggtgtgatattacgatatactgtgtgtctggttgtgtgtgtacacacacaatatatatataatgtgtgtggaggggagctttccatcccggggtcctggcttattactcccatagcccttgttgtttcctaagggactaaaacaacaagcatatcttttgttgaagtattggccttttgtccttggtttctgaagtagcttcagagctttaacggtgaaagacggtctttcgctataatgtttgggcactttaggcctcagaaaacagaatctctcttgctgatcttctcctgccctcctttcatgtactcctctgtctccccaaggcagggctctaattttcccctgccctcatccataaagaaattctttgacctacctgatctgattagaagtcataagactcacatttcggaaggagtcctgtttccattccctggaggaaggagccacgcacagagaggccaagaagaatctgaacagataggtcttgttgggtttcctcgctcagtctaatagtactagatcatgccttttttgtccaatcacagttctacatggttgtcaatcacgcctatccaatggagcctccatgaaaggcccatgaggatggggttcagagagcttccaggtagtggaatacgtggaggtttccagagggtggtgcacccagggcgggcatgaaagctctgcaccccttcccatgtgccttgccctgtatagctcttcatctgtatcttctgcaatatccttaataataaaccagtgaccaggcatggtgggtcacgcctgtaatcccagcactttgggaggctgaggcaggtggatcgccaggtcaagagatcgagaccatcatggccaacatggtgaaaccccgtctctactgaaaatacaaaaattagcttggtgtggtggtgtgcacctgtagtcccagctactcaggaggctgaggaaggagaattgcttgaacctgggaggtggaggttgcagtgagctgagatagcgctactgcactccagcctgggtgacagagcaagactccgtctcaaaaaaaaaaaaaaaagaaagaaaaaagaaaaaaataataaaccagtgaatgtcttttcctaagttctgtgagccactctagcaaattaaacaaactcaaggagggggtcatggggtccctgatttatatagccagccagtcagaagtacaggtcaaacaacctggggcttgtgatttgtgcctgaaacttgggggactcttgggggctgagcccacaccctgtgggatctgacactatctccagatgatagtgttggaattgaactgggttggagaatgcccagctggtgtctgctgtggaattgactgattggtttttggtagggaaaaattctcatacacttcttggtgaccagaggtcacagaagccttctgtgttgactattgtggtgtgggagcagagaaaactgcttgtttttttctgcagggggcatttctgggccatgatgtccactgcctgtttaaatttagaaacagtctctggatggccaacccaggtgcccccttggtcatgaatgatggactgctctctccttaagggttgagatggttctatccttcaccattgctaggaaagtgactggcttgagagtgagtgaccaggaaataaagttaccaatagcactgcctttgctgttcattgatgacctgtgacatctgtgacctgtgacatctgtgacctgcatgacctgagatctctttctgtctctgcaatcaaatttccaaaattcagagataaagacatgttcctagaacttcatttcagctttcacaacccctataatttccatttgaaaagccagcccaaacacaaaattagtttcctacgccagagaacattatgattacagaggtttggaaaaggggaggaaggtgttgtataaacccttagttctggttattttttcccctttatttgaatgacagtgactttaaaataacatacaaataaaagtaaaaccagagttttgaaaattgagcaagttgtacatttgtcacactgaaagaaaaaaaaaagtgtcagtgccctcttccaggtagattttagtcaaaattctaataatttcaaggaacaggagcccactcgtgctggttcaagggcaggtggcaggtggacaatgtcaagggatagtgtgactggcgtattgtgctgtgggtggttctgaggatcgagggcttgaggagtcaggcttgctctgccgtccgggtgcatctgctacgtgctccctctcttccagaagcttctttaggaccactctaagtgccatgccctcatggccctagcttgccaatgccccccaaaacttgatgttacatcctgtccctacctgacttttggttccattggccatggcctgagtgacaaaggaatgctgtggaagtgtggcttctggcctcggacgtgggcgggatggcttccctcagaaggaactgtagatgcacctgcagtttgcccagacctcagtgttttcatttcctctcttcctctctgtctccagaaagagctcttggaggaagttggccagaatggcagccgagctcggatctctgttcaagtccacaatgctacgtgcacagtgaggattgcagccgtcaccagagggggagttgggcccttcagtgatccagtgaaaatatttatccctgcacacggtgagagctatacccagtaagggctgataggatgtgatggtccaggcagtgcacagattgccagaaagtaacctgggggatggatggctgattaaagaatgaaaaataaggctgggcttatctcaacacttcaggaggcaaaagcaggaggagtttgagaacaacctgggcaatgggcaacatagtgagaccctgtctctacaaaaaatatatgtatttttaaaatttgctgggcatggtggatcatgcctgttgtcccagctacttgggaggctgaggtgggagaagtgcttgaacccaggaggcagagattgcagtgagttatgatcacaccactgtactctagctaggtaacagagtgagaccctgtctcaaaaaaagaaaaaaaaaaaaaagaagggaaaaataagaatcaaaaataatttttccaatgataaagatatgatatgataacatgctttacagaactgctgatacccataggtccctcctatagttactattaatggtaataacttacttggaagattagtcttttcagatgccaactttggctttacttattgaacttagttgcaatgatgtatactgtacatgactgaattttagacaggcaatatagctaacccttagctgtctacaattgggacagtttatttgctgttgcttgttttgctgtgtttgaaatagtactgctttgccatgtttttacccattcaagccttgggtaacatgctttgtgctttggtctgcacggaacatgaaatatttcctatggaagccatcctcagactgccctgggcccacggagctaaatgcccagccatgcgtgttggcttttgcatgttgctggaatgtcctttggcacggtgccactgtggtaccccaagtgaaccaagtgctgtgctcactccataacccaatggagccacctttgtttgactctcacctgccctaggttgtttaatgttaaacggctgtcataaagtccatgcataggcatctagatcagtgtgcttatacattaagtttttgccaaacatgacctttgtacccaatagcagacagaacttgtgagcaaatgattgagttcccacctgtctgttcccagtgacactgaaacttgctctcccttttggtgctgaaatggaaccatattacgttcttgcagcacataggcacagtttctgggaaacattagtaactggtgatggggaggcaagatgtgtctacctggtagaaattcaatgaccctgagattctggctggacgcagtgactcacgcctgtaattccaacactttgggaggccaaggcaggcagatcacttgaactcaggagttcaagaccagcctagccaacatggtgaaaccccatctctatctaaaataacgacaacaacaaaaattagcagggtgtggtggcatgcgcctgtggtcccagctacttgggaggatagcttgagcccaggaggtggaggttgcagtgagccaagatcacaccattgtactcctggctgggtgacagagtgagacccccatctccaaaacaaaacaaaacaaaacaagaacaaagacaatgagattctgattctaaagggacagcttaaaaaaattggagtttaggctgggcgcagtggctcatgcctataatcccggcactttcggaggccgaggcagttggatcacttgaggtcaggagtcccagaccaacctggccaacgtggggaagccatgtttgctatgcaggcagtccttaccttgcagggctccagtatgcacaaatttcaattaccacagttaaataacacccattccccaaaaatatagttccaattttagttaccattctatattaaccataatggcataaagcataaactcgggctgctggctcttcaggccaccaaccatcgtagaaataacagatgcacatcctatcatgaccaacggcatcatttctttcaaaggctgttgtgatcggtcactgcgcccttgtcattctttttgtgcccaccttgcggagacatgtggctgtgttgcctccttgtctcccagggacaaacccacatgacattttacaaaaatgggtaattgaaagagggagttggtgaacaaaggtaaaagtgcagtaaagaaatgcaaagtgatagtgttcaacgtaaaatttgaattgaatgcaagactgtgggaagttgataactgcccctgctgatgtgaaccagcggtccttagtgaaggtgaacttatgcacatacatcaagaggttgtgacaaaaaggttgaaaatgtcccagagaaagcgacactgtcaaaaaacagcattgaaggaatactgggagatattttacaacattgaaagaacaaaagctaaaacattagcagtcgatccaaacttagaaaggaatgtgacaattcttcaaaacagagaaactatattttctctgtatcataagttacatgactagaaggcaaactatttaacctactctcgatcgtttttttacaaagaaatgacactttaatttttcatgtttctaacattttaaactacagtagaagtaaatattagttgtaattttgttattttcttgtacgtgtataatgacatgagttttctcattgattttaaaattactatttttaattaataattgaaaaattgtatatacctgtggagtacagtgtgacattttgatctatgtatatgttatggaatgagtaaatcaagctagtttcccatcagttattaagatctcttcgcatggtctcagcttacacaaagtgagacctgcctatatttgtagattataaaagatttaactgagttctgaaagctttgactatttgttcttccctgttacaagccagtgtttctcatatatttcaaacccatgactggtctattggtatctcaccaggttgggtagattatgccccctcttcaactccggcgcctggcaacgcagatcctgtgctcatcatctttggctgcttttgtggatttattttgattgggttgattttatacatctccttggccatcagaaaaagagtccaggagacaaagtttgggtaagtctcccagctaaaaatgtttgcccactggtattgacaaggttgttataccaagtgattatgcctttcctgttgggccagctgcttacattgctcccagatggctgccctgccttatgcataccctgggctcaggcagcttcctgacttacgccatggtctacagaagcagctgccagcaaaagccaggcctgaaaagggttcctttacagagaagagtatcagtaggcctttgctactcaaactggattgctgttaagtgaggacttttattagaagccttaaaaataggccgagtgcggtggctcacacctgtaatcccagcactttgggaggccaaggcaggcggatcacttgaggtcaggagtttgagaccagcctggccaccatggcaaaatgtcatctctacagaaaatacaaaaattagctgggcatgatggcacacgcctgtaatcccagctactttagaggctgaggcacaggaattgcttgaacccaggagggttgttggcaggttggagtgggacagaatgagtgaggggtgtatggctatactttggagggggctgagcctccctctttcattgctccaccttcagaatgctactagaacatcccactcgctccaagacttgccataggcgtgggaagggcttaagattggcagccaggctacgctttatttgtgttcatcccagtcttaggggtcagttactttagtctttataagcctattcttacaattgttataccttagtatgtgaattctaagaatgactattttaaagaagtggacaaaatctgatctaaatcttgaacatataattgactaaaatacatcccaggatcttggtgtgacatgtgggttcatcataaaacaagtacagagaacctctgcagaagctgcaagagtagctcattaatatgtattaaaggcctgctaggcactgggcactgcggtagcctggaatacagtggtgaacaaaatcctgccctcatggggttcacagttcatggggagtcaggcagtagtcaagcagtcacaaaatagattaaaaatggcaactgtaatacattctatataaaggggtaagaatgtgtcagaaaaatttggctgcattaagaaagtcagggaaggcctttgtgcagaagtggctgacaccagagctaagatctgaagaaagagcaggtattcattagatgagagagaagaagagcattacagccagaaggagcagcacatgccacattaccaaaaagtggggctgctgagtacagcaaatatattaacaagattacaatactatttcaaatatttagaaataaaactatttccaggaaccattaaactcagcagaagcttaaaacaaatgaaagacttgtaacaggttattgttatctatgtcgaagtcagttcccatggatccttactacaagatctattcatttgttccttttgtaaaaccactttccagctcatttttaaatgaaaatacttttatttttacttataaaagtaacattatatttttttaaaaatcagattatatcgaatagtcaaaaggagaaagtgaggcccatttcaggcccatagatggtgttggttgctattttggcatacgtctttccaagtgctttgctttgtgtacatcagtatttttttcaaaattgtgttatctctttaaaataatctatgtacctaaggtaacttgagattaaatctgtaatctagactttcaaattcataatactttcccaccaattagtctaaaacagtgactaaatggattattaaaatagacttcattttttatttttaaaattaatttatttttttgagacaggatcttgctctgtcgtccaggctggagtgcagtggtgcattcatggctcactgcagccttgtcctccagaacccaagtgatcctcccatctcagcctcccgattagctgggaccacagtcacataccaccatgtctggctaattttcttactttttatagagatgaggcatctcactttgtttccctcgctggtcttgaactcctgggctcaagtgatcctcctgcctcagcttcccaaagtgctgggattacaggcatgaatcccagccttattttttagaacagttttaattttacagaaacattgagaagatagtacagagatttctcatatgctccatacctagtttcccctattattaacagcttacattattagtgtcacacgtgtccatgtgaagagaccaccaacaggttttgtgtgagcagtaaagctttttaatcacccgggtgcaggtgggctgagtccgaaaaaggagtcagcaaaggatggtggaattatcattagttcttacaggtttggtataggcagtggagttatccaatatccaatatccactggaggaccaattttttgtaagcagggggtggatcttgcaaagtacattctcaagggcccgggagaatattacaaagtaccttctcaagggtagggagggtgtatcatacaaagtacattcgcaagggtgggggaataccacaaagtacattatcccaagggcagggagggtgtattgtcacaaagtcaattgatcagttagggtggggcaggaacaaatcacaatggtggaatgtcatcaggtaaggcaggaactggctattttcacttcttttgtggatcttcggttgcttcaggccatctgggtgtatacgtgcaggtcacaggggatatgatggcttagcttgggctcagggtcctgacaattagtacaatacatttgttacagttaatgagccaatattgatccattgtcattaactaacatctctactttcttgagatttccttaattttcacctaatgtccctttagtgttctgggatcccttccaggatgccacattttacagtcagtcatcacatctccttaggctcctcttggctgtggccatttcttagaccttccttgtctttgatgatcttgccagttttcagaagtgttagtcgggtgttttgtaggatgcccctctattgcaatgtgttcgatgttttgctgataatgagcaggggttatgggtgattgagaggaggagcacagaattaaaatgccattgtcatcacttcttatcaagggtgcatattaacatgatgtatcactgttgatgttgacattgatcacctggctgaagtagtatttgctgggtttctctaccatgaagttattttttctccctttccctactgttctttggaagcaagtcactatgcatagcccatattgacagcatgagggtttaactccctccaccccttactagctacataaaatatttggaattcttcaccacaggagattggtgtcttttcttccattcattcattcaatcatattttcataagtatagacttatggatattcattttatactcatagtctagtattactttagtttcttgctcagactgttacagctttggccactgggagcttatctgttattctctgttcttggcggtacctggctagagtagtttcaatattgccaagtaagtctaaaataaatcaaaggaaagaaacacgtttcttctagggggaaagcttttgttgtagaagagcccattgaaaagcggaagctctgtagcatccttgtggaatcagtgcctgccccagtagccctgtttttatagtgaagtatctttgttttcattcacccaggaatgcattcacagaggaggattctgaattagtggtgaattatatagcaaagaaatccttctgtcggcgagccattgaacttacctgtaagttgactttcatttccctttttggcaaaagttaaaatagttgagaacaaagaaggatcaatagacagatttctaacaaaagccaaagatgtcgaagaagaatggatatttttaatgtacaaaatgtctttaaaagcagcaagtagatagccagacattgccatgcacagctctgtgggctaatttactgcaatcaggagcttgacctggggttaaaaggactcacaatgtcatgaaatgtggcagaaaagaggaaccttctagggtgacagaagatgggtagaggccagggatttaaagaaaacttctaactagtgaacataatctcaagcctcatttcctgttttcctggcaaccaactccgaggatgatttgccaacatgctttatagtaattatggtttgagctttgctgaatcagagagtgggggcttctggtttaaacagcggaaataaacagacactagtgttcctgaataatttcagaaaaagtatagaaaggacatgcaaatattaacaaattcatgcttctggatgtttgcccccaataaagaaaatagataagaatgacagaatacaggttgctatgaaatagaaacttgcttggtgtagaatattattaatttctttacctttctagtctgtaagttttgacttttagatatcctcaattttttttttaatttaaaattttaaaatttgtcatttagaccactttctttcctttattggagaaccactggataaagctttttctctgagaactaatgtgtcctaattatccacatttttttgatctttcaagagcttgttcatgccttaactgtggtccagactgaatcatttgccaagagttgttgaactggtccccttctggttaatttctcttgttgccaacatgactcatctattatataccttactatattatatattttattatagaaaaatctttttctccaattcctcaaagtgctcaatttagcccttgctatgctgttataataggtttcatatacagtatgtaaaataagagcttattctctagatgtttcctgtggtttgtgagactccgtccatggcatgggagggtaggggacgtgtggttcttttgtatactgtagtcaagggtataatattaatagtaaagaattcaccagaaattacctattgacttatcttccttacccctttaagtcaaaggcaaaccacccctacatgaatctgattaccggctgctgctaccacacaacagaatgagaaatgtggttctgatttttgtaattcttcagaattaaccttgccctgaaggattcattatacttagtttaatcattctaaagtatgaaattttattactggcatttttgggagagaaataatagatacaaaatgaaaaaaggggccggctatggtggttcacacctgtaatcccagcactttgggaggccgaggtgggtagatcacttgaggtcaggagttcgagaccagcctggcccagatgataaaacccgtctctactgaaaatacataaattagctgggtgtggtggtgcatgcctgcagtcccagctacttgggaggctgaggcacaagaatcgcttgaacccaggaggcagaggttgcagtgagccaaggttgcaccattgcactccagcctgggcaacagagctagactctggctcaataaataaataaataaataaggaatgttttattatacaggactttatttcattttaattatcaagtgaaagaaaacacgctgacaatttttgtacatactatgttactcctttttcagtacatagcttgggagtcagtgaggaactacaaaataaactagaagatgttgtgattgacaggaatcttctaattcttggaaaaattctgggtgaaggtaagcaatttaaagtaattcttttaaaatgtgggataagaaggtagcagtttagaataattctttaacatatatttattaaataaaatagcatctcaggactctgagttatactatggatagttatattttattatttaaaatgatagactattgatttttgaaactcagatctggcacatgaaaagattctcttcaatgcctagcacatacaggtccttgaaaaatattaattttctttcttcattgaaaagcatgtaattcattgagtagtttcctatgtactttaagtttattcctctagttcttaagttcattgttcttggcacctttctaattaggaacaaaaatgaaaatacgtatttaacttgttaagttgttcttaggatgaatgataatggtattaaaagtttgtgctttaaaaacttcaataatatttttcatgttctcttctaagtgtcttggattggttataatgcttaataaagtgatgagcaaaggtaggcccaagccacccaagctcgtgacaagcaggagactagagcgtggcgcatcaccctggtttgcgatgtgggtggcctgggcaggctctgcctggctgcccgtgggtgagttgctctcataccacatgaaaccagcagctctggcactgtagcatttctgtggtcagggaagagtttgcacagtgtccatacaggtgttctttcacttcacaggagagtttgggtctgtaatggaaggaaatcttaagcaggaagatgggacctctctgaaagtggcagtgaagaccatgaagtgtgagttatcagtgatgaatcccattcttctagggtgggcagttgcttcagtattgggtgctccatgaggccatatgtcacaatctcagttcccagtgggccagaaggcaatgtggaacactggtcaccaagggggacttactttaatgagctcttcatgcatgcattacatattctttatactcaaggcaataacattttttatttttactaactcctgcatgcctatgcatacatactgtctgtcttgctctctctccttctctcactgtctctctttctctcactctcatctagtagagctaacaactccaaagtagagcatcaattgctgaggcaggggtgatctaatagcaacatctgaccccaggggttgttctggccggcctgtctagtgtggtggggccacttcctcatttgaggatgattgcatggccctgaggaagctgcgggctgcctggcaagtaagttccccagaaagaggagaaatatttggtcaaggcatatgaagagttgctatcataagctagaacttccaagcaagctgggaagagagccagcagtgagacagggagagtcttgtaagtcacagccaagaacctgctttatcctgcaaggagtagagcgctattaagaggcttaaccagccgggcacggtggctcacgcctggaatcccagcactttgggaggctgaggcgggcagatcacaaggtcaggagtttgagaccagcctgaccaacttggtgaaaccccgtctccactaaaaatacaaaaattagccgggcgtggtgacacacacctgtaatcccaggtgactgaggcaggagaatcacttgaactcgggaggcggaagttgcattgagccgagatcacaccactgcattccagcctgggtgacagagtgagactccgtctcaaaaaaaaaaagagtcttagccaaatgaagaatagagcaggttaaattccagaaagttcactttgatgtcagtgtggaggagaacaaattacagtgttgacaaaaatagtggtagatgccagttaggacactgtaaaatctatgcagtctaggccctctcaaatactttcttttttttttaattgagatggagtctcactgtgtcacacaggctggcgtgcagtggcgccatcttggctcactgcagcctgcacctcctgggttcaggtgattctcccgcctcagtctcctgagtagctgggattacaggcacccaccaacacgcctggctaaatttttgaatttttagtagagaagatggggtttctccatgttggccaggctggtttcgaactcctaacctcaagtgatccacctgccttggcctcccaaagttctgggattacaggcatgagccacttcacccagcttaaaatctatatagttaaggaaactatagtgacttgctgacttgtctaattgaaatagctagaaagggggcaggttgtgctgggcttcttcattaccataagatgaccagatttcactggcagagcaaggcagcatttcctctccatgtccttcttccaggaagtgcatttctggagctggggccacacagctgtataagtttgattctataggtgtctggctgggcatggcctatcactggggaacttagaaaataggtcgtggtcacgtggcatttcacccagtcttcatcatgaatcatggatggagattatttggtgctcagtttgtcaatattcttgatgttgcttccttattaaccccttgtacctattcaatactatttttgatcagggaataaagtaaaattggattcttcctaaaatttaaatccactatttactggacattaaagcataagttagattgtaagcatgtactgagactcttaaatgaaaaggctgaagtttatttatttttttctttttgagacagagtattgctctgtcgcccaggctggagtgcagtggcatgaactcggctcactgcaacctctgcctctgggttcgagcaattcttctgcctcagcctcctgagtagctgggattacaggcatgcaccaccatgcctggctaatttttgtatttttttctagagatggggtttcaccatgttggccaggctggtcttgaactcttggcctcaagtaatccgcccaccttggcctcccaaagtgctgggattacagccgtgagctaccacgcctggcctggaggctgaagcttaattcagctataaaaaggaaccacaataaccaacaagtcacatgaaccggtactttttaagtagaccataatgactaatatttatgtaatactcactgttagccaaaggacattgcagttattcctgtatttcatcaggacaacaggaagagaaaatgaacataactaaaaaggaggttcaggaactagcccccagaaactaaaacaccctgaagttagaatactcactggagctgaaccaagcactgagccatattctgcactgttcctgcctcttgtatgattttatctgagcctcacagtgcatctgtggggagtccttccataattcctattagggatataaggcaggtatattaggaggcctggtgggaggagctgggcctggaacccactttttctctggcttgactctgcagttatttaatttcattagggtaaattgcatagggattacacccctgctaattgtcaaagattgagagtataatctctagcttcaaaatccccaggctcagctacatttacctgcaggttggacccctggggaatagtctgcaggcagagccctacccctgtattcccccacctggttgtttgcagcaaaaggaataggtgagggcaaatttttgcagatgtatagattttcttttaattagaaaaatttttaaatttttctaaatttccttcagtagaaagaagattaatatatattaagccaataggatggtatagacactgcattagatgccctcatgcatgattttaatcagtagttttaccctgttaacgcaaattccctaaggcaagccagactttttatttgtttttaattgtggcaacatatacataatataaaatttaccattttaaccattttaagtgtacaattcagtggtattaagaaccatattcataatgttatacaaccatcactaccatccatctccaaaacttttcttttctttttttctttgagacggagtctcgctctgttgcccaggctggagtgcggtagcacgatctcagctcactgcaaactccgcctcccggattcaggccattctcttgcctcagcctcacaagtagctggaactacaggcgcccgccaccacgcccgcctaattttttgtatttttagtagagacaggatttcaccttgttagccaggatggtctcgatctcctgacctcgtgatccacccacctcagcctcccaaagtgctgggattacaggcgtgagccactgcgcccagccccaagacttttcatcttgcaaaactgaacctctacacctaccgaacaatgactccccactaccctttctccccagccctggcaagcactattctattttctgtctctgattttgactctctaggtacttcatgtaagtggaatcatagagtattcatccttttgtgacaggcttgtttcacttagcataatacagaattttaaatgtctctctcttaagccagtttaattcaaaaaatttggtatgaaaatgcatccaactcacaaggcgtggttgagcaaccagacttgcaggacatacaacaatagaaacagagaggtgtggggttctttctttttttaaaaaaagcaaatataattgcaacagatcagttagaattgttctttgttttggtgttggggttttttttttggaattttttttctttaccattagactttaactttgtagagcagtttcaggtttgcagaaaaattgggcagaaagtacagagaatgcccataggtcccctcctgacacacataatttctcctattattaatgtcttttattagtgagctgcattttttgcaattgatgaacccatactgatacattattattaaccagagtccatattttacattagggttcactcttggtgttatacagctctgtgggttttgacaaatgtgtagtgtcatgcatccatcattatagtatcatacagaattatttcttggccccaaaagtcccctgtgctttgcctgtttgcccctctcttatctcccctagccctactagcccctgacaaccactcatctgtttcctgtctctatactttcatctcttcctgacctgggttttagagaacagaactgctgttgcccacccactccccttaattgagtaaattatccatacttaaccttttctattttctcctctagtggacaactcttcacagcgggagatcgaggagtttctcagtgaggcagcgtgcatgaaagacttcagccacccaaatgtcattcgacttctaggtacttccgagaaatgcaggagtgggtggccaagagggctctgctgatctgctctgtgccaaaggaaaaaatctctggtgtagataagtttacacttcgtataaccccaacataacttataacattgaggttttcacccagacttttcttcataatgatgttttctgaggctaatagtaataatgagtttgcattttctggacgctgataggctcaggaatgatttgagttttccacagaattctaggagagtgtgaattaaattgtcctcagttactcaaaggcaagacacagaggtggttgtgttataatttttattaatttaaggttatgcatgagttagatagcagtgggataaaggtgaaaaagtaggcaaattccgtaggtttatctttgagaaataatttattaacctgtttgaaagtactgatttcttaagatcatgatacattgatgatttcatggaatatgatttaacagttccatagaacatgatttaacgtaatttggctttgcagctccattagccaaaaattacaaaagaggagattaagtatggagtggatgctgtgtaagtggctctgtcccaagagagaagagtaacctggaaataattgaattttctgctgaccttggtgttttgtttttgctttgccatcctgtgactgcatacatgctaagttcttttgggatctttcaaagtttcatatgattggcactgcagagagatgtgaaaatcaatgtttgtatacagtattatgtcaaataagctactgttattcattcactgctattggcttcagccgactatgagaacaattgcactttgtgatcacaccacagagtgcaggagctttgcaagcatgggatcaggtgatagcctctggctctcagattccatgataaatgatattatagcttctcttttgcaaaactgttaaaatttagggatgtgaattttacctatagcccttcaaagttattgtaatagtttaagcatttgcagtggacttcttcacgtgattaaatatctatcacatgaaactagttcgccctagttcaatactagttcagtattgactttgagggttgtagcgttaaggaatcatagccactggggacattgtgtctttcatttcctaggcctccttatctgaaacaaaaatcttatggggtcactacccctcagactcagtggaacagaaattcctaggtttctagatggctatacttgttacagtttaatttgtgacagccctcatgccctcattaatctgaaagggggaaaaataccagtagtggaccctgtgtgtgttccattttctagaacagagtgtgagttaggcgctcttgattttttcaaactgttaacttggtaacacacggcttcagtttttccagtggtccacgagggcttttctggtcacagtaacaaggactctttgtaattgatgctgtgtttgtaatttcaggtgtgtgtatagaaatgagctctcaaggcatcccaaagcccatggtaattttacccttcatgaaatacggggacctgcatacttacttactttattcccgattggagacaggaccaaaggtaatgatctccttgtgttacccctgaacacttctcagggcttatgtgacttagccaggacaaccaaatcatctaatcttgaaagtgaagccaggaaggagaggacgttgacttttgttcagtgctccctgtgtgtccagggttgaaatgtggggtctatcctcacagcaggcctgctccaggtattattatcctgctttatggtgggtaagtggctgcgtgcacagtcttatggacaaagccttaccaacttgagttgggtggcccaggctcctggttctgcacttcacaaccctcatggccgcatactccccagagcttgcagactatgggaaggccattgaaggtggctctcctaaaagaaattttacagagctcattctggatttcaacctttgaagaagtgttggtgaccaagaagactgcacaactgacattctgaaaactgtttgtaacattttactccctatgttgacttacccaccatgagcactgtgaagccctgggaatgttggatgtagctgtagaggcagttacggatcatctaggaaatttaggaccatggagacgcttgcctttcttcagggtcaattttcagtattgactttgagggctgtagcgttaaggaatcatagccactggggacattgtatctttcatttcctaggcctccttatctgaaacaaaaacagtatcctcctgttatgttttgtggacaaacggtagactgcgagcaggcggtgtgtgtcctgactacatgcccagctaagcaggacgccccttcctgccttgcacgcatcttctctgttgcaaaaggcagcgatcctgcggggttctggttgggacacatgtgggaacagggtgtggctggcctctgtcaacagtcattctctgactgggcaaaaggcaaaagtcactccagatcatcactgcccttaatcacagctgtaagaaaccacaggtcctgggaaggaaccgaaccacccagtctacaccttggcattctcggacacaccccacctttgtccctttagctgccatcagtatgaggaccgctgagtgcagtggtgcaattaggaacaactgcttccttcactgcatcagcgatggctccaggaaagaattcttgctgctcttgcttgatggtctgatgagtccacaggatgaaagtgcaaggaaattagttcttagggaccatgaaaactcactcccactggctctgcagacaaaacacaggggaaaatgtcccatgcagcaccagtgtggtggagttctgcacactcccctgtatctacaaacctggggtgacagtggcctagggtcagccaggtcgcttttccaagtgaagcagtgccatgggactcactcacaaactattaaccaaaggaagtttattaagttctgcccaggtgcggtggctcatgcctgtaatcccagcacattgggaggctgaggcgggggaatcacttgaggtcagttcgagaccagcctgaccaacatggtgaaaccccatctctcatgaaaaaatacaaaaattagccaggtgtggtggcaggcaccagtaatcccagctacttgggaggctgaagcaggagaatcatttgaactaggaaggctgaggttgcagtgagccaagatcacgccactgcaatccagcctgggcgacagagtgagactccatctgaaaaaaataaaaaaaacaaggtttattaagttcattagttcactctgtgaacaagtgctgactctaaggtgggcactgagctctggggacactggagggaacatgacagatgtggttcctgccccatggagctgagctgctggtggtgagtgagaggagaacaggagacagacaattggttattcacagtgagggagctatgggcaccaggagcacaggggctcaaatgcccagtgggccaggcagagcccagtgggggcataggggcaggaagtgtgcaaggtaactagactggggggtgtggtgtctgcgcacagatgcagaacctcatggtggcagggccaggacttcttcgtttcagtaacctggagaatgttggcagatagatcagaggtggtgattggaatatgaagccccatatgctgtggggtctgctgtttagaaggagggattgtgcagagaaatgtgcattcccttccccccgccccccacatcagtcactgagcatcctcatgtcagggaagccacacacagaaatgtgcattcacttcccccccacccccacacccagtcattgagcatcttcatgtcagggaagccacattccttctaaaagatgtttgggccccatgtgctgtcagagaagcttcttgtttttggagtcccctcttcttggcttgttcattataacatctctggatgcagggtgcctttcagttccccggtggaggctgcatggagttgctttctagttgttcactgagggtgaacatgctccctccattcatcttctctttgtcatgagcgtatccatcctcaggatcagaagatgtgttgggaattggtaggccagcttgcttgcctcagcagtgcccctaagaggggcagcaacccctgccctgaatccttccagcatggagaaactagagagaagcggaacctcagactgaagtgccccgacctccggtaacttatgaacttaataaccacaagtcacaggtgactgatagagttacagtgaaccatgatgacaagaatgacaactgagggccttcatgggggaagtcggcttagaaaaacactagtcctcatcccaagagacaggtccatctgtagaaacagccctttatttaaaatttgggaaagctgaaacaaataggcaaaaatgtgagacccaatttagggtcagcacatgctggagcctccttttccacttccagctgacgttgttggtatcttacgcctgtgtgtgatggaggggagggtacttttgctttgctttttttcccccttttactctttctcttcttcctagggacagcttaagtgatcaggacaggagagtggccccctttcttttttccagttcccccctggccccatgcccacatgtactcctgttctcttccatgagaatgcacttgtctttcaccaacatgagtactaaccgtagagacaggaggctgcagctgcatcacacagctgttataaaatcaccgagactcttccaaagaggtgaggggcctagtcctacacagaaaatataatagacagggctgagtattttccttctctttttcccccaaaaagaaagatgattgcattataggaagtctgtaaaaggataaaaaattacccacaattcccaacaccttagtacaattgttggcgatttcagacattcatctctcattgttcactcaatgcctacatttctcatggccttcacgtcactacatacacacttgcccctgggatgacagtggctaacctttctcaagcatgtagcataggccagcctgtattttgtatgtattaatgcaccagtggcacaacagccctaaaaagtagttactagtggaatctaagctgaggaaactgaggcacagggggccatggtgaaagcaggattggcccccaggctgcagactgtgagccttcaatgctcttctgactgccccattctgtgtgcacccctctccagcagggcagcccccacacagatccctgtgagtggcggcaccacatcatttcagtgggttttgtttcatgttgatgggtgattttactcacatttaatttatggtacgttgtataatttgggaggggggtggtggcggggggatggaatttcactcttgttgtccaggctggagtgccatggctcaatctcggctcaccacagcctccgcctcccgggttcaagtgattctcctgcctcagcttcctgagtagctgggattacaggcatgcgctatcatgcctggcttattttttttttttttttttgagacagagtctcgctctgtcgcccaggctggagtgcagtggcgtgatctcagctcactgcaagctccacctcctgggttcacgccattctcctgcctcagcctcccgagtacctgggattaaaggtgcccgccaccacacccagctaattttttgtatttttagtagagacggggtttcactgttttagccaggatggtctcgatctcctgaccttgtgatctgcccacttcggcctcccaaagtgctgggattacaggcatgagccaccgtgcccggccatgcctggctaattttgtatttttagtagagacagggtttctccatgttggtcaggctggtctcaaactcccgacctcaagtgatcagccgcctcggcctcccgaagtgctgggatgacaggcgtgagccaccgtgcctagctgttacgttgtataatttttctaataatttcttgggggtgtggaaatttcatgttattgtacaagagtgcattttgtagcaaaaaagattaaaaatacacagggctatttggtggcccaaatagttttgtctattcaagaatgttacataaatggagtcatacatttataaccttttttttttttctttttgagacagagtctcactctgtcacccaggctggagtgcaggggcacaatcttggctcactgccacctatgcctcccgggttctagcaattctcctgccttagcctcctgagtagctgggactacaggcgcctgccaccacgcctggctaattttttttgtatttgtactagagacggggtttcaccatgttggtcaggctggtctcaaacttctgaccttaaatgatccacccgctttggcctcccaaaatgctgggattacaggtgtgagccactgcacccggccattttataaccttttgagactggcttccttcactcagcattatgtctttgagatccaaccaagctgtgtatatcaatagttcattccttctttattgctgtgtagtattccattgtatgcttctaccacagtttatcttttcacctgtttagggacatatgggttgtttctaggttttagcaatcatgaatgagactgctataaaattcatgtacagatttgtggatgaagtcttcatttttctaaagtaaatgcccaagagtaggatgctgggtcatatggtaagtgcatatttaaccttataagaactgttttccagagaggccattccattttacattctcaccagcagtgtgtgagaaatgcagtgctccccattcttattaggacttaatattgttgctggcttttctggtttttccttatagctgtcctgattgatgtagagtgatatctcatcatggtttttatttgcatttcccgaatgactaatgatgttgagcatcttgccatgtgcttatttgccatccttacatccgctttgatgagtgtctgttgttcaagtattttgtttattttttaattgagttgttgattttctcgtcatattttgagagttctttatatgttctaaatatagttcttttgttggatatgtggtttccagagactgttttccaagtttgtagcttgtcattgcattctcttaacacgggcaaaaatattttaattttgataaagcccaatttatcagtttttttttaatgagtcatgcttttgctctcatgtctaagaactctttgcctaacccctagtaaaaagattttctcctatttcttttctaaagattatgttcttttacattttacatttaagtatatgaccaattctgagttattttttgtatagggtttgagatttagtttaaggtttgctttttttgcgtatagatgaccaatagcaaaagactatcttaatccatgaaaagactgtccttaatccattgagttgctcttgtacctttgtctaaaagcagttggttgtacatttctgagtcctctgttctgtttcattaaactctgtgcccatcctttgcccctatcacattgtcttgattactgaagcttgttataaatcttaaaatcacccagtgtgattcttcctactttgttctactttttcagaattgttttaactattctggtttcattgcccttccactgaaactttagaatcagcttatctgtgtctggcaaaagttctgctgtaatcttatatccttttgaacaaaataacaagtaagggaaacaagtacacaacattttactgactgatgaatagtttccatttgcaaaaaaatacaagtgtattttcaatgatggaaaataactttcaagtattaaaaagataaaaaggaatgtagtttcctattttgttgcttagtagccacagataaggtggaagacacaaagtgcatagacaaacagaaaaatcaagcttttattcagatcttttctttgctgcctggaataaatagctcctgctcctgctagagcagcccaagactattatcagtgcatttgatactgcgatggcccaatatcaatgtatttaaacatgcttctccaggagggctagggtgctggacccatagtgccactctgcccagggcagacattgtctctggagctgtgcagggcagacaggtagatgatgagacatgacccccagttctcatggagatcgatagtacaaagggagataggctgtaataacatatgcatcacacagtgatgtgagcagcctgctagagcttcagggaagaaatgagttctgactggagaaatgtttaaaatattctacactgctgactgggtgtggtggctcacgcctgtaatcccagcagtttgggaggccaaggcgggtggatcacctgaggtcaggatgtgtccggagttggttccttctggtgggttcttggtctcgctgacttcaagaatgaagccgcggacctttgcagtgagtgttacagctcttaaagatggcatggacccaaagagtgagcagcagcaagatttattgtgaagagtgaaagaacaaagcttctacagtgtggaaggggactcaagcgggttgccactgctggctgggggtggccagcttttattcccttatttgtccccacccacatcctgctgattagtccattttacagagtgctgattggtccattttacagagtgctgattggtgcatttacaaccctctagctagacacagagtgctgattggtgcatttacagtcctttggctagacacagagcaccaattgatgcgtttttacagagtgctgaatggtgcatttacaatcctttagctagacacggagcactgattggtgcatttacaatcctctagctagacagaaaagttctctaagtccccactcaacccagaaagtccagctggcttcacctttcaaggagtttgagactggcctggccaacatggagaaaccccatctctactaaaaacataaaaattacccgggcgtggtggtgcatgcctgtaataccagctacttgggaggctgaggcaggagaatcgcttgaacctgggagggagagtttgcagtgagctcagatcgcgccactgcaccactccagtctgggtgacagagcacgacttcgtctcaaaaaaaaaaaaattccacactgccatcatggatatcctcaaaagagtggtaggaggagtacagtggaaaattaagagcagcacacaagatcagaatgagcaaagaccaaatgatctgggagcatacctatgttttaagaaaagcagattgtctcacatggcaacagcaaagcaatggaaggataggaggaggggtgataaaacaggaaagagaagttggggtcaatgtttaggttctacaacaagtagaatgacttcaccagcatgtaatacaaaacccaactcaaaatgactttcaacggagatacaggatctcatgcaataaagcccagaagtagcacagttccagagttggctaggtgggtgcttgaggaattaattgagaaattaaagggctacaattgcatttgtagcccaagctattaaaacagctcctacacaagaagaaggaggaggagaagaaagaattttcttaatttcattttcagattattcatcactagtatataaaaatacagttgatttttgtatgtccatcttgtatcctacaaccttgctgaactcatttattaattctgctatacaattattttttaagtgacttttggtcacagtctccaggaataacagaagtgttctaggaaaaaacagcacaaatgaatagtacctgatactcattacatcttcatgaatgacagcaagatgcaatatttcttatgacccaaatcctttcctggaaatcagtatctagaaaaccaaatacccaaataatacagaatagaggcataaaacttccatacttaaagattaagacatttcatttatttatacagtatgtaattgacatgtgtcttggagtataaaatcattgaaaatgcaatgtctttccaaaatgagtaccattttggaaaactcatgtttggaaaggaagccatggcaaattcagtgccttggggagggtacataatggatggacccattcatgactgccagggacttgtgcaaatccttttctgcagggccatgattgcactaaaacacttaattactacatggaagttttatcagcagtcatcctcataactgattccaacagtggctggttttctaacacagcaatctagtttgatttttataagctagagaaaacactagactgttgaaacttataggcagggcctacgggagcaaaatgaaaattcctgaatatgtacttgtggtgctttggtcctgtgataattggtgaagactctcctaatttctgtttagaagaaacgagtatctttcaaaacatttcgtagtaaaatggtagcagataggggtgcctaattggaaacagctcatcctaagtggacttttcccctccgaaacattagacccctgacacacacacacacacacacctcgccgctgctgaagccagaccacctgtccctttccctcctctgtgcaatgcgtgtgctctgtcccactctgaaggatacacggaaggatcacgtttgacctcataccttctaaaaagaaacaatgtcattcactgtaaatacttttaaagatggggaaaagagaatatgatgtttgccaagaagtttaaggtttttctcattcctttttaaaaaccttatttgtgatattagtgatatggaaataaaagatttgtttccttatttcatcactacactgtaataaattaaagcatcctttccccccccggcagaaactgcttgcaagttttcctttttaaaagatagtctttcttcttgtttcctctatcatctagcatattcctctgcagacactattgaagttcatggtggatattgccctgggaatggagtatctgagcaacaggaattttcttcatcgagatttagctgctcgaaactgcatgtaagagtcctcggctatcctggaagggtttggacctcatggtgtttggtctttgcagggttagtgagaggacctgttcctgtttagataggcaaggaagctgcagtcagcgggggatggtgtggcttgctccgaagatggaaatatggctgggtgtttgggagttttcactgcctctgtatctgagagtctggttggcttccaaagctttcccttatgactccagttttaccttcactctctcactcggtaggaatgcaaggtgtgacccttgtgatccttccccagccatcagctagctttggacctagagttatgtgtacgtcagctcctcttaaagacagcagtgaaaatcataaaggcttttccctaagttttcacaacacttccttaggaagaagttttgtactttgaatacatggaagctgtcctttcacagcagacaatggcttcattatacaagaaatgtggacttaggttctccctatttcttcaacctgcttcagcagagccattgtctgctgtaaatcttcaaaaacaataactatgtcttgattttaagttttttattgcaagaagagggagtggtccttcaatgtattttgtcatttgtttttcttggtcagagatgtgacaatggggcctgccccctcccgcctcccagccgaccctgcccctagggctcctacctctttcacctcatttttgaaaacactaaaggggttttggttttgttattgttattatttaaataatttttcgaccatggagggagaatcatgaaaactctttttcccttactgtttccttcatgttttcccagcaggtagggtgaccagctttgcagtttaccctggcctgaggggtttctcaggacaagggattttgagtgtaaaaaggcagtgtcaagcaaacagggacaagttagtcaccttccccagactactttatatctatttcttctccttctcttccttttattctttcttctcctcttccttcttcttgtgtaggagctgttttagtagcttgggctacaaatgcagttgtagccctttaatttctcatttaattcctcaagcacccacctggccatcttagcaagaagcccagcatcttgctcttactgcaggtaattccccatcttccccaaactctcagggggcttacttagtcctcagggccagtgctgcttccagacctctgggaggaaggctgctggggtcctggatcagtccaccagagggctctggttttgagctgctgctctttctgctcctgctatgctgcgtctccatgttctccagctgtttctatccactgtgcacaggtgcccttgctagtccacatcccacacagatcagagcgatgcaagactgcatcacttgaggctaggcgtggtagctcatacctgtaatcccagcactttggaatgccaaggcgggcagatcacttgagatcaggagtccgagaccagcctggccaacatggtgacactccatgtctactaaaaaaaaaaaaaaaaaaattagccggctgtggtagtgtgtacctgtaatcccagctactcgggagactgaggcaggaaaattgcttgaacccgggaagcagagtttgctgtgagccgagatcatgccactgcacaccagcctgggtgacagggtgagactctatctcaaaagtctcaaaaaaaaaattgcatcacttgctcttgctcttgctctgctgttggtcctcacttgctctgccattggtcccaatgcagcatgctcacaggctggtggtgtctctgtgttcttttggtcaattatcataagtgttttcacctgtgtctgatacagaccagtaatttaaggcattgcctctgacgctgctgaagacgtaacctgctctctgtaggttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtggtatgtacacagctttgattcaggggtcccacagcacaaagaggagggcatattgaaagaaatgacctcagctggtatggcaagacattttactctttgataaactgagggttggcagcttgctcagatctcttttatatcttaccatcagatactttaattcaagtggaacagtagattctgatgaagtgtcctgacattcagaagatgtgtgctttgcaaaagcccttaatttcttcccatttttccttgccgtcaaaggatgactcattgcccacaactaggatatttcatagtcacattaaattgaatgagttcatccactggctcttggaacctagatgctatatgaaaggtgctgtgtaattacgcccttgacccgagataaggaaaaaaaagcacctcacagcaacagtggaggagagcactaagcagatgtgtgacgaggctgtttctgcctttgccagatttcccagaacagcttttgtagaagtggggaactgtgacactccaaccccacgttattgccgcgttgggagagcagtgcgtctcacacataattgccagctttgtgcatgatcatcagtgtttaaggaaatgacctttcccagtgaaaaagtccattcaggctttgtggaaaggcttgcatcctaacttgttgttgctttgttcccagtgggcatttggcgtgaccatgtgggaaatagctacgcggggaatgactccctatcctggggtccagaaccatgagatgtatgactatcttctccatggccacaggttgaagcagcccgaagactgcctggatgaactgtgagtgggcttctctgtctcccttccatactctgcatggggcagccacctggctctgcactgacctcggaaacacagccatgggaggggaaagggactgctgttagccaggtgggcatgtgcagaggggtggaacccacagacaccccagcccaggagccattcctgatgtgggagatagtgtgtggtatctccagtgagcccactgaggctcactcatccaaagggcctcagtctcgaacgacaggcacggtcaagacaaggcaatggcacctgtcctaaaattccttacacacctctaggaaatatatccacagataatagcttcgccttgtagtgcatgaggtccttgaatgattcctcaccctcttttggtccagttatctttctccttctatgtagcatttcaaacactccactcacagtagtagccttcatcaggaaactcagaaatctaaaccaatgactttggggtcaggctgctcatcagaatcgcttgggagatagtgtaacaatacgattcctcggccctgttcccggaaattatgatgctttcggtacaaagtgggcccagaaatgtgtgttttagaatgctccctggggctgggcgcagtggctcatgcacgttatcccaacactttgggaggccaaagagggcagatcgtttgagcccaggagtttaagaccagcctgggcaacatagagagaccctgtctttattaaaaaataataaaataaggccgagtgcggtggctcacgcttgtaatcccagcactttgggaggccgacgcgggtggatcacgaggtcaggagttcgagaccatcctcgctaacacagtgaaaccccgtctccgctaaaaatacaaaaaattagccgggtgtggtggcgggcgcctgtagtcccagctactcgggaggctgaggcaggagaatggcgtgaacccgggaggcggagcttgcggtgagctgagatcgtgccactgcactccagcctgggcggcagagtaaaactccatctcaaaaaaaataaaaaataataaaataataaaataaagtgctccctgagagatcatgtgtttagacaggagaaagaactaccagctgtgacacacacacagcacacatcccatcctgacagggcccccgtcttcaaggccaggcagtatggggaagagacccaggcctcggagtcaataggccacgctctgcttcctaactggccctgtgagtggctatggcaattaatctcccccaagcactttgctgaccttattaaaataatttcttgtggcattgctggtagcttggtgatggtgatttgaaccttcctaatggggagtctcctccctgtataataagggccatgggcttggagaggggcattctcaccatatttagcaagaacatttcaggactgtgggcctgcgctggctctgtcatggagtgccatgcctgggctgggacaggtgagtgtggacagcaccctccctacacacacacacacagacacacacacacacgccctgctgcctcacatgggagagagagcctgggtccctttgcccacaggctttccgggtcccttctaagccaaaaagaaggacactgttttaatcagagcttcgtcccgttggtagtggttggtttttattgtggtggtagatgtataacattaagaagagaaacaagcactgtaaaacctttaaaacatcctgaaatgctaataaaattagttctagggtttcatggtagtttttaaaagtgccatgtttatgaagtgcctgcttctgaaaataaggaagcatttcagtcaaacaatgttgactatggaaagagttttgttgcagtttctttctgagctttccttgcccaccaaaataagttgatatttgcggtgattatgttgggtcttagcagggtctaagctgtgtcacgttgtggtttttagagccaaaacaagtgaatgctgagtcggttttctgtgagacattttaggggacaaagcagcagagtcagcacacgccgtgtggctggggaagtcaggcagagaggggcgaacctgccacccccgcctcctgtgggctctgtgccctgggtgtgccaagggggctatggctgtgctgtggcctcggggcccctgtgagccaggcttccttccatctcctctcgaatctagatgctgggtaacaacagcatcccccaaagaggcctctgttccatttctgagacatttcctttgtaaaatgaactcaggctgagtgcagtggctcatgcctgtaatcctagcactttgggaggccaagacaggaggattgcttgaggccaggagtttgaaatcagcctgggcaacacagtgagaccccatctctacaaaaaataaacaaaattagctgggtgttgtagggcatgcctgtagtcccagctgctcaagaggctgaggtgggaggatcacttgagtttaggaggtcgaggttgcagtgagctatgattgtgccaccagactccagcctgggaaacagagcaagatcctgtctcaaaaaaagaaacaacaacaacaaaaacccaaaaaacaaatctaaagtgtttcacatgatggctgaaatagtaaacgtgagggaaaggtcagtgactcttcttcatagtgaaggaggtcgaggtcacggatgagagcaggtgccctgtgttagatggactggcactgccgccgactgttggcgtgacttcagtcagttcctctcctctccaggcctcagctgccctgtctgtgagtgtgactgcatctcttccttcgtggggctgcagtgaggagtgatcggttagggcccatcaacccacacacagctggcacttgctggtcatgttctacctgcatcagccaccttgaagctgcagttgcgtggactcaggggctcctctccgggactcacctgatgcccatcccagcaccaccctcgcgcttcacacacctgaccagcctagcattgccctcacactattatttaccctggcacccaggacctggtgtgttggctggcacagagctggccctgcctcttgcctgcttcttgtctgccccaagaaccccagcttatatccaccttccccatctcagaaaccctcctctacccattgatgtatccctccctccactgccacctgaagcatctgagatctggagaagggacaaggtgggagtcacagtgggctgagtggcagagctgggtagatactggctagcacagtggaagcacagctgataggagatgggcatcatttccctgtgcagacttgcagcctgcactcagccatcctcagagccaggagcaaagcaggtgcttgaaaaatatgagtaaagtcatacatttacaaattttgtaaattcatatgattgcatttaattgtgataaaatatacataacataaaatgtactcttaaccagtgcgtacagctcagtggcgtgaagtacattcacactgttgtataaccatcaccaccatctatctccaaaactcttcttatcttgtaaatctgaaagtctctacccattaaactaatcccattctctcctcaatacagcccatggcaacctatatgatcacatcttttataaaatctcagcagaaaaataaaaatgaccatttacaaaagcaattaccaaacttatttttctttccatccataaaattttataaagtctaaatcactaaatatcacagccctcctattacttaccagatgggggcttcttgttaatcttcttgttctactacgatgaaattgcccatttgtgggagtaggttagacagtatacatgttcaccatgtctttaaaagtcatatttatatttttatacatttgataaggtattgaatattaaaggaaaagaagtttcaaagtgatattgatactattctacttggaaataaagataaattatttaaatactttctcctaagacatgaaataaatgaaagtaagttaaataccacagcctcttgatgaaataatgaaaaggagattatgtccctaagaacagaatgtctcaaagctcatcttagatggcaaacaatcaaggctgtttggaaaacagagtcatgcaaattgacttacgcctgaaaacctcaaaaataaaaacagaaaccgtctgtcaagtctaagtgaccatctaaagaaggtaagacagggaaacaaaacagaacccctaagcctgagatgagaacaaggattgtgagacagggaaatgcgccgtgccgttgtctaggcctacattcaggatcaagctctttacatgcatggcactttgccagcctccagcttccggatgcgtgtgcaagtgttgataaaggctggaaagtggacagatgaaaagatattattatacatctacgtgaatgagatctgcatgttgtgtgtgaagtaacatgttagtagaattagccaaaagttctataggctgtaactaaatgtcaatatggaaattgcatatttctgttcgtaagatgctagtaatttattgcatgggtcagatgatttaaatttgggtcatttttttgtccaatgacgtatgaattatcagtttctcaaaacagaaaagcatcaaaatgaaatgatgcctaggcatgctggtgtgtacctgtaattccagctactctggaggctgaggcagaagatcacttgagcccaggagttcaggggttctccaccagcctgggcaaaatagcaagacttcgtcttattaaaaaaataaatacatctatttttaaaattttatatatatatatacacacacacacacacacatttttatatatatacacattttcaggccaggcatattaattggcatgcatatatatatatgccatatatgtgtatatatatgccatatatgtgtgtgtatatgtgtgtgtgtgtgtatatatatacacacacatatggcatatatatacacacatgccaattaatatgcctggccctgaaatgtcaggtctatcaattataagaaaaaaaacatttttaatgaaatgatggtataactcactcttcatctcagcctattgattcctaattgtcatctgtcttactgtgctccattaaatgtccctccattggaattcttaactatattagacactgggatgaaaaaaccacccagaagagagttgccctctataaaacaaagtggaaggagttgtgaggagcacttggacgcaggagttgtccaatctgaatctgaatccctggctacccacatggccatggcatgttctgtaatgtccctgagcccactgtcatcttcattacaaagtgacaatgacagggctgttgagaagactagatggagtgatacgcagcacacaactaccccctgccctcacccctgctcctgatcttcttagccctagccccagggccccaactaactcagctgtcctggtaacaactcagtttgatggcataggacagaggtcagcaaacttttcctataaagtgccaaatagcaaatatttttggctttgcaggccttttagcacctgctcaactctgccattgtgacataagaagtcatagataacgtgtaaacaaataaggatagctgtgttccaataaaactttatttacaaagtagacagtgggctggatttggctcatgggccatagtttgcccgccgccatataaagaaagagacctaaatactccttatctgcaaagttagatataactgccacatatgtgctcttcctagaaacagaatcacttttttgtcaaataccatggaacatttacaaaagttgtataaatattaggccaccaaaaaagtctcaataatttttataaaaagtagaatgaatgctgattaaaatgtgataaagattctgtaaaaacaaaggcatggattgcacaaagagatgggtgccatgctgggagacaatccacttctttttaactttcaggtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttgttaagtaagctgtcattaaaaatacataatatatatttatttaaagagaaaaaatatgtgtatatcatggaaaaagacaaggatattttaataaaacattacttatttcatttcacttatcttgcatatcttaaaattaagcttcagctgctccttgatattaacatttgtacagagttgaagttgttttttcaagttcttttctttttcatgactattaaatgtaaaaatatttgtaaaatgaaatgccatatttgacttggcttctggtcttgatgtatttgataagaatgattcattcaatgtttaaagttgtataactgattaattttctgatatggcttcctaataaaatatgaataaggaaggatatgttgaacttacttgagacttgaaagacagtggtcggcagcggccttgtggcctttgcaaaggaattcccttaatgcctggtccttggggcaattgctctgaccattcttggcattgctttatagagatatggaaaaaccacaccagggtctgtagataaggaataaagaatattgaaggattgaaaaatactgtgtgaatggaaagatttaaaatcagctgaagaagagaatctggcaggtgaagcacttttctgtttgggaggggtagctcatgggaggtaggcatgggcagtggggcagggcatagctgagctcacgttctgcctctgccacttcgtaatagctatcatttgtagagtacttgtttcaggaactttatgtgaaccatcttatttaatctgtatgtcattataacatggtacaaatgccatcatcatgtatgagccaagaaatccaggcttagagagactgagtaacctgcttgtagcccacatctaaacagtgggggagccagaatttagaacatctgattctggctagttctatgcctgtgatttgggggttgtattagtccattcttgtattgctataaagaaatacttgggactgtgtaatttataaagtagtttaattggctcacaattctgcaggttatataggaggcacagtgctggcatctgctcagcttctggggaggcctcaggaagcttgccatcatggcagaaggcaaaaggggagcagatgtctcacatgcaggagcaggagcaagagggagaggggaggtactccacacttttcaacgaccagatctcacaagaactcactcggtatcacgagaacagcaccaaggggcagataccaaatcattcatgagaaatccacccccatgatccaatcacctccctccagaccccaccttcaacgctggagattacaactgaacaagaagtttgggtggggacacagatcaaaaccatattagaaatctactccagagcttctcaacatttttactttatttaataaacatatatctcttactctgtgccaggcatggcactcatttaattttcataacgacactaccagataggtactactattatctccacttcacagatgggcagactgaggcaggaagagcctaacttatgctgctagtaagggcagcagaattatgcagtcagttgaattgttgatttcccagccttcggggcagctgagcaggcccagagccactggcatcttcaggcctgtttactccccaccagtaagcagcctcgcctaggcctctcccacagtcttcaagaatcagaatctacatggggtccaacagtgtggctctcacccaggttctggtcccagctgcccacccaggcacccaatctccagggtgagccggctcctctgttactgtgaaatgctccatatgaaaaagttctggccagatgtggggattcacaactgtaatcccaacacttcaggaggcaaggcaggaggatcacttgagctcaggagttcaagaccagcctggacgacatagtgagaccctatatctacaagaaaaaattagccagaaatggtggtgtgtgcctgtagtcctagctactctggaggctgaggcaggaggatcacttgagcccaggagtttgaggttacaatgagctgtgattgtgccactgcactctagcctgggtgacagagggagactgtgtctctaaaaattaaaaaaaaaagttctgagggtttgaaaagaatctgtaaaatgccaccattacattttattcgtgaaagaaaaaaagctgtagctcctataaagataacttacactgttgaaaatttttggtcattaaaaaataaaaaaatttatcacctacttgtataaacagtttcttatcgatggtaagtagcaggaagttgaagaactgatcattaaagtcttgatcagaacctgatggtgactagttcaaacaaaaaaaacccaccccaaaatagaaaggtatgctcatatctatgagcaaaataagtaattataaacattgaaaaatgttatttggaagtttaatataaacttaatattaaatatctatgctcatatacagtactttgtattttatatttctaattttaacagcataatgtaaaaaatgtacaatgaatagttcatcaaacaccccacagccctctaaatcctgtccagtatcttctgtgtggtctgagcagggctggggagcccgggccagttctgccgcaggagagtgtagaaagctgagccagctgtggcttctggcttttcttgagacatcaagaaacgtagcagagaaattcacttcagcacacagcgtgatgcacccaagtgttggttaaaagtggtgtgatgaatgagaatgaagctgggctaccattgttcttcacatttaaatctccgcactgagaatgttggtgttcttcttagccacatctgaatatttgaaaatttggaaagaactaactttcagatgatccagtcattggcaaactctcatactgtcttctgagcataaactgaaaacagcgtttcaaattctctttcatagaaactcaaattacttttgtaagtggctcttgtaggcaaaaaaaagggagagaggaaacaggaagaaacaagtcgggttaattgtcttaaccgtgctggggctcaggatcaggaggtcgaaaggacaaggaaacagacatatgccagaagcactcgtgactggcacgttgagacttgccctcccttgtgaggattttctttcttttgtgttgttttttttttcctttctgttgcttttcttaatgagtagaaatgagaatcaagcgtcagggcaactcttggaaaacaaaaaaaaaaagacaccaaagcactcttcatggtgagccaggccatatggtcagaggtgggctggataggagctcaccctgccagatgtccttgggcaatcgtgggcaggtcacttgactttccttgagccccagttttctcaagtgttcagtaaacataccaatgcctttttctgcaacaccctgtgtaagaaggggaggaggcaaggtcttcgaaagaatattatactcacaagaggctgttctcaatttgtggcatcattccttatgcagtgcaaacccagcaacatttgtcatattcaaaatattttcagccaggcgtggtggctcacgcctgtaatcccaacacttttgatggccgaggagagaggattgcttgaacctagtagttcaagaccagcctgggcaacatagggagaccctgtctctataaaaaataaaaaagaaattagccagggatggtggcatgcaattgtggtcccagctgctcaggaagctgaggtgggaggatcacttgagcctcaaagctcaaggctgcactgggctgtaatcacaccatggcactctagatggggcaacagagcaagactccatctcaaaaaaaaaaagaaaaagaaacattttccctgattgtttcatcaactccctccaaaataaacacagtcattcataatttgaaaagagaaagagatagtatttcgccttagccagaaacgcacagttggggaagttcagagtgaaggaggaggccctcagtcctcacctcaaacagccactgggctcaggagctggaactaccttcctcttgtctatcctggggtttagctactgatgatacaagcctcattgcgcctctccccaatatgtgggttatgacaagcaatggtggcttgctttaccaggagcatttggggacatgtggtgggtcagaatgctatcccaggaaggggatattccctctctgcctccatgtctgccagacctagcagaggttccccacctgggaaatgggccaaaccacagtctcttcttttacagagcaggctgattctagccagaccagttctgattcatgaaagtcaagacttttgtaacttttcctggtcaatggcaaaagcaagttggaacttctgctgagtccgtgggaaagtaactgacccaataataaactagctacaacagcaacttaacttctctaaagatgtttagtaactgagtgacaaatgagaaaatgggaagttttgttttctttaataaatgtttcaatgatgcacaatgttcctatccttagattttattttctttcttttaaagctctaagtgagaatagcagcaaaactcccattctatttaactttaaaaggcatatataattacttaattttttgttatttaaatgcaataattctgggcatggtggctcatgcctgtaatatcagcactttggaaggcagaggtgggaggattgcttgagcccaggagttcaagaccagtctgggcaacatggtgcaatcccatctctacaaaaaacacaaaaattagctgggcatggtgccacatgcctgcagtctcagcaacttcagaggctgaggtgggaggatcacttgagccacagaggtcgaggcagcagtgagtcataatcatgccactgcacttcagcctgggcaacagagaccctgtctcaaaataaataaatgtaataattacttctagaaactgtaacctgtggaccactattttagaatatttttacatacaatctctcttatttaaatgggattccatggatagatatatgaaagagaaaccagagaattatatctattaactctttctattccttaaggacatgataactgttaattaatagatttattgagactatacacttaaacattctaatgaagaaagtgttttcgaacaacaatcatatgaggtcacctataacccactcatccatttgcaaatattcactgagaggaaggccctgttctgggcattgggatcttgcaaagaaaggcagtctaggccttatcacttcttggccttttggctaagatcaagtgtagaaaggcagtctagtccttgctgtcttgaataacagtccaaaggagggaacaggtggctttggatgaatcattttcttttaactatagtcttctttttttttttttttgagatggagtctcgctctgttgcccaggctggagtgtagaggcacgatctcggctcactgcaacctctgcctcctaggttcaagcgattcttctgcctcagcctcccaagtagctgggactacaggcatacaccactacgcccagctgatttttgtatttttagtagagacggggtttcaccatattggccaggctggtctcgaactcctgacctcgtgatctgcccacctcggcctcccaaagtgctgggattataggcatgagccaccacacccagccatcattttcttttaaagaatattcttcagaatactctgacttccacattttgttgaagtccattcgtagcatagtgaagcagagcagccacacctgtagatgctatttagagactctacaagaaacctccagaaaagggacagaatgcctttcctggaagcaagctccaaggcccggccccacatgacttaaaattaaagggccatcagctggggcttaaaaatcaaaatcccattataccacagtctgagcagttcaaggggatgcaggctgctgatttaactccacaagtagtaatggcttgttttaacaaacatagtttctcatcataaaaatgtgtaattcgccagttttttcatccatacttcatactagattatctctaacgatctatcttcaagtttgctaattcttcttctctcagctcacagctactattgaggccctctagtgagtttttcatttcagttattgtactttttcaactccagaaattccattcagttattttaatcacttctatctcttaattgatattctctgtttaattttaaattcaaaaatatacaacgtggtgttctttagttttccaaacatatttgcaaatagatgcttttgctttttttcttttttttttttttgagatggagtttcacccttgtcgcccaggctggagtgcagtggtgcaatcttgcctcaccacaacctccacctcccaggttcaagcgattctcctgcctcagcctcccgagtagctgggattacaggcatgtgccaccacacctggctaattttgtatttttagtggggctggggtttctccatgtccgtcaggctgctctcgaactcccgactccaggtgatccacctgcctcagcctcccaaagtgctgggattataggcatgagccaccgcacccggcctaccaatagatgcttttctataatgaagtacagtcatgtgtcacttaacgataggtatacattctaagaaatgcattgttaggcgattccatcattgtgagaacatcatagagtgtacttacacaaacctagatggcatagccgactacacacttgggctatatggtatagcctattgctcctaggcctattgctcctatagaaacctgtacagcatgtgtactctactgaatactaaagacaattgtaacacaatggcaagtatttatatacctatacatagaaaaatgacagtaaaaatactgtattacaatcttatcagaacacagttggatatgtggtttgactttggccaaaaccttgctatgcagcacatactgcatttatctgctaagttcaatatctaggcctcgccagagacagtttctattggcttttttcctccatgagataactttcttgtttacttgcatattttgtatgtttttattgaaactggatatttcagatcatagatttcagaaactctggattctaaagtacccctctcccagaggtggttattatcactgtgtgtttgtttagcaatttgcctgaattaattctatagatggtgtttctcctgtagtgtttgagcactaatgtctctgctcagttgctttttaaaaattatacttttttaaatgttgaagcctgactttcaacaaggcacccctggatcaacgtagcttagtaataagccgattgattggtcagaggttgtgcttaaacatcttgagccagtatgatttctacattttgctttctgtggcttgcagaatacagtgcaagttcaggaagtttcttgtttatccaggagtaaataattcagtaagtgtaaatggattaatcattccggtaaaaagacaaaggttgtcacgctagataaaaagagatgtatatcctgcaaaaaaattagctgggtgtggtggagcatgcctgtaatcctagctactcgggaggcagaggcaggagaatcccttcaaccagggagctggaggttgcagtgagccgagatcgcgccacagcactctagcctgatgacagagtgagactctgtctcaaaaaaaaaaaaaaaaaaaagagatgtatatcctgaatatataaagaacacttgcaactcaacaatgaaaggacaaataactcaatttaaaaataggcaaaggattcaaatatacatttctcctaagaaggtttataagttgccaataagcacatgaaaagatgttcaacatcattagtcattagggaaattcaaattataaccacaagataccacttcacacccactaggatggatataatctaaaagacaggcaacaacaagggttggaaaggaggtagaataattggaaccctcattcatggctgaattataaacattcagttcataattcagctgtgaatgagggttccaattattctaaattctaaaattcatacgttgaagctctgaatcccagctgtatttttattagatgggacctctaaataaataattaatgttaaatgaggtcaaaagggtggggctccaatctgataggattagtgtccttaataggaagaaacaccaaagagctcaattgcattctttctgcatgcatgcacaaagaataggtcatgagagcacacattgagaaggtggccatctgcaatccaaggagagaaccctcaccagacaccaaccttgctggcaccttgatcttagattttcagtctccagaactgtatttctgttgtttacaccacctagtctatgctattttattaaggcagctgatgggaatgtaaaatggtacagctgctttgcaaaacagtttggcggttcctcaaaaagttaaacatagaattaccatatgacccagcaattccactgttagttacatagccagaagaattgaagcacgtctttaaataaaaacttgtacataaatgttcatagcagcactattcacaatagccaaaagatagaaaggaactaaatgttcatcaatagatgaatggataaaacaaaatgtggtatatatgtacaatggaatattattcagccttaaagaggaaggaaattctgacacatgctacaacatggatgaaccttgaagatagtatgctaagtgaaagaagccagtcaggaaagagtaaatattgtatgatattcaacttatatgaggttcacagagtaattagatttatagagacagcagaatggtgactgccaggggctgtggggaggaaggaatggggacttaatgtttactgagtatagagttttagctggggaagatgaaaaagttctggagatggatagtggtaatcgttgcacaacaatgtgaatttccttaatgctataaaaccgtacacttaaaaatggctaagatgataaatgttatgttgtgtatattttaccacaaataaaaaagagtgaattttatggtatgtgtgaattatatcttaattaaatcattgtaaaaaataatgactcacaccaaacaaatagcataaaggggagaagaacccacatgattatctcagtagacacagaaaaaatatctgtaaaaatcagcattcattcataataaaaactctcacaaaactgaatttatatgttttgacagagagttcatttaatacttggagctgaaacaaacaaataaaactcaaaataaacaacaaaactaaaaaccaaccacctctcccaatctttgcaagttagctctatgctgggacgcaccttcagcacttagcaaggctcaccctgagcctagggtcagccttcagtgaacacttagtatcttctcaagtcttttctaagcatagattttgcctgggtgtgtttgtggctttctaaattccttggtatacatggctgcttttgcatgtcctaagttcccaaaaacatctcaccccagattctcctttaggcctttgatggtctatcgtacgtctctacccagaatctcttgccttaggcatccatgggtctgtagtcacctggcagtttttatgagtgatacccaccatttttcttcctgagttccaagttagggaagacagagagaagcaccttgtgttcacccttcagatatcccgtggagaagttagaacaggtgtacataataatttgtaaataaactctgctctgtcccctctgctttgagagagagagaactgggaatccagcttctgcagtttcaagactgagactgccactgcagcagtgggtgggggtggggtcatgctgggcaaagataaaatcactacaaaacttttcaaccactttgaagatttcatttcatttcttttcttttttaaaatgagatagggtctcactatgttgaccaggctgatcttgaactcctggcctcaagtgatcctcccatattggcctcccaaagtgctaggattacaggcgtgagccaccatgtccagccaagatgtctttttcttgactgggcatttgcttggttgctgttaacactgggttgttttccagagcaccaacaaagtttgttcagacagttcctgcttgttttttcaatgttctgaagtgaagaacaatccttcgagttttctagtctgccattttgttgacatcactgtctcctttgctttagaaagatatttctgctgggtatagtattgtagattgaaagaattttttatgtcaacgttttttttttttttttttttttgcaggtgcaagatttaatagagtgaaaacagagctcccataaaatggaaggagacccaaagggggttgccgttgccggctcgaatgcctgggtttctatcccaatcattgtccctccccctgtactctcaggtgatagatattagctatttctttacctcctgtttttgcctaattagcattttagtgagctctctttactacctgattggtcgggtgtgagctaagttgcaagccctgtgtttaaaggtggatacagtcaccttcccagctaggcttagggattcttagccggcctaggaaacgcagctagtcctgtctctcagtccctcctctcaacaggaaaacccaagtgctgttggggaggcgggccagcgactgctctaactgcttccttctgaactagggcgcagtaggggtcatgcagttgagatttcctcgggaggggtgcctttgatgtcatcaacatcgaagcatgggctagcaggctggtccagggggctgcggtagatcttagtcctcgactgcacctggggctccatttgaagaacgatttgtagttttacagcttcgattctggaagagacaaacttaacaaggaggttaaaaagatacagggattgaaatgtatggcctgcagtgcaggggattatttctttggcacacttcacaggccctgactatctgcttgttagttttgaaaaggcctggtccagtaaataaagattcagccatctgatgagtgctatcaatgcctaagtgaaaggtttggtgaagagttttaagtaatttccattggttagctgcaggcaaaagtatttttccttctttggtggctaaccatcctgaggggaggaaactatgtcctcatgaggttccccattgtcaggcctctgagcccaagctaagccatcgtatctcctgtgacctgcacgtatacatccaaatggcctgaagcaagtgaagaatcacagaagtgaaaatggcctgttcctgccttaactgatgacattccaccacaaaagaagtgaaaatggcctgtctctgccttaactgatgacattaccttgtgaaattccttctcctggctcatcctggctcaaaagctcccccactgagcaccttgtgacccccacccctgcccgccggagaacaacccccctttgactgtaattttcctttacctacccaaatcttataaaacggccccaccccatctcccttcgctgactctcttttcggattcagcccgcctgcacccaggtgaaataaatagccttgttgctcacaccaagcctgtttggtggtctcttcccacagaggtggatgcgagtgaaacccatctatttctcctgctgagtagtggggcttggtttcccagaggggactaccccatactagggatacttctataagcatttctaatggagggtcccgccttgtggctctttcggcttcaatatccacttggcggttcccttctatttccctttcctttcttttctgatgaccccggcagtgtaagactgccacctctttaggtttctgtacagccaataataatctcctaatggcttcctgatgtttgataggtgttccttcagaagttaggaattccctttctctccatattgctgcgtgagcatggaggactaggtaagcatacttagagtctgtatatatatttacccattttccttctcctaattctagtgtataatggcccttgcttttgctaggatgtctctccctaagaaaggagtggggctttcaggcataattagaaaggcatgtgaaaagagtaaaggtccccagtcacagcttggcagctgggagaagtacctagtgactgcctgtcctaggacccctcggatagcgacagatctggaagacagttgtccaggacagaagagtaagactgagaaggccgtgccagtgtccaggagacagttaacctcctagctttcaatggtcaggcatacccggggctctgtgagggtgatggcatgggctggcacctgccccaggccccctcagtcctgctgctggatcatctggttagtggcttctgattcagaggaccttcatcccctggggcagtgggccttccagtgattcccttgacataaggggcatggatgagggggtggcttatttctattcagacaatcttttttaaagtgtcctcatcgaccgcactggaagcaagccctattaggcatttcatttgcccagctgttccgtgttccagagcctccaaagtccgcttgcctgagggtcatgactaaagcagtggcctttttcttatctcgtttgtcctgttctgcctgctcctcctgatctctattataaaaaaccaaggttgccaagttcaatagggtttctaagttttgctccaggcctaaagcggacttttgaagtttttttttttctaatgtctgcagctgactgagtgataaacttatcctttaagattagttggccttcaatagagtcaggtgacagggaggtatgcttcctcgatgcctcccttagtctctccagaaaggcagtaggattttcttcctttccctgtgttatagtggatatcattgaataatttataggctccttcctagttttccttagtccttctagcacacaagttagtaaatgtctgcggcaccaatctccatgttctgattctgcgtcccagtgagggtctatgctgggaactgcctgctggtctgtggggaattgttctctttcctctattgtcaccctatcattgacctgactgagataccagagatctccaaactctagggctgcagttatgatggcacttctgtcatttggggttagtgtctgatctagcagtaacgttatatctctccatgtcagatcaaaggattgtcctaacccttgttaaacatcaatatagccatcagggttatctgataatttacctaggtctattttaatttgcttcgagtctgacagggaaaaaggtacatacactctgactgggccgaattctccagaatacatcttaggggcgtttttgccttgtggggaacgtttcccatctgagaaaaaaaaaaacatagggatgtcagcacccctagtcattttccaatgagcattagtcctagagcatcctctatggtcctaatgcttattcctttccagtgtgcgtaatcacccatggacttctgcttattggagtagttacgctcaccaatgtagcagtcctgcacctgttttcctgcctttcttgaccacaaagaaaggggtccaggctgctggattctagtggtcctttaccagcgtgcccaacattgcctttgtgctcaggggtgagtcctaaagctgggctgggttcctgagtatttcataacaacccagctgccccattaagatgcattcctataaacaacagttcttatggaaattcatttcagagggtgtaggtaaccttttgagtcaggattgagatagaatttttttttttgattctgtaagtactttaaggcttggctgagtgcaaacagctcccagtttgagcagatcaattattaggcaattttcctaactctgtttccacaagagtctccctatcaattactgaatacccattgtgtttttttttttccctcaatcacctgggaggaaccatctattgtcctgtcctgaagggagttccttctaggtctggctgggcctttgtatggtaattgatatttaaatcccctgttaggaaatctgctgggttaagggaattttcagtggttaatgttatgttgttttttttttaaccgactatccctatacttcaagatttttgagttagtaagctacctttttgcttttttgacttagaataattctgaactggcgaggtgtgctcacaatgaggtttcctctaaaagttacttttctactttcttctgttagcaaagcagttgctgctacagattgaatgcatttgggtcatccgcgggttcctgggttaaggatttttgacaggaaggttactgtttgtcagtggtctcagtgttttcaggcaatgcccttgtttacactgacaacaaggtagtattgaagtgttatagggtcatggagaagctcttcaattatcaattataggttttaaatttaccctggcttttaaaggaatagggcacactgttttttctttactacttctatctctcttttctctctccctctcttttctctctctctgtctcttctctccttgacttactcaagtcgctttcatcctgatctgttatgttgttgtagacccagttccagttgttaaagtactgggtcatcagttctaaggccctggccaaggagctaagacttggagattgtattgcagaggggtaagctgggtagaaattgggggaagagagcatcttacacaatgggagagcaatcctcatagccatttacaaacttggggccctggcaagggtggtggggaacgggtcccacataactgcccatgtcgagagctatatgcctaaattgggagggacaccagggacaagactccctgggttcatagcctagatgcctaaggacacagtgtagagcttccttagatccctttggagatacaacttgctctaatacttgggagaggaaatgaaagtctgaaccattagtacctaggaggcagggattggaggaagtagattcagaggtaaagagaattttggggctacactttcaagaaagttgtggttgggacccaggatgtatgggtcagaaagaaaggtaggggtgcatgcatgggcaactgttgagtagagagttctggctgcaccatgatctcaactggctaatgctgggagttcgggacaacagctttctgcctctagttggccctcggcttccccaggaaaattgaaagcggaagctggttccaggcagaacaatgctcccaacccagaagggttgggttgttagaaagccctttcccagacagcctcacacgtgagtcttaagtccagcagccatgctaatcatttttaaccagccgacaggtgcctggtattttcctccaattctaagggaggatagtaagctaaagtggtccaatattaccgctttggaggtcccttcatggtcgctaaaatgttaccgggggtggcgggggctccttgttcttagagctcccaagatggtggtgggctgcttccaagatggtggcaagcctcttgttctctgacctggggttcttggcctcatggattccaaggatggaatcttgggctatgtggtgagtgttatagctctattagaagccgtgggtcacggaagagagccgtggaacccaacgactagtgttcagctcgattagaatgaacctgggcacttagccacgcaggaacaatggtgagcctttagcccaattgggaggggcaacgggcacctcgctggatcaggagcgcagcagacagcctgctggatccagagggatggaagtcagtggcaggtctgcgatggcgccaaatagcagtggtggatgccgagtgaaagctcagcttgagccgtaacaaacacggaccagaagagtgtgcagttgcaagatttaatagagtgaaaaaagagctcccataaaatgggaggggacccaaagggggttgcccatgtcaatgctttaaagatgtccccacgctgttttttttttttttttgaaacagagtctaactctatcactcaggctagagtgcactggcactatcgtggctcactgcaacctctgcctcccgagttcaagtgattcttgtacctcagcctcccaagtagctgggattagaggcatgtgtcaccacacctggctaatttttgtagttttggtagagacagagttttactgtgttgaccaggctggtctcaaactcctggcctcaagtgatccctctgccttggccttccaaagtgctgggattacaggcataagccattgtgcctggccccctactgtcttctttgcttacattgtttctaaaaaattgatgtcatccttctctttattctttcccttgtatcaaacatgtctttttttcccctctaactgcttttaggagtttctcttttcactgatttgtgcaatttgcttatgatgtgccttgaagcagttttcttcatgtttcttttgtttagctctaattgaacttcttggatctatgggtttattgtttcattaagtttagaaacatttcaaccattcttccttcaaatatttttctattttttccactgttttttggagccaattacacatatattaggccatttgaatactcactaatagtctgttaattttttaagttttttctccaagattttggttattttctatccttatgtcttcagttttactaatcttattaggccatttgaatactcactaatagtctgttaattttttaagttttttctcctagattttggttattttctatccttatgtcttcagtttcactaatcttatcttctgcagtagccaatttgctatattaagcccattcagtgtatttatttcaggcattgcatttttcatctttagaaatttggatttcatgttttttcttttaatatttctacttaatttttgaacatataggatacagttataatttttaatgacttttttgttcattctaacatatgtgtcagttctggccagtttcaactgattatttttctcctctttatgtctcacagtatcctgattctttgcatgcctagtaatctccaactgatgccagacattacaattttactagttgagtgttacagatttttgtactcctataaatattcttgggctttgttctagggcataattaagttacgtggaaactgtttggttcatttgggttttgctttaaagatttgtttgttgaggctcaattcatctgggaggaggtgaaaaaataaaaagagactaaagccctgtttagtctaaaactaattactctgtactattgaggcaagacctttttgagtattctaccaatgccctgtgaattaggaagttttctaggttagctggtgagaacaggctattttcccagcctgttgtgatactatttcttcttcttctttttttttttttttttttttttgctgactctttcctctacttcatgtagtttcttcacatacagtggctgataatttctctgctgaagatttaaaggggaccttttgcagatctcaagaactctctctgtaccactctcacctctccatatatattgtcctgcaaaccactgctgctttgctcacactgaactcccagctttgtcttctcaactcagggaatctgcccggctctgctagagttattcctccccatgctgtggtctgaacattctctcaagccagtaagctgaggcagtcataggactcaactttcttttttttccttcactcaggggtaactgtctttcattgcctgatatccggtgtcttaagaactgttatttcatctatttggtctggttttgtgttgttgttctaggcaggagggtaaatttggtacccattattacatctagcagaagtcttgaatgtacttgttaacaaatgttttattagggaaaacttcaagcttatataagtgggcagaatagttttgtcactgcctatgtcttcatctctaggctttaaaacatgatcaaatcagggccaatcttgttttatctgtgcccccactcacttctctccctcttgcttttttttttttttttttttttgagacagagtctcactctgtcgcccaggttggagtgcaatggcacaatcttggctcactgcaacctccacctcccaggttcaagcaattctcctgcctaagcctcctgagtagctgggattataagcacgtgccattacacctggctaatttttgtatttttagtagagacggggtttccccatgttggccaggctggtcttgaactcctggcctcaagtgatctgcctgccttggcctcccaaagtgctgggataacaggcatgagccactgcgcccagcctccctcttgcattttgaagcaaatcccagacatcatgtaagctcatctgtgaatatttcagggtgagtttctgtaggggtccctgccagtgctccacctgtgtctatcctgccttttcatttcagtgtgcctgagctgacttctagctgtcatgatctgcatctctttgcttgaaggctttccttaaagctcagaaaagccactctgccctgcgcatagtgggctggaaccgccagtgtgattggtgctctccccggcgtagccctccacatcccagctccctcacccttgtgtgagataattctatggtgtttgtctcacacctttccctaagtttctctgtgggattgcgttccattcgcccacagtggtagctgacttgataatgtcccctttatgtctgcattcctttctctgtcacatttgctctttccctggatttgtttgctagtgctgccaaaacaaagtaccagaagataggttgatttaggcagtagaaatgtattttctcacagttctggaggccagaagtcctagatcaaggtgtcattagggttggtttcctctctcctgggcttgtagatggctgttttctccctgtatctccacatggccctcccctctgcatatttctgtgtcctaatctcctcttcttgtaaggatgccagtctcattggattagggcctaccctaatgacctcattttaccgtaataacctctttaaaggccttatctctgaatacacattttgaggtactggaggttaggactccaacataagaacttgggaggtggaggggacagggttcagcccataatactcccctactggcatttactctacctctcaaatcagctactgccactcaagcccttatttcaggatctacttctaggaaaatccaaatgaaggaaacctctaaaagataagtcctcttttgaaaaaagtaaccacatttccccaaaagcactcctcatatccacacttaaggactttcccaccgtgctgtttacatgcatatcccctccggtgacggcaaggactaccttttatggatcttcttatgtaggcagttcctcagatgtaggagataccaaacgctgcttgatttgcttaactaaatgccatgagttctaatcttccttggaaacttggttatagccaaatagaaaaaaatactaactaacaaataaaattgctccttaataatgcagaaatccctgctgccttcattactagctgtttgtgcaatacccagcactcagtaaggcacatagtgtcttccaaataaattaaagtttttatgtcttaaattagggctactcactgtgatgtgggatgttgatagtggggagaggttgtggggggacagggagtatatgggtactgtctgtacttttctgcacaattttgctgtgaacctaaaactgcttgaaaaataaagtttattaatttgaaaataaatatattagaaatatagtgtcaccaattaaagttagaaacggaaaacaagactagatttaaaagacctttaggaaagacccaattttatataaaatatcatcaatctgctagtgtcacctactggtgaaaagtggctactgctgtggaaacaattctatccatttcttagtgctcttgaattttgatggttatataacaagtgttctgtaggaagtattagtaaacaataaaaattcaacaaaatagaaaaagtattaatatttatatgatatataagatgtgggtggcaagccatccaggtaccgaggcaagagaccgagggcacaagctgttccagtgtaataaaatatataaaacaacaagagttatactagatctagatcatagacatgattatatatgaatatcattaatcattagtttgtagcaattactctttattccaatattataataatcctcgctctataatcataatctaggaaaaaccaggccatacagagataggagctgaggggacacagtgaggagtgaccagaagacaagagtgcgagccttctgttatgcccagacagggccaccagagggctccttggtctagcagtgacaccagcgtctgggaagacgcctgttgccaggcggaccgtggtctagtggtagcgtaagtgtcaaggaaaaacacccactacttagcagaccgggaaagggagtctccctttctccaggggagtttagagaagactctactcctccacctcttgtggagggcctgacatcagtcaggcccgcccgcagttatccagaggcctaaccgtctccctgtgatgccgtgcttcagtggtcacgctcctagtccgcgttcatgttccatcctgtacacctggctctgccttttagataacagtagcaaaattagtgaacatactaaaagtctctgatatgcagaaataacggcataagctgtctctctcgccctctctctctctgccatggctgccaggcaggcaagggccccccgtccagtggacacgtgacccacgtgaccttacctatcattggagatgactcacactctttaccctgccccttttgctttatatccaataaataacagcgcagccagacattcggggccactaccagtctccgcgacttggtggtagtggtcccctgggcccagctgccttttcttttatctctttgtcttgtgtctttatttctacactctctcatctccacacacggggagagacccactgaccctgtggggctggtccctacaatttatgtgatatataagttgcacatgaagaggaaatatcagaaaaacaacctttatgtttacatatccataagcctcaactcaaaactaaaatcagttttgatttagggaagaaaaagttaaatgaaggcaaatggaagtatgtggaaaaggtgctttatatgatactctcaaaatttctcatacaatccaatattttaattaaaagcaatgaatcaaatgtacagctttttatgcaaaaatagcatctattcatttttggtgttagccataccccaaagtctctcattaatagcactgaattcaggatctcatgatacttcgtgttctcaaatgccttttcatttccctgcacagcaacctctgaactgtgattcagttttataacagctgcaataaactccactagaggaaggactggtctattgatgggggcctttcagttctagcttacagtcaactattgccaaatttttccttatttgttctttggacaatttttgtttgctccaggatttaatttttcaaattaaaaattatatggtagctgttttgtttgtttgtttgtttgtttttctaaatcccataagactcaaaagagaatgagtaaagcactctggcaatcagttgactatcaatctatttttaccaagtaatcataaattttccatctgctgtggaggacaccaagttggatccctatatgggatgtgagaggtgtgagatactcccttccttcttccttcctcctcctccttcttagaaaggcatataaattttattaacatatatacagggagaaccacagagtgattacccccttctttcttagttttggaaatttttcttttgaaatgatttcagactcaaagaaaagttgcaagaagaatacaaagaactcctgcatactcttcattcaaattggttttattagattatcttgatagatagatagagatggtatacatgttatacatatataaagcttatatatataatatataaaaagttttttgtaaccaccaaagaataagttcagatgtggtgcccgcttacctttaaatacttcagtgtgcttttctctagaaagaggaccttctcttagtgtgataacggtgccattttcacattcaggaaattcacattgacaataccattttcttaaagtccttgttcaaatttcaccaattgtctaaagaattttaatagcaaaaacaatttttctggtgtaggctccagactgctaggcctatatgtcacatttagttatcatgtctcttgggtctcctttaacctctaacttcctcagctgtttcaagaacctggcatatatatatatatatatatatatatatatatatatatatatattttttttttttttttttttttggtaaattataccagctagttactttgtagaatgtctttcaatttgggttgtctgatgtttccttgtgattagatttaagtatgtgaattttttcctcatttccttgaatagcttgattagatgcatttttgcattttgggcatgcatttttggcaggaatatcacagaagtcatgctgtttcttttcagttaatcaaatcatgatacatatcatgtctgtttgtcccaatccttgtgggattaaccttgatcattaagttggtgtctgccaggtatctccactgtataattactgtttttctctttgtaattaataagtaatttttggaagatatttcctcatgaagcttttgccaactaactttagaatagaattgatgattctttctgaatcaattttaattgtgatagttgccaaatggtgatattttaaatttgttattccttctgcatttattagttttccaactgtaagaaagtgattttctttcctatttatgtaatcatttatttatttatgttagtatagactcatggattcctatttgagtcaatgagttacaatccactactatcattttggtgaccaaattgtcccagatctggtaagtggaagggagctccttcaaactggctcctatgcctttttgacgtgtcctcataattttttacccacttccttactttctggcaaaacaagattctcaagttcatcatgaatttctctattccattcctgggctcagccacttctccaaggatccctggtttattttagtggagaatgatatttataaagcaagatctggtgctagatgtacctattgctactggggtgtcgctgcttctaggtcctcctgggaatcagtgcaagaaaatataaacacacacacacacacacatatctacatctatttataaaactaaattttaaaaatgagttcacactgatatcatcagttgcaagccagcattatagttcattctaaccttcctcattttccttttttttttttccttttcttgctttctttctctttctttcttttttttgtttgtgacaggttctgactctgtcacacaggctggagtgcagggctcactgcaactttcgcctcccaggcccaagtgatcctcccgcctcagcttctttgagtagccagaaccacaggcacgccaccacacctggctaatttttgtatttcgtgtagagacaggatttcgccatgttgtccaggctggtctcaaactcctgagctcaaactatccacccgccttgacctcccaaagtgctgggattacaggcgtgcccagccactgtaaacatcttacgaccatgggtggtgactggcaagaaatgtaccttgctagttttaagatggagttatttttaaaatggtgtcaccctggctctcctatgctcctgtttcccaatttgacaaccaacacgatctttctgatcagctcatccttacttaaaaaccatcattggggccgggcgcggtggctcacgcctgtaatcccagcactttgggaggccgaggcaggcggatcatgaggtcaagagatcgagaccatcctggctaacacggtgaaacccagtctctactaaaaaatataaaaaaattagcctggcgtggtggctggcgcctgtaatcccagctactcaggaggctgaggcaggagaatggcgtgaaccaggaaagcggagcttgcagtgagccgagttcgcgccagtgcactccagcctgggcgacagagcgcgactcagtctcaaaaacaaaacaaaacaaaaaatcattgcctctccagtgttcttaactaaaggtgccatctgcctaacttaatttaggaatgcctgtatgttttggtactgtttaaatattcccagctttgccactctccgtctcacaccaacatccagtcatctggaagatctttccattcctccagttctctcgtaactaaaacgatttcagacttacccctcactcccacaggtaactcgcccttaactcttcttgtagaacttaaatttcatgtattgttctctccttctgtccctcacttacttcctaaatctctggtggatgttcccctgtggtcctgttacagttattctgacctaaacagaactgatcacgttgcttactgggaagatgcacatgcaatctctagtgtatagtaggtcctcaataattactggtgactggtaaagcagccaaggcctttggactataaatcgatcttattctacgttaataacaatattagcacaggattctattcccttgctggatattatttacatttgataatgaatgaactaattctctttgacagcaaaacatgtattcagcttacagccgaaaatgcaagggaaggtacacaataagacggatccaagccctgacccctctgagctttaagccagtcaagtaactacttgttctgaaaagtattaactgtcctattaacgttaaccttcacaacacaatgccttgtgttcaactggccttggcctcaaagcactttcctggcacattccctgaatttaaagaacggtttccatacagctgagagggtcgaggcaggggtaagtgtagaagacgcaagaaatggagacaccctgggaacagaactctagactgcactccaaccgtagcacttactaggcattcgactccaggaccttgacactcgcgctcgctggcggcgagccccgcctccccactgcgcctcatctcccagacaggccccgcctccccactcaggccccgcctccccactcaggcccgtctcctcactcaggccacgcctccccgcccagtcccgtctccgtactagggcttgctccaagccctgcttcctcgcccaacctggcctccccactacggcctaaccccaagcccttctcgtccagccccgtctccacactactgcctggtcctcaactccgcctccccactccgaccccatctccctgaccagccccgcctttacgctcaggctccgcctccccgccgggtcttgcctccaaatcccggccccgcctccacgcggccccgcctccacgcggccccgcctccacgctcggcctggccccaagctcttccttcctggggcactctgtctccgcactccggcctggtcccgagccccgccccgcctccacacggccccgccaccacacggccccgcctccacgcggccccgcctccacgctcggcctggccccaagctcttccttcctggggcactctgtctccgcactccggcctggtcccgagccccgccccgcctccacacggccccgcctccacacggccccgcctccacacggccccgcctccacacggccccgcctccacacggccccgcctccacacggccccgcctccacacggccccgcctccacacggccccgcctccacacggccccgcctccacacggccccgcctccacgctcggcctggccccaagctcttccttcctggggcaccctgcctccgcactccgccctggtcccgagccccgccccgcctccacagtcccgagcccgcctccaaccctgccctgtccccacacccagcttggccccgagccacgcctcccaccccgcccccacactcccgagccccgcctcgtctccacactccggcggcgcctccctacccggccccgcctccgcgctcgggctgccagccctcccttgcacgttccggctcctcttctatcttcacgcccacgctaggccctgagcccagcctccacgtctcgccgccaactccacatcctggctcctatctctgccttccaggcatctcccagctgcacgctcgggcccggctcagagccctaagccctgcctcccggtcctggccgggtttcccagaactgcacggcgcctctccgcccaggcccaagcgcgagcccctcctccacacccgagtccgagccccgcgtcccggattcggacccgcctgcctggggcggtgctgcaccaggtgcgggtgtggcaggcgtctcggagcgccaggtgcagcttcctggtcaagatggtcgccgcctgccgctcggtagccgggctcctgccacgccgccgccgctgctttcccgcccgggccccgctgctgcgcgtcgccctctgcctcctgtgctggaccccggcggctgtgcgcgcggtccctgagctcgggctctggttagagacagtcaacgacgtaagtggagtgtcgggacccaggcgtggcacgtctcgggccgtcagggccgtcgtgcggcttcgcttgaccccgggcttgttcaccctgcctctgccgggtcagcaccgggtcccctgataccctccctgagccttttgtctgttacagccggggagcggggagcggcccctcctccggcccgacctgggctgcaggcaagagccgtcaggattgcgcatgggacggccctcgggtccgagcgctcggactgttactgagggtcaccatgcccgacgccgtggccctcattctgctctgacatgttttggctggatcaggaatctctcggcacatctagcagcatctttgggattcgactcttcctgtccggatgcagccacagtgggccacacccctgaggccgcagggaggacttgccagcgcttcagtttctgcataaacttagaaagcgggtctgccgcttccttaaaaaaaaaaaagaaagaaaaaatttaaatgagggggaaacgtgcagtagtcaccctacctctatttctctcttcttgagttcctgaatttctctacagttcctgtcacagttccgggagagagagtgtgtgtgtaggtggggcgggacttgtgattagggagtgcttgaaaggcgaatctggaggcatgagtgggtggaaactcttctttccaaggcaggctattagaaaacttggcgtctggtaattagaggagatgatgtgggagagatgcaggggcagaattatggaaagtcttgcaaaagagagacaggaagtctggaagaggcattatctccggcttctctggggtcagatgactcatccagcactgtttgggatgggtattttccacatgcatgaaataatgtccaggttctaaagatgagacttatattttgatttccttaaccagaaaaagaaagtagttccaaagactacaaatacttcccacaacacaaaagctactcagaggaacacgctgggtatctttctggatcttttaagacctagtgcagccatttcctccaggattggattcttctgggttggtgacctaatttgtgtgccagttatagtctgcacatctccattatttaatttcctgaacgggaaaaagtagaactcagtgaactactctcatggcttcctgctgctacgatagtgaatagtcaatataactatattggaagtgaatcagttgcatgcatattgttggattacttgaacatatctgtatagatctttgctaagtgtactgtgaacatacctgcaaagatctttgccaagtgtacttcttcctgcatgaggaagagaagtttgctccttgagtgctgcatgacctttaggctaattttactcctgtgtgaccctgggccgccagaagtctaaaagcccttctctcccaagagtggacttatattttccacatttcaggttgtcagaaacaggaaaggagagtggggctttctttcatttgtactgcaaatctatcaggaaattttgtttctttgtttttgtttgtttgagacagagtcttgttctgttacctaggctggagtgcagtggcacagtcatatggctcactgcagcctcaaactcctgggctcaagcaatcctctagtctcagtctcctgcgtagcgaagactataggtacatgccacacaccagttaatttttaaatttttttgtagagataggggtctcactatattgtcaaggctggtctttaactgctggcctcaagccatcctcctgcctcagcctcccaaagtattgggattacaggcatgagccactacacctggccaagaaatggttcttttgagtgtacaagggagcaaatggttgaagcaccactgtgtgtcatatgttagactggtcattgctgttgcaaagatgaattttagccacagccccttctcccaagacgttcacacaataatacggataacagatttatgagtagatagtcatatacactgtgatatacttgggatattactggagcaccaagggggtcacctaaccctgcttcctggaggagagacctgcctcagtctttttttttttttttttgagacgaagtttcgcttttgctgcccaggctggagtgcagtggcacaatcttggctcactgcaacttccacctcccgggttcaggggattctcctgcctcagcctcctgagtagctgggattacaggtgtgtgccaccacgcctggctaattttttatttttagtacaggcagggtttttccatgttgatcaggctggtctcgaactcctgacctcaggtgatcctcccgcctcagcctcccaaagttctgggattacgggcgtgagccaccgcactcggcctcagtcttaaaagatggataagtactaccttgatgaagaagaggaggggaacagagcagcagcagtgcaggaaattattggtgttcctgctacatcaagttctggcagggttgttagaggggactcaggtcaccacaagctttccatgcctgagcttggccttgagcctgaggccagaggcctcaaactcaaggacctgtgttggccaaggcaagtcatatcattaagcacagtgagctaagttcaggactggagggggtagtgaggaatgttgtggactacagattgcatgcccattctgaagagggcagctgccatttggcttcagcttactctgcatacattctagcagagtgggcacagaattgccacagctcgtttttttaagtgagactggaatccatctttttattatgtcaactaaagttttaaaaaggcctcttgtgggcccagtatatcccatttttaggttggattagacctccagactcccagtagctactttaggatgtgaatgagggagccattgaaagatcttagacataatgctaatcactatggctgctgtctaaagatgaattataggatcagatctggaggtagaagtaccagttaagctattgcagaaattaggcaggaaatgcagagggcctaaattagggcagtggtgacagagatggagaggaagaactaaatttgataaatgtttgtgagataaagtaggcatgccttggggattgggtgatggaagtggggaactggaaggagccatggcttgggtgactgtagatggtaccacctccagccaaggtggacaatgtaggaaaagttggtgagcagagaggagtgtgtctggtttaaaacaggtttgtctgttggacatctgtcagtggacatgtcctttaggcagttgggtatttggatctggagctcaaaggaaggatccaagttgggaattttattgttgttgttgaaactctgttggggaagggaagaggttaccacttgtcctatcagtgttttttgttttgttttgttttgtttttaatgcctaatcatttgtacatttaacacagtctctaactgcaggatttttattcctgagaagacattaaacaactaatcaattatttgatttaaattgtggaaaggttgtgaagaagaaagggtgctagggattatataagggagggcctggccggatatgggccacagtggaagaattcctgcagaacgggcttttgagctgggctttgaagggtgagaaggagccaactagatgaacaaagggtgaaaggaaggattttaaagtaaatttttcaggttgaccactaatcctgagggcaggaaagaatatcatgcttttctggaactggaaagttgagaggtgggcaggacttgattattcacgtcctataggctacagtaagaatttcggtctgttgtaattgcattggtaaaccataacgacttggagctgggagagggggacagttccttatcaaaagtacattcaaattgacgccaggagagcaacatgcaaatgcagtcagttcatgtcacgtctgagcagcactaatcctgcaatggcagcatcttttacctcttatgtgtcactggccctaactgagtctgctagaggccagagccctcctgatcctcagggtaactgcaggaagtagaaccatgacaaggttttaagcaagttagtgatgtgatcagatttacgttaaaaaaatactcttgtcagagagaggagtgcaaggcttagaactctatatgttgtggggtaaaacagttgcaaaaaaaactttctaacaagatcttcctgtgtttgtttttcattttagaaatcaggacctttgatatttaggaaaactatgtttaactctacagatatcaagttatctggtaagtataataaaacaataaaatactagactgggcgcaatggctcacgcctgtaatcccggcactttgggaggccgaggcaggtggatcacaaggtcgggagttcaggacgagcctggccaacatagtgaaaccccgtctctactaaaaatacaaaaaaagttagctgggcatggtggtgggcacctgtagtcccagctacttgggaggctgaggcaggagaatcacttgaacccgggaggcagagcttgcagtgagccgagatcgcgccactgcactccagcctgggcgacacagtgagactctgtctcaaaaacaaacaaacaagaataatgaaatactaatatatatataaacaacataatataaacaaatacattcatgtaaatgaatataacatatataataaactaagcaaatgttttgtttttaagtagttctaacattttaaggttttgttttgtttcagtcagcacttggttatttacaagaatggatttttctttttttttttcttgagacagagtctttctctgtcacccaggctggagtgcagtggcaagatctcggatgactgcaacctccgcctctcaggttcaagtgattctcctgcctcagcctccctagtagctgagattacaggcgaacgccaccacgcccagctaatttttgtatttttagtaaagatggggtttcaccatgttggccaggctggcctccaactcttgaccccaggtgatccacccacctcagcctcccaaagtgctgggattacaggcatgagccactgtgcatggcccacaagaatggatttttctgatcttctttcagaaaatgtaatgtgaatcattttatgaaaattataattaaagtctaatagacgaacaaaaaaaatttgttttttgtgaaatttaactttgagtctcagatttttaaaactagataaattgcttttacgaatatatgaaatgtcatgattgtgataaaccctttatggccttgaaaattttcaaaacgtacatatcctcgtaagaagtaaaaattgctggacaacattttaattagagttttaaggttgataaaagttaaaatattcattaggtagggcctgtcttttctgtgtcaatactgagataccagaactaccaaggttttttaagaatttcactggattttcattggatcgtattcattgtggcccaattcctcttattgtttccagtaacctaactaggaaaattggttgccagagttaaagtctcaggataaggagcagttttttgctgggtagagcaaactggcttctacaggatccaaagtcatgcctctttcctttcacacaacagatcatgctctgctcatttgttgggggcaattcttccttttatgggtctttcctgagggaagtcaggctagccagcagctagaaagcagaggtggtttcaagcagctctgtaatatcaatcatcagttgtgataagagcttggtaagaggaaattgaagtccaaggtgagagagaaaaaaattttggcatctgtttatttaatgaattcatgtctcaaagtctagacaaaggatttaaaagaatctcagtctggtgctgacaaaaagttatatggaaaaaaaagtaacgtcagccactgaaacagaatttgatttttaaaaatcattacaaatgcctgagatcaacatatgagtagactacaatcaagacgttgttattaacttatctaaagaaagaatgggacagcatgagggatttaagagcaaaagcataataaaactagggtttagtcaggcaaatgctggtcatgtccaacagcattgttgggggagaggttttcttgaaccatgaccacagctatgacatggggctggcagttgtggatatagcatccacctgagcctccttggtctggtgccatgctcaccaaaccaccttctcatccgtattgggcctccagggaggcatgctgaagggaaagagttgatcattactagtccagtttacggtttctgttcattgtaagtgagtaattgagtattctaatttatacatctacatggtaatcatgaaagtgagtaattgagcattctaatgtacacatctaccattgggaaagggtgagatgagaatctgtgttttcacagagccagattttagtgcttgttaagctaaggactggtcccttggatatatgtcgatgctgtttgggagatcagatatctggcttttttaaggcaacctctcttctgctgtctcattcaagtcatgtggagcctgtgctaaaaaatatctcaatgtaattcaccatattaacagaatataagaaatgaaccatatgatcatctcaaagtatacagaaagagcatttgaaaaaaattcaacacccattcatgatagaaactcaaagaaagttagaaatagaaggaaacttcctcaacctgataaaaggcatctatgaaaaatctgtagcaaacatcatactgtcagttcttcccagattgatctataagttcagtttaatcccagccaaaatccaagcaggctttttgtttgtttggtcggtgcatattgtgaatttcacatttttgagtgctggaggacgttgtagtcctttaacaactttgttctagcagacatttaagttccttgtgggtcagtttgatgctttccagttttcttgttaagttcttttaggatggttctgcagtagccttttgtctagggcaaacttaacagtgcttctgtggtgtggtctttctgcttgtcttccaaatacctggtatatttactgaggcctttccactctggctagtggaaactcaaacagttcccaactctgtgtgagctctgagaattgttgggcttgttcctatgcatgggcaggctgcccttcagccagaaactccaggggatcactatgcagatttctctttctctttatgtagcttccatctcttgggtactgtcccccagaaaatctaccagcctcagtttgttgaacttgaatctctggtctcagtttggtttcgctctttgtcattatcagcctttgagatgtctcccagtgatccttgcttcctgttattcatgatcttgtgtggtcctctaacacattttatcagagttggtctgagtgactgatagagcatggtggaaataatggcacatcccttctgaggctaagttataaaagatactgtggctgcatctttgctctctctaatcactcactctggggtaagccagctgccatgtcgtgaggacgttcccaacagagctctccttaactccagacttaatgcttttcagtctgcctatttgtgtcactctcttacctggatcattcaaaagaaaggccaaactcctcagcagggtctaagacctcatgaattttccccagcactcttctccagcttcaactctttctcctttccccagcctgtgttctaagcatagcagactattttcaggggtcatactcatgctgtgctttcactcaccctgggcatttacatgtttggtccacccttctcttcaccaggctaacttctgctcttccttcaagttacaggtctcctcctccagcaagcttacccagaacccattcttcatgctctcctgggctatgataggtgacctgctcagtgctcccttgactattctcagcctctgggactactgagagtgcctgtttagttgttaaaactcactcctccagtacctcttaagtcatagacaggcattgttcttgtttaccatcatagctcacaggatggcacacaggatggggctcactcagtatattttgaatgaatatgtgagtgagaaaaatgtttgagagtgaaataagcagtgacttagcatatcaggccactcagtttatttaattttagacttatacgtgaaatgagcagtattacagcagcttttggttaactgtaacaatttaatgaatttatctgtctcactttacagtgactttttggagaaattagctaatgttttactcattgttacattaaagtagcctatttttaattgcattctcaaaaccttaagtttatattagagtgtatgtattattcatgtaaaacaagactttctttttctaaacagttaagtcattccattgttctgggcctgtgaagtttaccatagtgtggcatttgaagtatcatacctgtcacaatgagcattctaatctggaagtaagtaaaacacaagtttttaatgtatataaagctatgaaggaaaattatgggtataaagattagctcatcaagcgaggaggctagaaatagagattacagttttagaagtgctacagattaattttgggacttatggcaataaaccaagttacatgctgagaatactacgagcttttagttgccttgtatgatatgaaaaatgttagtaaatgtttaaattcaggcacgtaggagtcattgataaagacgcatacatacaaataaatgcttaatttgcaaaagaagtttaaatatttcactttttaaaaaaattatagggaaactagaactgtattgagtacaagtagatttagtgagcacaagtagatcgcagaaagaggtgaggagaagaaaggaggtatctggggaaaggcagaggattctgagagagaaggagaaagtggctgtgctgagcaaggcttttcctgcacctggctgtgaagcctgggtttcttcctcctgggatgtgcactgggctctcagcaaggtgtttctcttgatgattctcgtgatagttgcttgggattgtttccttttcagattctctgttacctgtttggcttctaccttgaataatatatgggtttccatatctttttaaattatatatgtatatatgtatatatctatacatatacatatatgtgtacatatacctatacatgtatatgcatgtaaatacatatgagatctctctctgtcacccaggctggagtgcagtggtgcgatcatggctcactccagccctgaactcctggactcaagtgaccctcctggcaggttgtctcaggtagcctccagagtttctgggattatagatgtgagccattatagctggctttctgtattgttattagtattatatttctatttggattgaaccatgccattttccttgaactgcctttttggcttcatctctaaatattttacaccttcacactaaatacttcaatgtaaatttcctaagaacagagatattcatttatttttttcacagtataattatagaattcaaatttaacactgataaaatgctattatatataaaccttattaaaattttgcaactgggcagggtgggtcacacctgtaattcctgcgctttgggaacctgaggcgagaggatcacttaagcccaggagttaaagaccagcctgggcaacaagtgagaccctgtctctacaaaaaattaaaaaattagccagacacagtggcatgtgcctatagtcccagctgttcgggaggtttaggccggaggatcccttgagcccaggagtttaaagttgcaatgtgctgtgattgcaccactgcactccagcctgggagacagtgagaccttgtcttcaaaaaaaaaaaaaaaaaaaaaaagttcaccagtgtcccaatattgtcttttagagcaggcgcccccgctccccctgcacacacactccacaccccataccggaaccaattcaggtttgcatttcatttcctttccttgtttttgtttttagttcctgataatctggatttcccccctttttggtgtgtcatggcattgatagttttgaagtgcacagaccatttatttttgcaaaatgcccctgaatttgaatatttctgatgtttattcatgatcagattcaagttatacatttttggcaggaataccacagaatactgatttgtctcatttttggtgatgttaatttgatcagttggtcaaggacatatctgcaagattttttccattccaaagttactacttttctctttgttattaacaacaacttgtgaggaaaaacttttgaaactatgtaaatatgttgtggttttcatcaaaccttcagccacttgttttagcatcctttcatgattcttgcctgatgagtcagtcattactgtgctgattgctgaatggtgattttctagttccatactttcttcttcctttgttagcattctactataaggatgcactctctctactcccctaatcaatctgtcttatctgtcagtcatcaggtcggacttgttgatttttactttgttatataggttataatctattactgtttttatatattttgctcatattgtcccatatttggtctgtgggagccaactccactttttttgatgactgggagctgccattaaggagcctggttcattcatccattcaaggatgccaggaacctcaggtagttgtgtaaatgagcgtctcctctgcactcagctacctttgctgtatcttactgtttgctttctcttttttgtagttgaatgctactttctttctctgtaaaatctcttacacatgggataaaatacaagtagccccagaacaaagtatgttttatttctctgggaactatttcattgtagtatcttagtcagttttcttattgtaagtgtgcttgtgttatgtattactgtatctgaacacactggaatggctaaaaggttatgattatctcaattatattaaaattatattcgaaacagtttttatttggtattttattctattgcgtatttccaggtatttcaaactgaatatacttttggtattatttagacattaacttttatttatattctaggataagaagtgtgggaataaattataacatagaattttaccttatataggagctgttccaaaaacataaacttagtgttgatgaagacttttgtcattatttgaagaatgacaactgttggacaacaaaaaatgaaaacttagattgcaacagtgattcacaggtgtttccctctttgaatgtgagtatctgacttgccatgttaaagtttattttattcccagtgaatacaagtatcaactgaagtaatgttttatcggaattttgataaaggtggtatctgacttgccatgttaaaataaagtttattttattcccactgaatacaagtatcaactgaagtactgttttatcaggattttgataaaggtggttaacttgtaaatttttaggtttagtttgtttgtgtgtatagtagtacataataagtaagatacgtggctgggcgcggtggctcacacctgtaatcccagcaccttgggagactgaggtgggtggatcacctgtggtcaggagtttgagaccagcctggtgaaaccccatctctactaaaaataaaaaaattagccgggtgtggtggcatgtgcccgtagtcccagctactcgggtggctgaggcatgagaattgcttgaactcgtgaggcagagcttgcagtgagccatgattgcgccactgcactccagcctgggcgacagagcgagactccgtctcaaaaaaaaagataagatactgataccattgttccatttccttgcaacttattttggcaatatccttgcaaggttcttttatatctgctacctccaatttatctctcactcttccttctgtcaactgcagtcagacctttgcatccatcatcccatcaaaacagctctagtcaaagtcaccagtaacttccatgttgttaaatccaatggtctgttcctcttaccaaaagtcttgacttaccagcatttgacacatgtcaacactaactcctcctttatgccttttctccctaccagtgtgggagcttagattctaaaatgattaacagcagttggctgggcgtggtggctcagcctgtaatcccagcactttgggaggatgaggcaggtggatcacctgaggtcagtagttcgagaccagcctagccaacatggtgaaaccccatctctacttaaaatacaaaaaattagctgggtgtggtggtacgcacctgtaatcccagccactcaggaggttgaggcaggagaatcacttgaacccgggaggcagaggttgcagtgagccgagatcacgccattgcactccagactgggggacaagagcgagactccgtctcaaaaaacaaaaacaaaaacaaaaataaacctagcagtcagccttggttagtgagattatgaggcatttaaatttattttttgttcttttgtaaattctgaagtgaaagtctttagtaaaagttttaaaggagttctctttaaaatgtgttgaaatataataaacacagaaaagtacacatcagtgtactcctcaatgaatttttaaaaggccaggcacaatggctcgcacccataatctcagcactttgggaggccaaggcgggtggatcatgaggtcaggagatcgagaccatcctggctaacacagtgaaacctcgtctctactaaaaatacaaaaaattagccgagcgtggtggcgggcacctgtagtcccagctacttgggaggctgaggcaggagaatggcgtgaactcgggaggtggagcttgcagtgagccgagatcatgccgctgcactccagcctgggcaacagagtgagactccgtctcaaaaaaaacagacaacaaaactgagcacaaccatgtagaccctgatgaattatagaacattttagcacctagaacccccttttacttcctaacactttccctgccaatggcaacactatcctcattaaggagaaggttttatttttattttttaacttttattttcaggggtacatgtgcaggtttgttatatcgtaaactcatgtaggccgggcgcggtggctcatgcctgtaatcccagcactttgggaggccgaggcgggtggatcttgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtctggcctgggcgacagagcgagactccgtctcaaaaaaaaaaaaaaaaaaaaaaactcatgtcacaggaatttgttgtacgaattatttccatgacacaggtactaagtttagtacccaatagtcattttttctgctcctctacctcctcccagccttcacccttaagtaggcccctctttgtgtctgctgttcccctctttgtgtccattttctcatcatttagctcccacttataagtgagaacatgcggtatttggttttctgttcctgtgttagtttgctaaggaaaatggcttccagctccatccatgtccctgcaaaggacacgatctccttttttatgtctgcatattattccatgatgtatatgtaccacattttctttatccagtctaccattgatgggaatttaggttgattccatatctttggcaacgtgaatggtgctgcagtgaacatatgtgtgcatgtgtctttatgacagaacgatttatatccctttgggtatataatatacccagtaatggaagtactgtgtcaaacggtagttctcttttcagctctttgaggaattgccacaccgctttccacaatgggtgaaccaatttgtactcccaccagcagtgtataagcattcccttttctccacaaccttgccagcatctgttattttttgactttttaataatagccattctgactggtgtgagatggtatctcattgtggttttgatttgcatctctctgatgatcagtgatattgagctttttaaaatatgcttgttggccatatgcatgtcttcctttgaaaaatgtctagtcatgtcctttgccctctttttaatttttttttgttttttttcttgtaaatttgtttaagttccttatagacactggacattagacctttgtcagatgcatagcttgcaaatattttctctcattctgtaggttatctttttattctgttgatagtttcttttgctgtgcagaaactctttagtttaattagatcctatttgtcaatttttgcttttgttgcaattgcttttttggcaactttgtcatgaaatcgtcacctgtcctatgtccagaatggtatggtctaggttgtcttcatagggttttcatagttttaagttttacatttaactctttaatccatcttgagttgatttttgtatataatgtaagcaaagggtccagtttcagtcttctgcatatggctagccagttatcccagcaccatttattgaatagggagtcttttccccattgtttgtttttgtcaactttattaaagaccaaattattatacgtgtgctccgatatttctgggctctctattctgttccactggtctatgtgtctgtttttgtaccagtaccatgctgttttggttactatagccctgtggtatagtttgaagtcaggtagcatgatgcctccagctttgttccttttggttaggattgccttggctattcgggctctcttctggttccatatgaattttaaaatagttttttctagttttgtgaagaatgtcattggtagtttgataggaatagcattgaatctgtaagttgctttgggcagcagggccattttaacagtattaattcttcatatccatgagcatggaacatcttttttttttttcttttttttgagatggagtcttgctctgtcacccaggctggagtgtagtggcgcagtctccactcactgcaacctccacctcccgggttcatgccattctcctgcctcagcctcccaagtagctgggactacagacgcccgccaccatgcccggctaattttttgtatttttttttagtagagatggggtttcactgtgttagccaggatggtcttgatctcctgacttcatgatccacccgcctcggcctccaaagtgctgggattacaggcatgagccactgcgcccggctgagcatggaacatctttccatttgtttgtgtcatctctgatttctttgagcagtgttttgtaattctcattgtagagttcattcacccccttggttagctgtattcctatgggattgcattcatgatttggctcttggcttggctgttgttggtgtacaggtatgctagtgattccccccccgcccccccgccgccgccaccactgcccactctgtcatccaggctggagtgcaatggcgcagtctctgctcactgcaacctccgcctcctaggttcaagcaattctcctgcctcagcctcctgagtagctgggattacaggcacctgtgaccatgcccggctaatttttgaattttttttttagtagagacggggtttcaccatgttggccaggctgctctcaaactcctgaccttaagtgatcctgctgccttggcctcccaaagtgctgggattacaggagtgagccaccacgcccagccgctagtgatctttatatattgattttgtatcccaaaactttgctgaagttgcttatcagctcaaggagcttttgggcagagagtatggggttttctagatatataatcatgtcgtctgcacacagggatagtttgacttcttctcttcctatttgggtgccctttatttctttctcttacttgattgctctggccaggacttccaataccatgttaaataggagtgatgagagagggcatttttgtcttgtgccggatgtcaagggtaatgcttccagcttttgcccattaagtatgatgttggctatgagtttgtcataggtggctcttattattttgagatctgttccctcaatacctagtttattagagtttttaacatgaaaggatgttgtattttatccaaagccttttctgtatctattgagatgatcatgtggtttctgtctttaattctctttatgtaataaatcatgtttattgatttgcatgtgttgagcctaccttgcatcccaggggaaagcctgcttgatcatggtagattaactttttgatgtgctgctggatttggtttgctagtattttgttgaggttttttgcatcagtgttcatcaaagatattggcctgaagccttcttttgtcatgtctcttctatgttttggtatcagaataatgctggccttatagaatgagttggggaggagtccctcctcctcaattttttggaatagtttcagtaggaatggtaccagctcttctttgtacttctagtagaatttagctgtgaatccatctggtcttcggcctttttttggttggtaggctatttccatttcagagtttcttattggtctgttcagggaatcagtttcttcctggtttagtcttgggagggtgtatgtgtccagtaatttatccatttattctaaattttctagtttgtgtgcatagaggcattgatagtattttctgatggttacctgtatttctgtgggctcagtggtaacattccgtttgtcatttctaattaagtttattggatcctctgtcttttcttctttattaacctacctagcagtctatctgattaattttctcaaaaaaacagcttctggattcattggtcttttgaatggtttttcatgtctcggtcccctttagttcagctctgattttggttatttcttgtcttctgccagctttgaggttggtttgctcttgcttcactagttctttgagttgtgatgttaggttgttaattaatttgagatctttttaactcttcttcttttttttttttttttttttttgagacagagtctcattctgttgcccaggctggagggcagtggtgcaatctcggctcactgcaacctccacctcccaggttcaagtgattctcccacctcagcctcccgagtagctgggattgcaggcacccaccaccacacccagctaacttttgtatttttagtagagatgaggtttcgccatgttggccaggctggtctcgaactcgtgacctcagatgatccacccgcctcagcctcccaaagtactgggattacaggattacaggtgtgagctaccgcacccagccaagatctttttaacttttcactgtgggcgtttagtgctgtaaatttccctcttaatattgccttagctatgtcgcagagattctggtatgttgtatctttgttctcattagtttcagagaacttcttgatttctgccttaatttcattattcacccaaaagtcattcaggagcaggttgtttaatatccatgcaattgtacggtttcgaaagattttcttaatcttgatttccaattttattgttgtggtctgagagagtggttggtatgattttggttcttttgcgttttctgagcattgttttatttctcattggctgattttagagtatgtgccatgcagagatgagaagagtgtatattctattatttttgggtgaagagttctgtagatgtctatcagctccatttgatccagtgttgagttcaggtcctgaatatctttgttaattttatgcctcagtgatctaatactttcagtcgggtgttgaagtctctcactattattgtgtgggagtctaagtctctttaaacgtctctaagaacttgctttatgaatctgggtactcctgtgttgggtgcatatatatttaagagagttaagtcttcagttgaattgaaccctttaccattacataatgcccttctgtgtcttttttgatttttgttggtttaaagtcagttttgtctgaaattaggcctgcaacctctgctttttttctgttttccatttgcttggtagatttttctccaaccctttattttgagcctgtgggtgtcgttatatgtgagatgagtctcttgaagacagcaaaccaatgagtcttgcttatttatccagcttgacattctgtgccttttaattggggcttttagtgttgacattgtgggtttgatcgtgtcatcatgttgttagctggttattacgcagactcatctgtgtggctacttcctagtgtcactggtttgtatacttaagtgtgtttttttagtggctggtaatggtctttccatatttagtgcttctttcaggagctcttgtaaggcaggtctgaatgaattccctcagcatttgcttgtctaaaaagggtcttatttccccttcacttatgaggcttagtttggccagacataaaattcttggttggaatttcttttgtttaagaatgttgaacataggcctccaattctcttctccttgtagggtttctgtggagaggcttaatgttaatctgatgggctttcctttgtgggtgacctgacctttctttctaggtgcctttaacatttttcttcattttgaccttggagaatctgatgatttatgtgtcttggggatgatcttcttataaagtatcttgtgggggttctttgcatttcctgaatttgaatgttggcccctctagctaggttggggaagttctcatggatgatatactgaaataggtttttcaagttgcttccattctcccatctctttcaggagtgtcagtgagtcatagattccatctctttatataataggggcaatttttcaaaagcagaactttgttacttgtgtttgggatacagtgagatttgttctttgatgtttagctttttaatttttcatttttcttctaactttttttcttaattattaaaacaatttttctccgtagaaatgcagcagtataaaatggcattatttactcttttttccagaataaagaactaataaatatcagaaatgtttcaaaccaggaaagatcaatggtaagcagtttgatttgtctttaaatcaaatatacacaagttaacgtaagactgaaaaaagtcgctgatggatagatacttagagagtgatataaagtagggttattagaactgtggaaggaaaaggaaacattatttaaaaccgtatgttttcaggccaggtgcagtggctcctgcttgcaatcccagcactttgggaggctgaagcaggttaattgcttgaggccagcagtttgataccagcctggccaacatggcaaagcctcatctctactaaaaatacaaaaattagccaggcatggtggtacatgcctgtaatcctagctacttgggaggctgaggcatgagaatcacttgaacctgggaggtggaggttgcagtgagctgaaattgcaccactaaacttcagcctgggtgacagagcaagactctgcctcaaaaaaaagttttcttatatatgtctatatgaattttgtatatactgttactatctttgtctaaaaatatccttaaagcaatttaagatgcatttctatgcagcctttcttttctttaaaaaataaaattccccctctaaatgtgcaagacagcatagcaatgggctgtgcgtgtcattaaggatttaaagaaatagaaaccatgaatgtagcatgtgggagggaaattttggcattctggggaattactaaaagttagaagactgagtaagaggtcgaaagggatgggagttatgtgtagggactgaaaacaggtttgggagagcttaatgtttgcttttatactatgactcttcatgttttctcttcaaccatcctaaagaagtctgataatggaaaggcactcgctctgcagtggccaggacaaactttgtacaaaatctgtcatatgatgaggagtaggaaatgaaagaaacggataggaaatattcaggaaaatggagtataagaagtgtgatccagttatgggagggcactggagaatttacaagcattacagtgggaagttttattccttagtggaattgcaagtaacatagtgccttaagaaatttgaatcatttagcttatgtacttaatctgagtcatttctgacaatgttatctaacttcctcttcccccaattcaatttaaaaaccacacattaggccgggtgtggtggcaggtgcctggaattccagctactcggaggctgaggcacaagaattgcttgaacccaggaggctgaggttgcagtgagacaagatcgcaccattgcacttcagcctgggtgacagagcgagactccatctcaaaaaataaatgaataatgaaaaccacacatttaaataaaacaaaatgtttgataaaattaggataaaatatgagaagagtattgttagaaaaaagaggtttttttgagacacaggcttgttctgtcacctaggctggtgtgcagtggtgtgatctcagctcactgcaacctccgcctcccaagttcaagcgattcttctgtctcagcctcctaagtagctgggactacaggtgcctaccaccacacccggctaatttttgtatttttagtagagacagggttttgccacgttggccaggctggtttcaaactcctgagctcaagtgatccacccacctcggcctcccaaagtgctaggattacaggtgtgagccaccctgctcagccctagaaaaagttttttattgataatattaaacaatttatagattggtaatattagagggaacctgtaaaaatataaaagatagaaaacattgaagaatgagaaacgcttctttcctcctttacctttttaggtctggaaggatggtgtttaaaaaataagagaaatagctatctttccactacctgccattccttttctgttttgtgtgtgtgtgtgtgtgtgtgtgtgtgtgtgtgtgtgtgtgtgtgtctgtgtgtgtgtttaaaagaaacccaatatgactggacatagtggctcacatctgtaatcccagcactttgggaggccaaagcaggaggatcacatgaggggtcaggagtttgagaccagcctgggcaacatggtgagacccccatctcaaaaaaaaaaaaaaaaaaggaaaaaattaaaaaatagaaaaatttaaaaagtaacccgattcaattactttaaaatatggcaaacagttgttcagctatattacatagcaatttgttaaaaataatgaagaatttttttcacctctatttcaggatgttgtagccagaacacaaaaagatgggtttcatatctttattgtttctattaaaacggagaatacagatgcaagctggaatttgaatggtatagttaaactgcatgcatgtttactgtctgcattttctgtattctgtatttttgtcactgacctgagtcaacattctctgtttcaaatacatcattcaaaaatgaatttctgttaatcatacatttattttagatacttaaaatgtaacattaagttatcttattgctactatttattttttaattgatttaaaattttactgtgttaagataaatttttaaaatttcaaacttcatagtgggatataaaattctccattctttcagattaaaaaaatttttttaacatgtagaaatgtgtaggcaactttttagttgtgtatttcaagtaggttatgttctctgtttcttgaaaatggccatcatcagggatttaagatttttattatttgacaaattttattttaaaggatctgtctgtagcctaggagtagaagcagcatatctgccagcatgtgcttctgtggtctgtgaggcacccccaccactgtaagttagaccctctgtgccttgttaagctgtggttccttagtgccacaaaagtagacttgcaataagcagttttcaagagaatgaatgctttcccatattctagaatcactttggctgatgttttccatagtgggtgtgtctgctggggccagcagtagccaatcagcatgtgagggccctggggatttgatactgctctgattcagccagtcagctggcagaaaccaatgaggtgaggtaggcattgctgcagaggaggctcggtctgttgtactgcatggcccttggagggaagctggcaaggtggctgctctggaagagtgtgaggtaaggcttccttctggagatggcatcatgagccagactgtgccaagtagagggagcagggaccctgatgccattctgtcacctatcttagtctgtttgtgctgctataatagaatacttgacactgggtaatttataaagaacagaaatttatttccccacagttcttgaggctgcgatgtctaagatcaaggtgccaccaagtttggtgtctggttaggtccctggtgtctgcttccaagatggcaccttaaacgatgtgttctcacatggcagaaaggatagaagggcaggaagcacaaaaggggacaaccactctgctctcacggggtggaggcagaagagcaaagaagggcctaagctagttccctccaggccttttgtaaggcattaatctattcatgaggacagagccctcatgacttaatcacttcccaaaaggcctcacctcttaataccaccacagtgggtatgaagctttaatgaatttttgaggacattcagaccatagaactaggcttgtgcccacttctttcccaggcattgtgtcttttcccctgacaccagcgggcagttttgagcccctgctaattagtagctggagctgtcactgagccctgcatgttttgcactgtactcggcacatggtttattattgctatctcagacaaaacccaacctagatgtgtgagtttggtaatttattccaagttacgtcaaggaagataaggtcccggtgagatgagtaaattagcaagggggccagtctgaggtcttgtttggtagctgggactactgtgctcttgtatatgatcagatttggcacaggtttttagaatagcgtgtatacaagtagagggatctctttttttctttttattgtaaattgacaattacatatgacataaatgtatggggtacaaagtaatgttataatctataaatacagtgtggaataattaagtcaaactagttaacatactcatcaccccaaatgcttaacattttttgtggtgagaacatttgaaatgtactctctcagcaattttgaaacatacagtactctgttaactattcaccatgctgtgcaatagaactcaaaaaaagaaaaaacttactcctcctgtgtgagatttttttttacccttggaccatcatctgcccatgcctcctacctcccagcctctgtacccaccattctgctctcgtattaggagttcaattgttttagattccacatataagtgaaaatgtgcagtatttgtctttctgtgcttgactcatttcactcagcacagtgttttccagttccatccatgttgttgcaaatgacagaattttcttctttttaaaggctgaatagtatttcattgtgtatatatacacattttcttcatccattcatctgttgatggacacttaccttgattccataacttagctattgttcatactgctgcagtgaacatgggggtgcagacagctctttgacaaactgattttagatcttttgggtaaatagtaaagtgggattactggattatatggtaattctgtttttagttttttgaggaccttccatactgttttttataatggctgtactaattgacattttcacaaagcatcccttttctccacatcttcatcagcacttactctctttcatctttttgataaaagccattctgacaggtgtgaaatgatattggggttttaatttgcatttctctaatgactagtgatgttgagcatttttcatgtattaatatcttttgctcatttatatgttttcttttgagaaacatctaggtcccttgcctttttttttttttttttttttgagacaggagttcgctctgtcacccaggctggagtgcggtggcacgatctcggctcactgcaacctccacctcctgggttcaagtgattctcctgcctctgcttcccaagtagctgggattataggtgcacgccaccccacctggctaatttttctgtttttattagagacgggtttcaccatgttggtcaggctggtctcgatcccctgaccttaagtgatctgcccaccttggcctcccaaagtgctgggattacaggtgtgagctgtaacgcccagccccttgcccattcttttttttttaattttttttatctttttttattttttgagacggagtcttgctctgtcgcccaggctggagtgcagtggcgtgatctcggctcactgcaagctccacctcctgggttcacgccattctcctgcctcggcctcccgagtagctgggactacaggtgctcgccaccacgcccggctaattttttgtatttttagtagagacggtgtttcaccgtgttagccaggatggtctcgatctcctgacctcgtaatccgcccgccttggcctcccaaagtgctgggattacaggggtgagccaccacgcccggcctgcccattcttttaattgggttttttgttttcttgctattgagttgtttgagcttatgtattttggatattaactccttcttggatatatggcttgctaattttatctcccagtacctaagttgtctatgtctactgttaattgtttcctttgtgcaaagaagctttttatattgatgtaatcccatttgtctatttttgcttttgttgcccgtgcttttgggatcaaatccaaaaaatcattgctcagaccagtgttatgtagtgttctccctatgttttcttctagcagttttacagtttctggtcttacagtaaaggtatcttggtaaggttacataatcaaacaaatactaattgtccaataccatgtatgtgctacatacaaattcagcatttgttagtgtggtttgtattcttggagccttctgggaaatgaacttacatttaaagatttaagactgactgttaattaactctctcttcttctctatcctagtttctctttctatgattgggcctcatggatatatctctgcatcagattggcccctaatgattgtgagtatttctcatcattttttcctttttaaaaaatgaattttataccctaagagctttgtggtagtaattcctcagtagttaatgctttgacatatcctgtatttctggttccagagtgactggaaaatgaagggttggatacttgaatgtagaagtgccaactttcaaatgaccaaaaggcttaactgactaaaattgcttctcttcctacagttttacatggtgatgtgtattgtttatatattatatggcatactctggctgacgtggtctgcctgttattggaaagatatattaagaatccagttctggattgcagctgttatttttttgggaatgcttgaaaaagcagttttttatagtgaataccaaaacatcagcaacactggactgtcaagtaagttttgactgtctctgtaaatatagtatgatctaagagttccccagtatttatgagcagagcagtgggaggcccccttctgaacagtggtttggaaacagatatattatagatgaagagaaggaaagccaaggaaagaatgtcagagtaggcctctgatctggccaagcatgtgtcttctcttcattatctgttttccttcttgctaaatttcccctcactttcctcctgggaaaaataaaagtcccgtttcctaaggttcagcttggattaaaacagcacaaagttcgggacagggagacttcaggtgctgtcaatccttttaacatacttctccttccccccacatcttcttttctttctccttctccttcaaaaaacgaaaggaaattggccgcagggagtaaaatcaggggtgctggaagggatggtgcctgcagcctccttgtgctctccccacctctttactcccacaaagatcttcatataaccagtggaggcaccatcacagtttacgcagtggaatatgtgaagcaggcaggccatacagctgggcatcctcagatgtgtgccccagacttctagaaagtggatttcaggccagagaagtaaaggtacaactctcccaccaaagctttggaaagagagagctcagagaggttgaaggtgctcaagagtgtacttctgagtgaccagttacaaatgatcttggtgcagatcttcaaagggcatgattttgtctgttattgattgattgacaaggtcttgatctgttgcccggtctagagtgcagtggtgcgatttttgctcactgcagcctcgacctccaggcccaaatgatctgcccacctcagcctctggagtagctggcactatgtgtctgttacttattttgaaatactctagaaaaaaaatgaattggactatagatgaaacaaatttggcgtaacgttgctaattattgaagctgcatgatgggcacaagggaaatcattatattgctttctctctttttgggagtatttgaaatttccccaaataaaaagtttaaaaggacatgtaccaaagaataaagaaaggacaaacatccaggatgcatattagagatatcactactctgtaagaagttttttatggtgtgtgtgtgtgtgtgtgcgtgtgcgtgtgcgtgcatgtgtgctctaaaccagatgatgaaggaagggtagatctgctgcttagaattgaagcattcctgaatgtagagaaggcagttctgatgctttgctgtcagtggtggtgatctcttgtttagtgaaggtaaagggtggcatggactttagtgaggagcagcaaaaacctgagatccatgaagaggtaagaggccatctgccatcctcagggaatctaagctgtctgagatggcactagagggcttggaagagatacccagaccgctgtcagggtctttcaggagtcccgtccaataggagaggtgggcaggagctgatgtcctttctgattttcccaagtgggaattctgtgacaggggctgtcttgcccagcattgatcttgaagcatcaaatttagaaaaatcattagaaggatgagaagcattgactgttaggacccgacgtgggtatgttaagaatatcatgtcagactaatttttttgttttgggatgctagattgacaggaagatgtagtaaacttagtatagctgacttcttcaaggcatttgacaaggtctcttgtgacttcttgtggacaagatgagctgaaaactggtggtgctgccatatctaaagagttcatggagataatcactggtcagtctagaccgctgctgttttctgtggtagccacaagccacatctgggtacttaagtaaaattaaattaaattaaaaattaagttcctcagttgttctagcttcatctcaagtgctcagtagccacaggtgaccagtgactgctgtattggacagcacagaggtagaccacttccatcattgcaaaagggtctgtgggacagcactggtctggagcaatggttctcatccctggttttgcatcagcatcacttgaagaactttaaaatggtaccagtgccagagagtctgattagggcagacctaggaagtggggctgtgtagaggcttccaggtgattccaatatgcatctagggttgagaaccattgagctaggaggctttgaatggtgtctctctcagattttaggccttgttgctgttttattcttcttgtgaatctgttggtttgttcaactaacatttattgtgtgactatgtagacagcattctcttaaattttgtggatgatgtgaggctggccagggtcgtaaatacttaggggcatagagaatcattttagatagacccttttcacttgaagatatgtgatgagaggcaagagagttgacatgctgaatagaaaggtgaaatctgatgatcttgaacttaggtttggagtacaaattgcaaaaataccaatggaaaagttttaaaaagaatttaaaaattgaagctgatgaaaagcaaactcaacataggcaataatagggtagttgcctcccacaagctcccacaacctcagattgcagcaggagcctggaaggaaagttgagaatcttgctgtacaggccacactgtaccagaaacgttgtagtcacattacctcaagaggagtatagacagcccatggagggattgacagcacactcatccctcaacatttgtgatgataaaccccttctttacattctgcactctttcggagagctcatccattgttttcctcctaaagctttctctcctgtggaactctctatcctgagctacagacatatatatccagtcacctacaaaacagcttctcaatgccttgcaatcttctcaacctctgaatggcaaaaagggagctcatcctttctgcctttgtgtggcggtctcgccccagcccacacttgctgcccttccaggtgttcctctcgctgcatgatactgccaggagacctcaggaccatctttcacatctttcttggcttcttgctctgcctgtagttctagatctatcttcgaggcatttgacaaggtctcttgtgagttcttgcaggcaagatggagctgaaaacagtgtgaactgaaaacatcagatggattcacaactggttttgccaccatattttctgaatatctttctgaatctttctgcttctctctgtgatcactgccggtactctcatcatctcttagttttctggaatagtctcctgagcattttccttgcctgcagttttgttcctctccaaaccattgtaggtagagcaatcttgataaaataaagccatccattttattccagcagtcagcacattttttctgtcaaggccatagaggaaatattttggctttgcaggccatatggtctctgttgtaactattcacccttgccatcaaagcataaaagcagccatagacaacatgcaaacaaatgagcattgctgtgttcccataaaactttatgttcaaaaacagatcagatgtagggccagatttggcccatgggccatagtttaccaatccctcctttgttcttttgtttattgttattgacttcccactgcccttaacatcgagtccagactccatgacaggggctccaaactgcatgattggtccctgcctttatgaccagcctcttttcttgacatctaccattacactctctgctgcaggcataatgaactttgacttcttgcagcatagtttgcttttcctcttttcttctctgtgcctttgcacgtgccgtgttctttgctttgtcatcccccacccccaaatacttaactcctacttagccttcaagtcctgatttagatgtcactttttctgagtttttcaggacccaattctagttcccccaggtgtagattagactggccttcttccaagtctggagggatgatgtgttacctcttgctcttaccacactgagttctatttacttagcctaaccagagtacaagctccatgaaggcagggatcaagatgtctttttcactattatagccacacagtaggagcatatcagatacattttaaatgaatacatgatgaggagatcctggagaaaagagaactctagaggatgttgtggtttttaaatatttacaggacaagaagagagagttctgtaaagagcaagaacagagggaagctcagggagacagtgttcgggctgatagaagaaagctgtgcccagtggagcagattagatagatagggagtgaattcttgaggcgagtatgaatccttcactgaagttttcaagcatcagttggattcagtgacttttaaatcaaatgtggctgattggtctgaagttcgaatgtagttatacacaggacatgttgttgagaatcttggttggcaggcttccaggtgtagacaaagtgaattattttatttttttcttcctcagcccaaggcttattgatatttgcggagttgatttctgcgattaagaggacgttggctcgccttctcgtgatcattgtgagcctgggctatggcattgtgaagtaagtactggcgtgtgggaaaaatgctgggtcccagcccagtgattcagtccgtctacattatgacctttgtgaaaatggaacttctaagtattgtagtacaaatccctttgggaaaaatctacaagaacacatttttaaaagatttccacatacttgctattttatgttatcttccaataaagaccctgaatttttatttcaataactttatatagttagatgaataaataatcaactttaaggataatggaaaatctaaaataattcaaaccattttcaaacccttttctgttatttagacagtatcattaagcttttatggtcctatctgagtgttggaagagagagtggattaaacaccaagtcagcaaaacttctgactgaaacctgtctgtccctcaaggactctgcttctggaccttctccggcgggtcttttcctcctctcacctgtgaatcactgggcataactatgggagaacttgatttctatccttgttgtgttttttcagacctttcttcctgcttctttcctaaaaccctgattcccagaagctcactcttcaggctgggtcacctgctgcatcttgttgtggtcactgtgagcttccagaccctccctcattcctcagctctgtgggcactggcttcacaggtgtcgtcctcagcatttcatctgtcagaaggccatggggtctcaggagccatgtgcatgaccctttaagtaacctgacctcacctccccacctctcctgctcttgcccatcaccatgtttcagctactgattcccagtatcattttctagactttattatatatataactgcaccctcttcaaaatctcaattttaagcaatccacttttcaactgtcaacctcctctgtttcctgttactttctttaacatgtcggtgtcagtctttttcgactatactttggcctccagccttttgaccctggcaccttccgttgtccctccccatcttatatccttaccttcttccttttgcttggattccctggtccagcaggacattgacacccaaagacccctgcctttctctttgtcaaccttcttgacaaaaccccagccttgctaagtccagctttccttctgcctcaggctcccacccgagcaggggaatttgcccaaaaagagccctggaccacactgagggggcctacttgccattcatgaccctaaacttcacgtgcaccctcagtgctgctggcagttgtactcaatccccttgccactattttctcactctcctgtctgcagaagaccattttacccctttctctcagactctaccctgaccttcggtttttttttcactgaggaagtagaagccatcagaggggaattccactgcatctgtgcccccagaccctgtcatttcccccacatctggaccgcatgaaccactttcctcttcttgatagtcacgggccacccctgcctttgtgcccactcaactgtgagggaaactgtcctagtgctcggttttgttttttcttgcatcgtcagctttcctctctggtgggtcacccccatcagcatctcgttatttctaccattttttaaagtgaagccctccctccaccccacatggccctctcctccacttctgcctcattcacctttcccctgtgcagcataacttctcacatgagtagtctgtacctcagcctccccagtattgctctattgagactgctcttgtcaaggccaccatgacctcacctgccatatcacatggccctgctcagccctcgtccagttgtcccgtgagcagctttaaggagtgccagctttgcctggtttctgggagctcgtcttccatcctctcacatcactggctactcctccccagcctcctctgctgcaccctcctgtgttcctgagctccggcccccgggggcccaggctcaggcctctgctctgtgactcgcacccctaggctctcctcctgtgtgcgtgcccgtttgcttgtgagctggggattggggagttagcaggattttatcctggaagcctttatccccctggacttttattggagattctttctcaaatgccttttgtgttcttagtacagtgtaggaaatgaaggcctcttgttgaggaatcttgcagtacctttcacagctctggttatgaacatcagataccaacaggtgcagtgttgttactgtgaaaggaatagaagattaaatgaatgggtacagatacaaaccctttttaaatgaatcccttcactgttagcttgctcggctcaactcataaagtgagagcagtaacagttctggttatttggaggttctggttagttgattataatgaatcagaatttagattccttagattaggtaaatagtcttaattaaatatgagctatgaccactaacttaattttttacttatattttgttttgaattgactatcttaaatatttttttaaaccagtttttttcttctaattactctgagaggagggtttttgagcagccttaaatgtatgtgcaataaattctgatttgcaaatatcatgaaattattctattttaaattattaattgcaaaaaccaccatctttgtattttcccaactcaattatattttgaaagagccaaaaaaaattttttttgttgtttttgtttttttggagacaaaagtctcactctcgctcaggctagagtgcagtggtgcgatcttggctcactgcaacctctgcctcctaagttcaagcgattctcgtgcctcaacctcccaagtagctggcactacaggcacgagccaccacccccggctaattgtttgctttttttggtagagaccgggtttcaccacgttggccagtttggtctcgaactcctgagctcaagtaatgtgcgtaccttggcctcccaagatgctaggattacaggcatgagccactgcgcctcgcccaaaaatgttattttaactctttcagtttaaagaatgaaaatgaaattctgttagcactcctgttctggttaagagctggtgatcagaaaggaggtcatggacttccatctcctcatgtcctgctcttcctctgcccaagtcatgagacaagtgaattatctctgaaaagacagacctcaggaagaattaagttagacttctcagtggcacttagaagttggcatttaccttcctagatttcatcaacctactcttccattctatagaaacagtacctgaattatattcattctgttgcttgaatttcagcagcaaaatcctctggcacctttgtggcctccaaatattgcttcaaaggcatcagtatagcttcaggtcctagagaaagagaccctttgttcctgggcctgtttcctaaaacaaagtacctcagagccgggaacagactgatgtgattagatagtgacttcctggtattggaaatggtgccagttactgtattcaggtgcattttactcacccatgctttttcttctttctctgtttcctcttcctgattccaggcctcgtttaggaacagtcatgcaccgggtgatcggactggggcttctatacttaatctttgcagctgttgaaggcgtgatgagagtcattggggtaaaaactacattattctaccacccctttttgttattgctgtgaaatgtggttttactttgtatctcctgagatgaatttttagatagaaacttgtgaaaaaggcccaatttgaacttttcttctatgggatgtttcccttttaaaatacttcctgaaaggcaaaggctagacagagtgcttcttaaaatgatatgactgattgcgaaggcaccgcttgatatcatcccaggtatcagtcccatcccagaaaggttcatggttgttcttcatagagaacatttgtctttatcattatgcagctggtataccttaatatcattcttaaccctggattttaaaatgtatcaagtgaacagaaagttaattacacccttcaggtatacatacagtacattccatcactcttttaagtctcatttgtttattcattttctctgactcttggggactagctattttgaggattcagtagaccccaccattggaaaagcctagaggaagtgatgttcaaggggaagatgactctggatgtgggcagcagcactttattctctagagaagtatcagtatttatgtctgcaaagacccctagatttctagcttcagtttttttacttttattttgtgcggttttttgtttggttgtctcattggttgattggttggttggttggttggttggttggttggttggttggttggttttggagacagggtcttgctctgttgcctaggctggggtgcagtggtgcagtggcgcagtggcatgatcatggctcactgcagcctccatctcctagacttaagcagtcctcccacctcagcctcccgagtagctgggactacaggtgcaggccaccacaccagactaatttttgtattttttgtagagacagggtctcactatgttgcccaagctggtcttgagttcctggctggcctcaagtgatcctcttacctcagcctccctaagtattgggattacagatatgagctaccactcatggttgcttcagttttttgaataaatggttgaggattgagtgattaagaagcttattatatcttacctaatccaaagacctttgtcattttacctaaaatgtctttggattagctgtataaatcagatcataaatatttatccaatagtgctaaaaagcctcattcttctccctgttgtctttgatacacctgcattctgtgttagatgctcttttagtctttgagtatatttatttccacgtttgtatgatcatgaagaactctgcattcatataataataataataaatacttgccagaaggaaatagaaaagataaatatcccacatgtaaatacaccatatatattgtattcctttaaaattgtacatagctttgtggcacacgcctgtaatcctagctacttgggaggctgaggcaggagaatggcttgaacctgggaggcagaggttgcagtgagctgagattgcgccattgcactccagcctgggcaacaagagcaaaactccatctcaaaaaaaaaaaaaaaattttacatagccaacatcttagatagtgacttttaaaggtgactagtcagagtaaatgtctaacatggatcccccccttcactttttctgtgtcccttcacaacacagtcaggaaagatcgggagttcgtttcattaatagccctggctgtcggtttggtatggaggagagagattgaaatggctggtgttagtgaggttggggacacgatgctttttatttgccattacataatacagttttatgttgctatcatcacataaattagcacttgttgctatcaaaaacaggtcatttccatgtgcttaaacacaatcctcttaggaaattaaatcttttatgtggctttgtaaagtaatgagataagctaaattatttttcttcatcaaatgataattgctatagtgcaatgaaagtgttacattcaggtttcttcccttatttttatctttcagggttctaaccatttagctgttgttcttgatgacattattttagcagttattgactccatttttgtgtggttcatatcctttactgtgtccttcaaaatagtttgttgtatcatgaaaatcagattacatgtaatttgtaataacaatagaaagaaatacagttatgcatttttgttaccttaatacgagggttcacttgaaggtgaaaaagtagcaactacccaaacaaggaatatctttattttttctatgtagtttagcaaacagttagtgctcattctcagtatgtgccccatactgacgaggcatgggtgaaaaagatgtccctaaatttaagggattcacagtcttgtaggggagacagatacataactggcatcagtatagcagtagtagttgccatcttagagaggtgctgtgccaacaggggaagagagaagttaatgctggcataaaaatcaggaaagacttcacagagatggcaacatttaaattgagactgggaagacaagtaggggtttactattaataaggaggtaattagggaagaggtattctaggaagaacggaggggagcaaatggttgaagcaggaaaacagagggggacagtggcagaatgtccagggaagcctgcctctgggtggacatgcatgggagagccttggcaggcggttcagggaagggtggcagggcatgctcaagagctgagtgccttccagaggcaggggctggagaggaattgaagctgcacaggtgagtaatgtgatgaaacctgtgtcagtgagaactctggtgacagaagaagatgacgtgggaaaggagagtctagaggcaggaaggtgagtcagtattcctttgcctttgcagtggtcgaaagaagagatggtgagggtcagaagtagggtaggggatatggaaagaagaacccacgtgatagacttgctagaaatgggtggaagagagcaggttcagagaaggtttaggggctgcagccatattgcaggagaagttttagaggcagtaagtactggatcctcgagggtcttctctgattcgatgactcaagttgagtctggggaatcccattgctttttcttcatgggggcacttgtggaaatgggaggaattctagagaaaatgtgactgaccagagtggaatgcagggttatgcatatcccagaacattctttggatctgtttctattatatttatgtcctctttgaagtgctttcctgttagataggtttcattttttgccaagttctttgtttcctctgtttttgatacttatgtcttttagctttttgacattaatttttttaaaaaattgtttttcttgtatctttttccattttctcatctatgtgtctcataggaagggccagagggcttggatctcatcactatgccctagaaggaaggtctcccatttttcaggtgtgctggcaaatgtagcactcctcataggcttttctgagccacttgtgggttgttttctaagctgggtctacctattctttaaattccctgtttgtgaattctcaatatgcttccaacttaaaaagcctatgaagagtgctacaaacctaaaatttgtaattcattgtcctcactcgtcaaagcagtgattcttaaccttgtttgggtactaggatcagacatgccttggaaaatctgctaacagctgtggagcctctcttcacagaacacagacacaaggagctttgcatgacagggcagttaaagacttaccaaattatatctgtggacatcttaggagtctgaggagcctacttagggaataataactgatctaaagagttgtttctgactgaacttgtttaaaaaagcatattctactttgttcagagctgctagttcagaatccaagtttgttgaataaaattatagttaaataaatctgattttctcagagagtaatataaatatcttcctctggtgtcattttcatattttctatgttaaaaaaaattaaagacattcatttgctaaaaatgtgaagtctgttcctcagttctacatgtgagcagtgttccagtgataagagagagtactcaccacaaagtctgtaggtcccacaggactgcttgttaaggggactctcctgccttgagaatgggcaggaggtataaacataccttgcactgggataggcagaatgacagtggagatgaacctgcctgttgacctcagattatctttagatcttactgtcttattttctgtcattgtgtgtttagaaaatgagctgattatatctattcaatttagaattgtcttgtttctaaaaccgtgtatgcttggaactttaacaagttagggagtatggtccttcattcaattaattaagctgcagactgcgttttttaaaaaataaactatcttttctggtaatttatagatatttatttcaaagatttcttgttctttttttttttttttttttaagacggagtctcgctctgtcaccaggttggagtgcagtggcgtgatctcaactcactgcaacctccacctcccaggttcaagcgattctcctgcctcagcctcccgagtagctgggactacaggcgtgcgccaccacgcccagctaattttttgtatttttagtagatacggggtttcaccatgttggccaggacggtcttgatctctttatcttgtgatcttcctgcctcagcctcccaaagtgctgggattacaggcgtgagccaccgtgccctgccgatttcttgttcttaaccatccacaaggtagttcattgggaaaaacacttagtaatgcagcttggcagaaaattccaaagaaaagcagctctgatggctctaatccatctggatttgagtgggggtaatttattacctttatgaacagcattgactttcacacattccagtatctgattagtcagattggggtaggaaaataaggaaaacagatgaaagacttagtttgcttaattatgaatatttataatgaaaatgtttcagggaatagtcaaagaaatctaaaatgtgaaagatctttagtgtttcatggtgagacaaaggaagtctagtgtctatttctgcatgagcctgaatttgtgaagtttgctgtcagattgctctttggtaatttttatcactaaaatgaaatgtctgctttttctatacagaaagatagcagatttcctaaatgatataaatgacaagaaaaaaaaaagcagaactaaatacgtatacaattgagtgctttggaaaatgaccctgcttcctttgattttgatgaacttaatataaccaatcctctaagaatctaattctaaagtcataggaaaaaaaataggctgaaaaattcaaaagccatagccttagcctttctcctgtggcccttcctcccctttttttcttcttgtttctctttcgtttctcttttcttttctttctttctttttttttttttttttttttttttttttttttttttttttttttttgctgttttgctgcaggtgagtgattctgatcttgttcttctggccagcctccccctctctctccttgactctggcttgtgctggtggatatccttttcctaccacagcagcgcgctctcacttcaggatcagaagggctatttgttttcatgactactttccttccatggcaggaatgatttacactttacctaaatttaacagtgtcttggtaagtggaggcttaggcaatttcaaatttactttttattccttagcttaaaaacatttttttaaaattattaaaccagaccagatttttttttaatcctagaaatttggttttagtcaagaattgttaaaagtatatgttttgatgtatttaaggaataaagtatatttgcatttttaaagttctcatagtaacctgaattggttgtattgtattgctttagaaattgatcttttgtaatttgttggtcatttagaagattaaaaagcagttttgtactaaagtactaaagtagctttagtactaaaatgaagttttttattaatgacatatttaaaatttttaaaacttgccacatccattctgttgctcagctctgttatttttagtgtttggttcataaacaaagcttgttggtctgctccagaggaaggaattctcatttaagagcagagagagctggcttgaattctgcttcactgctgaggagtcagtggaaaagtcttctttttgcttcttcatccttggcaatgttgaacttcacctgagccctgtgctcctggaaaacagccaagattaagacacccccctccaaacccccttccctatttgtgttccgagaaaagacttacctcagagaacccccttccccactggacttaggtaagactcctggaggcccgcttgtctacctatgacaaggccgggcacagaccctctgagttcccattccttgcatcacgaataattagatgaactctttatatccactgatcgatctgaacaaaacactgaaccaaactgtaagtattcttcttcctccaggccataaacgttgactcaccgtcagcctgagccaatacacagccctcccgagaatctgcagacctcaggaaaagacattccctcatcggtgtgtctagtcccaccactcactccccacacctactgctttttatccttgtttgctgtgctctataaaagaaaaacccttttctgcctgacctctgagactcttgcagatcttatagtcgtagtattcttcctattgcagtaatcctcccccgttgcagtcatctttcaaataaagcccttaactaagtccagatttgtttcatctgatgaattttagttttaaaatttataaaatggaattggtagatgacctaacctcttaattatggttattcaaataataaaatgagaatagactggaaagatcaaaataagatagaaatagggccagaaaagcacaagccaaatggcatgtcacaatgtgatctgtaaagagtgtctcacttagaggggttttagtgcgtgcactgctctatcccgtgttgcgggtgcatggcattggtggaacgcatcatgggtcttccgtgttttttccttggagtttgttttcttagttcagacaatggtaaattgtaaaagaaaatctgtgataaagtataatgattgtacaatattggccaagataacattttctgtgttttcattagcttcaaattttaggaactgtatttagcagtactgactttgggaacatagtagaagattctgttttttttttttaacctcttattattacttggaatgtttttccttaacttttttcacatttttattagtttggcacaaactatgaagaccctaaggctaagaaagaacactgtgaaattttcattatatagacattttaaaaatactctgatctttgctgtgctgggtaagctatttaatttttcttacagtaaattatcttagtattgttatattccttcaaaggtgactttttgtgtgtttcagcttctatagtgtttatggggtggacaactaagacatttagaattgcaaaatgccaatcagtaagtataaccttcctatttaaacagttatttttatttatactattttgtagaattttgaacaatttagtttatgcttgcaaatagaggtgattttaatggagatttatgtttttactttgaactattttttacagagttataaaaacttttggctgggcgcggtggctcacgcctgtaatctcagcactctgggaggccgaggcaggcggatcacgaggtcaggagatcgagaccatcctggctaacacagtgaaaccccgtctctactaaaaatacaaaaaattagcgggtgcctgtagtcccagctactggggaggctgaggcaggagactggtgtgaacccaggaggtggagcttgcagtgagctgagattgcaccactgcaccccagcctgggcaacacagcgagactccatctcaaaaaaaaaaaaaaaaaaaaaaaaacttttaactcctccaagtgagtctgaaaaagttcctccgaaatctccttttcctattatgcccttttgtcaagttttttttatatattttgaaaataaattctcttcctgtataccctaacaggaaatccttttcttcctgcacaccatgaaattgagtggtttgtatctagatggactagaaatcttaagactggcatgtttctaggatcgtgtgttcagtatgggcattcgagcgatgttttcttttttttttttgagatgagtctcactccgtcagccagtctggagcgcagtggtgcgatctcagctcactgcaacctccgcctcccgggttgaagcaattatctgcctcagcctcccgagtcgagtgatgttttctatgggttctcatgttggaagaagatatattcttagacttagaatatgaaaggtcctcttttggggatttgttgagatttggagctagtctctagtgccatataaataatcacaaaaagccctctgaaaatccagagcttttgctgccttagagacaatttaataaaagaagaggctgggccttctgaccttagtatttgccatttgaaatcctaagtatatgttttgcatcttttgattttgaaatctttctgttaacccaaaaattttatggcagggaatatttgtaacattaaacaaccctttagaaacattttgaacaatataggtttcttgaaaaaatatgtgcttgtttatttggaagacttactggttggaaagatttcattagtacttgtcattgtacattatttgaatgggaaacctatatgcttatcagaaaattaacgtttcatgcttgaattgtccttcttttaggattggatggaacgctgggttgacgatgcattttggagcttccttttttcgcttatccttattgtaatcatgtttttgtggagaccatcagcaaacaatcagaggtacctaacataggaaatttcaagtcgtcaaggatttgttgatcaccttctatagtgtcaagaacacgtttatagaaaccaggagaatagtcgttgcttttaaggagtatacagtcaagtagggagataagcaaaacaaatgcaagacagtgaaaaaagagatgtatagactagtccaggggaagatggaagagggttgaggaagacttcttgaagcgacagcgcttacattacaccttgaggaaaggaataggatagcgaatgactgaactgggaaagagtgtccattttctggggtggtgggaaaggcatgagatactttggaggccagtgagacatgcagtttggttaataccacatactcatattggagggagatcaagctggaagggagaagtacggccaaaatgacaaaagacttgagtgtcaagttcagaaagttgtacttgagactgcatgtgataggaagcctcagcttccttgctttatccctttgccccaaggagagaacttaagttcttgtccatcctttaggaaaaaatgaaaaagtatgtacagattcaacatcccaaatcccaatccagaatgctacaaaatccaaaactttttgagcacggacaggatactcaaaggaagtgctcattggaacattttgaatttcagattttcagatttgggatgctcaactggtagggataatgcaaatgttccaaaatctgaaaacatccaaaactcaaaacacttctggtctcaggcattttgcataaaggctactcaacctgtatcagtgtgtttctcctgtcctttttaaaattatacaataatacatatatatatatatatatatatatatatatacacacacacacgcatatacatacacatactgttctgtaccttcctgtttaaggtcacgcctataatcctagcactttgggaggccaaggtgggtgtatgacttgagcccaggaattcgagaccagcctgggcaacaaggcaaaaccctctttctacaaaaaaatacaaaaattagccaggtgcggtggtatgtgcctgtactcccagctacttgggaggctgaggtgggaggatggcctgagcccaggaggtggaggttgcagtgaactgagatcatgccgctgctactgcactccagcttgggcaacagagccagaccctgtctcaaaaaaaaaaaaaaaaaaccacaaaaaaaacaactatctttccatatcagcatgtatagatctaccacattacttttaatggttttatggcattttataacatgaatgtaatataatttatataagcagtccctggttattagacattttgtttaaaaaatagatttttgctattatcaataatgttttcagaatgctgttggacatcatcttggcaaacttttgttagtgtaatgtaaggtaaatgaatttttactttaatggctattgccaaatgaccctccagaaaggttgtcttgattcacactccatcagcagtattttgagcttatcaccctaggaaatgtggcccattcagtgggctttattttcaccaatcagattagcaacttttctttttttaggaaataaactgacaagtggtgggcagagaggtaaacctgacatggagaaagaaacagcagaaagttcccttccctcaacattaaatattgcaaaattgctttgcagaaagattttacccacttatgcttttacaaacagggtttgagagctccagtttcacaatttcttaatgataattttagctaatttgaaagtaaaataattacgttttcattattttaaagtataagaaattttttaaatgtagattttttatacaatggcttttagatataaactgaaaattgaacaagtttaaacatactagtaaaactactccttgtttttgctatagatatgccttcatgcccttaatagatgattctgatgatgaaattgaggaattcatggtaacttctgaaaatttaagtgagtaatatgttttctttttaaatgaccattgtacatattgcaacagaaatattgtacctttacccgtgatgcaaggtcacatatattgtttttttctataaaatattttaaaaacttttatcttcagaaaccttattttggtagacagtaacagaaaggtcagtgatgaaattttcaagactattgtagtttgagcttgttactcatttcgtaaaatgttgaaatagttacactgtttttcataagaatggtttgatgtatattgtgcttagctgctaaataatgttcatcttgatgattgctaagtttctttgagttgcatcttcttgctctttttaaagtatgcacacctgtaatttctgatcatgctgaaagcatttctacttaaagttttaatgatattttcattctttctgttattttctacatagcattttatcattttattaattttattgtaatctaattaagcatctgttaaggcaacatcaataagtaactcagatgttgagggtaattttatctttgtttcatttttttgtcctcttacttttgcttctcttagtaacattctttttcaccttctgttttggttctctaatacatcgatgaaatagaaaacaggaaaacaaatagaaaaaaatcatcaaatctaaaagtaattactttgaaaagcttagtgaaaagtggcttaacctctagctactctaaaccagaaataaagaaaaaactacagtggacccttgaacaatgtagggttaggggcaccaaactcctgagcagttgaaaatctacttataacttttgactctcccagaacttaactactgatagtcaactgttgaccagaagccttactgttaacatagttatcacatattttgtgtattatatgtattttatactgtattcttacaataaagtaggtggagcaaagaaaatgttattaggtagaaggaaaggggaggcagcaaaggcagacatatgtggtgtaacttttattgaaaaaaacttgcatgtaggtggacctgagcagttcaaacccatattattcaaaagtcaactgtagtacagtaagacaaacttctaatgttggaaatgatagagaggacattactatggtaaaaaaggtaaataaggaaatattatgaacaattttatggtaacaaattgggcaatctggatgaggcagacaagttcattgaaaaatacaagttcattgaaaaatacatataacaacccaattttaattctaaccctgtgccactaagtctgaatagctctgatctattagaaatttaaaaaaaatttttttaatttaaaatcttcctatgaagtaccaggcccaaatgattcactagtgagtcctttcaaatacttaaggaagaaatggaagaaatattctaattttacacaaaatctttagaaggtaaaggaggtgggagtacttaaaaggccagtacaattgaaatgccaaagtctaacagacgttacaagaaaaaattatagaccaaaaattatagaccacttatagaccaatatatcattaatgagtgggcatacaaaaattctttaaaaatattagcaaataaaatctagcaaaatatagaaagacaatcatgatcaagtggactttatcccagggttgcaaggctgttttaacattccgaaaatcactcagtataattcatcatattaaaatagtacaaataaggctgggtgcggtggctcatgcctgtaatcccagcagtttgggagactgaggcaggcagatcacctgaggtcaggagttcgagaccagcctggccaacatggcaaaaccccctcttgactaaaaatacaaaaattagccgggcgtggtggtgtgtgcctgtaatcccagctacttaggaggcagagacgggagaattgcatgaacccaggaggcagagtttgcagtgagccaagccactgcacgccagcctggacaacagaacaagactctgtctcaaaaacataaataaataaataaaaataaaaataaaatagtacaaataaaagaagaaagaagaaaaaaatgacaaaagtatctcagtgggtacaaataacaaaagcctcagcaaactaattctaaaatggtatgaaaacactccacagttaaaattctatttaatggtgaaatagtgaacactttcttctcaagattagggataaagtgcaagggtatgtacataccactttgattctgcattgtatgggaggtcctacctagtgcagagaagcaaaacaaaactccaaagaatgtgaaagaaagaacatgtggaaaggaggaagtaaaactgtgtttattcgcaggcaacatggttatgtatggaaaaatcccaaggagtctaaagaaaagaaaaagtacggtagaactaagtgactgtgacagtcatagggtatatgtccaatgtacagaagtcagttgtttttctacatattaactgaaaacaattgaaggtgaagtttaaaatgttatttaccataccttcaaaaataaaatacttggaataagtttaatgaaaaatacgtaaaacctctgcaatgaagactataaaacaatgcagagataaattttagaataagtaaatgtagagatagaacctgtgtctgaattggaactctcagtattaagctctcagtttcccagtctgataaatagattcagtgcaatcccaattataattctagctgacttaaaaaaaaatacagtggttaagttgattctaaaatgtatatggaaaagcaaaagacgtagaagatccttaacattcttgtagttacaacatggatgaaccttgaaaacattatgttaagtgaaagaagccaatcacaaaagaccacatactgtataattttgtttatatgaaaggtccagaacagacaagtccgtagaggcggaaagtagatcagtgcttgtcacaggttagaggagggggaaagtaaggactgactgctaatgggtttggggtttctttgtggggtgatgaaaattttccaaaattggagagtggtgaatatctcaaatctctgtgaatatctcaaaatctaactgtacttcaatatggtatgcgaattatctctcaataaaataaaattagtggatttatactgatttcaagacataattatttcagattacagcaatccagacagtgtggtattggcataaggatagagaaatccatcaaggtagtaaaatagagtccaggaataaacccatgcatgtgtggtcagttgatttttgacaaaggcaccaaggcttacatgaagagaggatagtctttttaataaatggtactggaacaactggataaatgtgtaggaaaaaaaatcattagacttttgttgcacatctcacaatcaattcaagatggatcacagacctaatggaaaagcttcaactgttattcttctagaagaaaaaaggaaaatattttaatgacgttggatggggtaatttcttaggacatgaaaaacagtaaccattaaattaaaaaatgagactttatcaaaatttaaaatctatgctcatcaggaagaatttaagaaaataagaaggctagctacagtgggagataaaatattctcagtacatatatatctgacaaagggcttatatccagaatataagtagaattcctgtaaatcaataaatgataacctatgttgcaaaaaatgagcagaagactagtgtagacacttcaaagaagacataggaatggccaataaacccgttaaaaggtgctcaatataatcagtcatcagggaaatgcaaattaagaccataatgagctgccaccacacatctgctagaatggttaaaattaaaaagtctgatagatagcatgaactattggagaggatgtggaacagctggctctctcatacagtacttgaaggaatgtagaatagcatgaccgctttagaaagcaatgtgacagcttcttacaaagttaagcatatacctaccatacagttcaactgttccactctaaggtttacccagaaaaatgaagcagatgtctacagaaacacaagaatgtttacagcagctttattcttaatagtccaaaactggaagtaacacaattatctacaaacaggtgaaaagataaataaattgccatatatccatacaatggaatacttttcagtaataaaaagtaaccaacactctataacataacttaatctcaaaaatgtttatcttgcatgaaagtgttgcatgatttagatgattatctaaatcagagcagtggttgcttttggtgaggtggggattgaccagaaaggaacttaaagaaccttctgtgataatggaaatgttaactgtattgattggcatggcagttactcaagtgtatatatttgtcaggtttcttcagactgtacacttaaaatttgtaatatatatatatatacacacacacacgcttcagtgttcaaaaatcactgtattccccttctaagagaaatgttggggttttgaatgtcccaggaaaacatttttggattgaggaacctcatttttatttattacatcagcttatgttataattgttctagtttatggagaagcaatatttgcaaattagtgtaataacaaaagtgactacttactgggcatagattgtgtgtcaggcattttatatgtgctaacttgttcaatggtcactagaactctatgaggtagaaattattattatccccagtttatagtcagaaacactaagtcacaggaagttaattgccttgcccaagattccagtgaggcagacacttagcctttgctccactgaaactgcaaacatgcagaagagccttggtcaaatatgaaagaaatcttgatctttcctatcttctttatgccatacgcacatttcaaaatttgtacatcagggatgtaaagcatacccaaagatgtgttttgttcttgaatgtaccatgaatcctgaagatttttaaatccataaactttaaaataattgcaattaaggaaatatgtatgcatgtatacttgtttaaactctaaaactaggattcaaacaagaaacttgaaaacctggtggttctgacaaatagtttccaaaaatctgtgaacttttttcatatatttttcctacattcccaaatggtaaatccagcatcctgcctaaagtttccattattaaccctccatttctaaaaagatatagtattttttcttatcagattattaaatttctaaaggaaaatattattttgtgattttatatatatgtttataatgtctctcgtagccgaaggaataaaattaagagcctcaaaatcagtttccaatggaacagctaagcctgccacttctgagaactttgtgagtatggtatatatttagtacaatcttagtcttccttagtcttcactactttagagagctatacgagtgtcatattcattgactctcagaagaacagtttttactaagattttgttgttgttgttataaaaattagtgttgccaagtgccaagtagcaatcctggttgtccataactgaaataccttcattgtagatctcacttctcacctgctgttcctaggccagcagcatgagcatcatctgggaacttgttagagatgcagagtctcaggcctaccccggacgctcctgaattggaatctgctttttgaaaagattccatagcctgttcatctgcacattcgagatgggaaagctttgttccaataaaagcttgtgttaacttttcagcctatgaaagtgatttttgaagccattttaaaataacatttgttatctgttggtaaagaactttatgtgttacctacacggttaccaaaattaacagattttttttttttttgaggtgggaagcttgaataaaattgtaaaacattgggcagagatgagctaaaaaatattttctgcatgttatttatgcataaaaatgtttttgaagacaacaatgtaaaatggaaatgtctatcatatagttttatactttccttataactatatgtgctgtgattaatactatgtaaaaatttatgtatgcatatataagttctgacacgatagataatatgtgaagacattttttatctgttagatttggcagattctctaatagattagacagatggataaataaacaagatggataacatagactggagggatggatagaaaggatagatggatggataaaatagatagataggtagttagataagatagacagacatagacagatagctatctcagctgacctgctttccttttcttgcctcctgtagggagatgagcataaatgagtgatacaaataaataggcttttctaaagttagaatatttgagatcaggcccggtggctaatgcctgtaatcccagcactttgggaggctgaggcaggcagatcgcttgagctcaggagttcgagaccagcctgggcaacatggtgaaaccccatctctactaaaattacaaaaagtaggcggatgtggtggcatgtgcctgtcatcccagctactcgggaggctgaaacaggagaattgcttgaacctgggaggcagaggttgcagtgagccaagatcacaccgctgcactccagcctgggcgacagagtcagactctgtctcaaaaaaaaaaaaaaaaaaagaatgtttgtattatcatcattttttttaaagttataaactcattatataagaactagaacaaattaggaggcataatgagtgtggcaaagcaaaaattcaatatccttgctattttctatcttacaaatgaactttgtgtttttactgtgatttctcaggacaaaaaaaataatatttcatacatccaactaaaaccaagaagtgtagaaatctgaaatctaatttttgcgtgtgtaagaaaacagtggcataatttctgtatggcatgagtgccaacttaggacatatgtagaaactaaaagaatgtcaaatatttacatttaaacacttaagttatatatatattctgttttaaaaattctgctgtcaggtgatattaagcaaatgctaagtataaatatttctacaggatgaagatttgaagtgggtagaagaaaatattccctcttcattcacagatgtgtaagttatcttctgttacagtttgattgtaaattttaggctgtagtttaaaagggatcgttctcatcctttgtcatgtgcttttcaaacctcgtacttgcatgtacttgggtaagcccctatcaccagtacatggcccttacagaactgcaaagaaaacaaaaccctggcttgttttgtttttcacgatacagcaaccattttaaaactagtggcctctaaccaactctagctttttctgatctgccattatcaggatcatttcattttttatctattatggaaaacgtcaaatgtatgtaaactttttttttttaaaggtaaccacagcaccatgtattgtgaggaggcttttggaggaaaaacatgagtataggaatcccctctggaaactttgagctattcaggatcctctttatctatgttctgtttgacacaagaattccagatagctgtttccatagtgaaaaatagaatagccaagtatgataaaatttttttacatattggtctttccctccctagcccccatctggtttctgtttagatagcttctgtgtactatgatattccttttgcctgaagaattgcctttacatttctttcttgtagtgcaggtatgctggtagtgaatctgtcagatttttgtttgtctgaaaaagtctttgtttcacctttattgaagaaatttttgtgggaatagaattctttgttgaccttttttttctttcaacacttaaaaggttggtcacttgaatgtcttctggctttcatagtttcagaaagatgtctgctttagttcttatctgtgttcctccacatgttatatgggttttgtttgtgtgggttgaggtttttttgggtgagaagggctggggaattgtctgccttcaggattttaactttatctttagttttcgtcattatgaatatgataattctaggtttgtgtgggcatatattttcatttctcttggctgtatacctaaagtggaattgctagatcatatggtaactctatgtttaacattttgaggaagtgccaagctgtttttcaaagcagctgcattattttataatcctatcagcaatatatgagggttccaacttctccaaactttttgttaacacttattattgtccacctttttgattttagctcttagtgactatgaagtgatatgtcatcgcatttatgagttactggaatgcaaactgccttgctggggactagtgttaaatatatttaactatggaattcaaactgtcttgttgggggactagtgttatttaactaaactgtgataactgaaattaatgtataaatagtctgtgcaaagtaagaactgcctattcattatgaaactaacaatacactgttatacttttttattttagcagtcagaaaaggaaaatatgggtgtatatattcttttatatttcccatgtatttactttttcttctttctttcctctatatatgagctaagaccttcctcctataggtctttctttaatatttcttataggataggtctgctgacaacaaattctctcaattttatttatgtgaaaatgtatttacttttccttcctttttaaaggatagttttgctggatatagaaatcttgattgacttttgtttgagcacttccaacatgtctttccaatatcttctggcttttgttgtttttgaggagaaagtagtcattaattgtattgttctcatgtgtgtgatgtgacatttatcttttgctgtttttctgatttttcctttatatttggctttctgcattgtgtttatgatatgcctaagtatggtcttttttttttttttttttttttgtctatcctccttggaatttgttgagcttctcagatccatgtcccatggtcattttccagtgccttcagctacttttttttttttttttttttgagacggagtcttgctctttcacccagggtggagtgcagtgcagtggcgtaatctcagctcactgcagcctctgcctcccaagttccagtgattcttctgcctcagcctcctgggtagctgggattacaggcaggcgccaccacacccagctaattttgtatttttagtagagacggggtttcaccatgttggccaggctggcctcgaactcctgacctcaggtgatccatctgcctcggccttccaaagtgctaggattacaggcatgagccactgtacccggctagctacttatttttgacattttggtccaggttttgtcagtgttttttgtggaagggatcatctgaccttttctgtccagctttacttgctctcttgtattgcaatcacattctctgtgatccttttttccttctttgtttcattttctatgttgttttcctaccacacattaagatttctgttgaatttattctcccttgggtgccttgtacttttctgcatcactgcactggaatcatttttgtctttttctttaattttttttctgattatgattgattctttgaatttcttcatgctttgtttttatctacttctgctcttggtttttagatttcttactgtagaatgtttttaatattgccaaatgttctttttaagttattgtatttaatttggagtattgtgtgttataactatagttttcttctactgtaaaatgttttgattttcattttccttcttttttctttcctgcactgttatatggaattgattttgttttcccattctgagagcttttatgatgaaggttcctggtttgagtgcctttttccatcagtgcgcatgaattgtagtttcttttatggatgacgttgatggtatggagtaggagaggttggtgttgttttatttttcttttatttctgcagaccttctcccaccgccccccccaactttttactgtcttctttttatttactacacgatcacatctccaaggaatattcttcttttttatatatcatcctttcctgaaaacaatgatcgttcaagggtgctgctttttgtcccactcgatttgagccccttccgtgtagcaggtgctgtgaacttcttccaagtcactggttttattcagtctgttggcactaagtgttgggcttttttggaggggttgaattttgtctacggttgtctgagtcctcccacccctctactatttttcctaaagtctctcaaccctctgtttccctactctgtgtacccatgagcttgcagtcacagcagggaatctgttggaatttgacatttatttctctatttacatataatttcaagtttgtggtgtttttttggtaatgctgaaggcatgtgtcttttgtggttttgtttgtgatccttagtaattttatggttttttgagcaagactatatggagagattcaaattaggtggccaccattattttccagatttggaaactcataactaagcattttagaaggaaattatttaagcaggcttacctcctactgtgccatcacttcttgctggaaaccaataaggctcctaggtagttctctttgcatgtgaggaagtcaccattctctactatttttttctgtagatagaaatatattcttggttacaaaaaatcctttgaaatatagaagactgaacttcttatttgatgtcttcatgaaccatttatgtgaaatgagtagagctctataatctaagatgatttccaaaattttaggttcttgggaacctttgcttcttcacttacgaaaactttaacacaagaaatgtagcccaatactatccaaaattaatgtacaatttacatagcaagtttagtatttagactttaaacacagagaaaagccttccccttatacatctgtggaaatggaacaaaaattttataagtcatgggacattttaaacagatcatgaataaccacatgatatgtattatgagatattggtatgatattcactgtgaatttcctcatcttcgataacccatgaaggtgacattagcatagcttatctccctctttaatgcactgaatcgttcttaataagttttaagtagtcattaacgtcatagcagggaccgttgttgatattgctagtgtttagctctaaacaaggtgccaagcgtgtagcagactgccttctggttcacctttcctctaacgccgtcttctcccccatattttccttaatcgtattattccaaacagtctgccttgcctccttcctcacacctagtcagtctcctggccctcctggcttcaccatggaccgcactgtaggtagcatcctctggcgttgtgcgtggctctttcatggcaaaactttggaacttggacatttccttcaggctctcctccctcagacctctgtcacacattgaggctagattaaacttacttaacatttgttacattcgtcttttctttatatctatattatctttgttgagcaaaagttctgttatataacacttctctctggtaccctttgctggcagacatccaggcagtggtcataatgacacagaagttaagcaaatgctggattctgtaaataccgcctttcataatgtgtttactcataaatgggttaggtccgcaataaaatttttggatgagcacatttgtgtaatcgtcacccagatcaaaaaacagaataacactaagtgctctaaaaagcccatttcctatttccctttcacatcaggagcccactttcccaaaggtcctgctgtcctgaagtctacaactgtagattatttgtgtcaggttttaaaatgttatccctcaatagatcatccatttgctttgctgtatagtattccattgtctgaataacccgcaatttacccattggggttattttcagttgagtgctattgagaacagcactgctgcgaaaactcctgcatgtctgtctgcgagcctagatgctcccttctgtcacctgtggatacccaggagtgagaattagtgggccatggcatgtgcctgtattcggctttcgtggatacactggccttactgttaacaacattatcacctttttttcccttttatttcagagctcttccagtgttagtggattcagatgaggtaaaatatatttttgcatatttccttggagctgatattttcacaaagtagagatgtatttcagaaagaagttctgaaagctactttttaagattattataaattgaacagacagaaagatgctatgaattgatttgtgggtaaagttgaaaggatttatgaataaagtccccatttcaaacaagaacaagataaatacttactggtatgaaggaaatgaagggttattttatgaaatcttgagtttaaacgattttaagatggcagtttgtctaaattaatctctgatacttgtagacattttgctgagatattaaagtttcaatctcattttcatttactaagcaggaaatttggatagaggatgtggatttaggaaagtttttgggaaaaaaattagctgtggatcacttggacattaagttgtgtggcacaaggcgggaagaaatctgaagtgtaagaattaaagactggatgcacggaacattaactttcaaaaaggacgagtggagggaagttagtggtagctaagttgtaacttgtatggtggctgtagcacataagaggggccagagctgtatacgttgaaagagaaggaaatgattttggcatcagtctgttatttgactgtactgggatgggaaggtttgagaaggccttgctgcaaaacagttaaacttcaagattcataactctacagaaagatgtagcattacagaaagattcataactctacagaaagatgtagcattacagaaagattcataactctacagaaagatgtagcattacagaaagattcataactctacagaaagaggtagcattacagaaagattcataactctacagaaagatgtagcattacagaaagattcataactctacagaaagatgtagcattacagaaagattcataactctacagaaagaggtagcattacagaaagattcataactctacagaaagaggtagcattacagaaagattcataactctacagaaagatgtagcattacagaaagattcataactctacagaaagaggtagcattacagaaagattcataactctacagaaagatgtagcattacagaaagattcataactctacagaaagatgtagcattacagaaagattcataactctacagaaagatgtagcattacagaaagattcataactctacagaaagatgtagcattacagaaagattcataactctacagaaagatgtagcattacagaaagattcataactctacagaaagatgtagcattacagaaagattcataactctacagaaagatgtagcattacagaaagattcataactctacagaaagaggtagcattacagaaagattcataactctacagaaagaggtagcattacagaaagattcataactctacagaaagatgtagcattacagaaagattcataactctacagaaagacgtagcattacagaaagattcataactctacagaaagacgtagcattacagaaagattcataactctacagaaagatgtagcattacagaaagattcataactctacagaaagatgtagcattacagaaagattcataactctacagaaagatgtagcattacagaaagattcataactctacagaaagaggtagcattacagaaagattcataactctacagaaagaggtagcattacagaaagattcataactctacagaaagatgtagcattacagaaagattcataactctacagaaagaggtagcattacagaaagattcataactctacagaaagaggtagcattacagaaagattcataactctacagaaagaggtagcattacagaaagattcataactctacagaaagatgtagcattacagaaagattcataactctacagaaagatgtagcattacagaaagattcataactctacagaaagaggtagcattacagaaagattcataactctacagaaagaggtagcattacagaaagattcataactctacagaaagatgtagcattacaggaagattcataactctacagaaagaggtagcattacagaaagattcataactctacagaaagaggtagcattacagaaagattcataactctacagaaagaggtagcattacagaaagattcataactctacagaaagaggtagcattacagaaagattcataactctacagaaagaggtagcattacagaaagattcataactctacagaaagaggtagcattacagaaagattcataactctacagaaagaggtagcattacagaaagattcataactctacagaaagatgtagcattacagaaagattcataactctacagaaagatgtagcattacagaaagattcataactctacagaaagatgtagcattacagaaagattcataactacagaaagatgtagcattacagaaagattcataactctacagaaagatgtagcattacagaaagattcataactctacagaaagaggtagcattacagaaagattcataactctacagaaagatgtagcatgtagattaaaagtactttaaatgcccctttaaaaggaattttatgctacatctttctgtatttaaagttttagtaaataattcatttgtaatttcaataatacattaatttagtaaagtgaggcaaatctctagatgagctaggcctaagaaatccattttagctctattcctgcctctcattggagattctgaacttgacatgttttctagctagcaggaagttgaagttttctgaacttctcagcagataactgactatacattattggagagtatggattatatggttattttttaatttttaaattttttataaggatgaggtctctctatgttgcccaggccggtctcgaactcctagcgtcaagcagccttcccgcctcggcctcccaaagtgctgagattacaggcatgagtcactgtacttggccttttattttctgtatgtaatatttccatgtatattatggaatatatttagtttccctaaatgtggctgttgaaagattagaaaatttttgttagggttctggaagtagtatcaacatgttgatacatatcttctttttttttcttcaggaaatcatgaccagatctgaaatggctgaaaaaatgttctcttcagaaaagataatgtgattggaacccgtataagaaatgtagttaagcctgaaggactatccttcatcaagactgaaagtgagctttgatttgatattgcctaaaaatttttattgtgttatcttggaagtctgtgtatcaaaatgaagaattcagatggtaggaggttctatagtccttttaaagctgactcttgagtgtcagttgaatatccattaaattggatttggaaataacctgaggaaagtattatgataaagatctgcacagatgcctcttagctgataggtggcaggcctgtgggtttgggttctccctcttttctctggaacatatgacaattccagattaaagaaaaatgttttttaataaatacccttggtctttcttctagtcacctttgaggtagatattgtgattttctggagtatagtatatccgtgtctctgtgtcttaggtttactagatgcaataatacttctctttgacatttgtactgaagtgatttgatattaagtaaaacagttaatgtttgaatataggcatatttataggttttttccgctcccccccaacccaccctttttaaaaaatctatacaaagcccttgtttgagtctcatcatgcacatcaaatcatggagttaggtcttctctgagctcaggggaacacaagtgcacagagagagatgtcttgagggtcactaccaaagaattaccctcattgtccctcactcaggccatgtgtacatgcgatgctgctgagtgtgctggggtgggtggtggccacgtggctcccccagagcacttcctaactggcaagctgggagacccattactggtgaactttgtggaaattagaactgtatcttttacataatcttggcatattacatttcataataaaaacatacatttagttgcatgctacatcactattgattttataattaatttcttaagcttcaaccatgttttataccttatttcgttacatcatatatttgtaatgtgtaatatgaaatcttttgctttaatgtctttttttaaaatgtagaatgttctaaacttgaaaggcaattgaatgtagtatgatgaaaatgtgaatgttttgctgctttcatgaccaaagatacagggctagtggacatttagaataataattaaagctagagtcttgtatgtcttttctttgaaggagttctaaccttgtaaattgagaatgacttcagagaattttgattaagaaaacattaaaatcttaaccggcacaaacactccaatttttttcactgtgaagccgcaagcaattttttttctttttctttcaaaagcctaccttctgaatttatttcttgtttactcatttcagagagggtagtaaagaagatctatttctggtagtcatatcgcttgaaaggtattggtaaatgtgttttcagtcgtgaccatgtggaaagtgaacagtgttggcaaacattaccgagaaaatcatgcttttcaagatgcccttgctttgggatatccttcctagggagaaaaaaaaaaagtagtttaacaattgtgaattccatttcttatttcagtttctgctgcagtaatgggttcccacccactataattcccagcatttatgttctgttgtattctccccttagcccagtaacatttttatctaataccccattccccaagttttgagacagattgaccccctactcattatgtggctctagttgaattttaaaatgtggaatattgggcttgcaggcagtaggagctgcaaatctggtagagtgggagtgtggagttaatggtgagtatgttaataaagggaaactgtctctgacagaatctcagtaatgtttaccaaaacatgtctttctacagctggtaggataaatgatgctaccctgtagctcagctacaggctgcagtgcaaacttttcttccatccagagaaagcagaattccctcctagtaacctcattacaaatactgttactagaagggcatgtgctgtctgtcaccttcagtaatatttgtgccatctcttgatgactgatgacctggatcgagtatttctatgaagggtcttcttaggccccttacatacgcaagaggggtgctctagtgccatagctgtagttcacaggaaggacaccaggagaagttatacctagggctactgagcagctcatcatccctgtttctgcacagtttcctgaaactggccatcagggcctctgaggcactcaaatcagtttacttttagcatgcccccatcagggtgggtctcactgttagtgaggatacgggtctggtttgatgtttttctaggcaaaatgcttaagtgttctggttatgccattcattcatacgatgtgtgaaatttgcttaaaagggaattttcatgatttgatttagattagtatttaaatatctgctttagatagcaattaattttattgtaaaaataaggaaaaatatgtgaatatgtgaattttttaagcctgagagatgatagaatgttcccatatttttcttgtaaagaaaataatattttaacttacacatcctgtagaaaataccaccttttccccttgtattacagtacaatgtttacattactatactgtcaagctgaaagtataaaaaatgtacatatacattttgagttatgtatcctttttttaaaaaaaagttcgagtctgttgcactaggctgtacatgactaaagttgacagatgctatgctagatttataatcactagttctggtacttgtgtctttgtatgatcaaagcatgcaataagcaatacaaaataccaagccttatacttaaaagaagtttaacatattggttaatatactggttaatatactggttaaacatattgaatgtatataagtggcaaaactagatttttaaggaagtgtacattataatattggagctcagtactgcatgaagagacttcattaaaactaagaaaacatttatttggggagaaattttaggcatttaagaacttgtatttttctattttaaaaagttaaattattccgtaatttggaagaagtttcgttgaatgtaggacataaccgtttgaagggttttcatttgaaaaattgatgtattttgtgccttaatattttgttcttttaataaaaatgctctgaatttgaatgattgattcttgatagtatttattggtgctagattatataaatctgtaggacatatagacatatatagactccaatagatggcaggacataaaattcttaaaacaggaggcacagctaatcaaacatggaaaagtgctcaacctcagtagtagtaaagaaatgcaaaacaaaagataggggatagtttaaaaaatcaaattaacataagtttgtactatggtatatttgtaaaatccttttgctttcaaagtctgatgaaatgagcacacttattaatgatggtaatatagttgatttccttttttgtgaaaagttcaacaatgtgtttataacctttgaataatgtcaattctggtgatattttaaaaaatgattcaaaatacagaataaagtttctccacaaaagtgtttattataatattaaagtagaaataaaattagagacaaacaatatcatagttaagtgaattatggtttaaccagctactttatgagatattgtatagccattaaattatgaagaatttataataaaaatacttataagaactgtgatgcagtggcacatatgtgaatgcttatctatgtaaaaataaggtagagcaacttactctcatggttcagaaaaaatgcattctatcttccaacttttctgtaaagttacagaattaagtaattacataattcttaattacataaataattacataattaattattattttgaaataaagataatttaaaaaaaaaaaggccgggcgtagtggctcacgcctgtaatcccagcactttgggaggccaaggtgggtggatcacaaggtcaggagatcgagaccatcctggccaacatggtgaaaccctgtctctactaaaaaaaaaatacaaaaaattagccgggcgtggtggcgggcgcctgtagtcccagctactcgggaggctgaggcaggagaatggcgtgaacccgggaggcagagcttgcagtgagctgagattgggccactgcactccagcctgggcgacagagcgagactccgtctcaaaaaaaaaaaaaaaaaaaaagtagagaaaggattgagtggaaaagcactggggtggcatacatggttagtgttgaggctcagccaggctgtggtcacaacttgattttagcctttcagaaacttaagacaaaaagtttatttcttgctcatgtgacaattcttcagtaggtatagaggtgggaagggccaccctcctccacatgtccctcagacacccggggtttatttccatcttgcggacccaccataccctagggcctaatttttacccctaattttctaagaaacatattcaacataaatatgtaaaaataatagtgccttggccaggcgcagtggctcacacctgtaatcccagcactttgggaggccgagatgggtgggtcacgaggtcaggagatcgataccattctggctaacacagtgaaaccgcatctctactaaagatagaaaaaaattagctgggcatggtggcaggcacctgtagtcccagctactcgggaggctaaggcaggagaatggcgtgaatctgggaggcggagcttgcagtgagccgagattgtgccactgcactccagcctgggcgacagagcgagactctcaataataataataataataataataataataataataatagtgccttagactatgtatcagaaaatctagaaaagtgtgtcttggttcacagcttaatcttaattaatttaaaaaatccatcttgctgtaagtagatgggacatggagaattttcttcatggacattctcccacctttgacatgtgaggagtgagagggacaagatggatagtcccagagggaaaggaagggctgttgtcataagactgatgaccattttggcagacttgggagcacttgcagagtgccaggctttggtaaccactgtattctcacagtagccaatgaagtattagttcccttggttcatagattagaaaactgagagagaggttaaataatttgatagtttaccatcctggcaggtggcaaggctggtataatactggtgggaatcatcctagaagggttgtcctcgaagtcctgaggagagaggagtttcggttaacaaagtgctgtttgcttgttagagaaggttaagtaagacaatgtatctaaagtgcctggtgcatagccttcaggaggcagctaaggttaatgtgaaaggtacagcaatgattgaggggtgactgagactcaattgaaacaaatggcatatgaaattcaaacacattccaggattgattcacttgtattaagatgaagttacccagagcaagttttatgccccttaagtgatagggaatgtacagctacattaacagaggtgacctgatatttacatctggtcagaggctgacctgatttatatctgatttcagatgtaaataattttgacagtatttccttaaaatcattttgaaaaaacaagaagctgcaatggaagtttatgcacaggaaaaaatgtgaaagctatccagcaggtggtgccaaagtaatgtctcttgaagagttctaatctttttttcttttctctaattcttccctttacagattttataaatttacttaccaaatgccactaaacaaatttggggatgaagaaaaaaacttaaaaataattcacacagcactgccctggaaaaacagttattttggtatattttaaaactttaaagctggaaagagcctctaagatcatcttacaaatgaggaaatggaggaccaggaaagtgtcactggctacagttccctcagaccagggttgaagactgcctcctagtttgtttttctcacctctggtccttattgtcagggggaaagagatgccacagaagggttggactgggcatcaaaacttgaaatacattttatatactttggtgaccacttgctacgtcatttcatatgacttcattgtcttttcagcttccaaattcttgtttctacatggtcataattccagttctctgtttcttcatttgataagtggagattttcttggggttcagtggagtctgctggaaaggcttgtctttatttgacctgagtcacagctttcccagtgctaaatgcctctttccaggggatacttattaaaaatattcacaggcatgttttttaatgtcacagctgcctaaagcaaaaaataacattcaaagcaaacaacagactgaccaaaaaccttaaaaggaaagtctaaagaatgagatgaccataaggcctttgaaaaaccttcaacatacttacaggaatctaaaaggtcacatgcatgcatagggctctgcatgctcagcaaagaccacaaacaagaagtgaaggctaaggcagagttagttgtaaactgcctgaatgagtgctgaaggtgtgccccaccatacacacaagcacctcggcaaagactgggagatttactggttccgagaggttaagaaagtctctgtccaataattgtctaaccattacataactgagtagagacttcagtgaccacatatcacaaaatatacagactttacggaattagtttagagaactcactaaacaactactacaacaagtagtaacaacagcaaaccattgaaggggaaggaactggttttcagagttaccacattatattatttaaaatgtctagtatttaccaaaaaattatgacataagcaaagaaatgacagtgtatctctcacaagaaaaaaaagagcatcaaaacaaaatgttcctgagaaagaccagatgtttgacttactagacaaaaactgtaagctgttttgtaagtattcaatgagctaaaaaagtataaatgcaaaagtatgagaatgatgtttgaccaaataatgtcaatagagatagcaatgataaaaatgaaccaaatgaaaattcttatattgaaaagtacaataactgagacaaaacatttattagagggtgctcaagagcagatctgagcaggtagaagaaaatcagtgaatctgaatataggtcaattgagattattcagtgtgaggaacaaaaagaagatagaatgaagaaaaattaacagaatctcagagacctgtggaacaacctcaagcatacagacacacacggtgagagtacgagaagaagaagagagaggaagaaaaatacttgaataaatagtggttgaaaacttttcaaacttgacaaaaaacagtctacctaagcagaaagattagcaaactccaaataagataaactcaaagagatctgtactgaaacatcataatcaaatgatggaaaaccagaaccaaagatggagttttgaaagagagaagtgactcattgcctagtaaaaatcctctgtaacattaacaactaatttttccccctcagaaactatggtggtaagaaggcaatgggatgatatatttaaagtactgaaagaaaaaccgtcagtcaagaattctatatccaagcaaactatccattcaacatgaatagaaatacagacagttgagataaaaactgaatttgttgttagtagttttgccatgcaagaaatactaaagtaggccaggtgcggtggctcacgtctgtaatcccagtactttgggaggctgaggcgggtagatcacctgaggtcaggagttcgagaccagcctgggcaacatggtgaaaccccgtcgccactacaaatacaaaaagtagccaggcgtggtggtgagcaactgtgatcccagctactcaggaggttgaggcagaagaatcgcttgaactgaggaggcagaagttgcaatgagctgagacagtgctattgcactccagctggcaacaagagcaaaactccatctcaaaaacaaacaaacaaacaaaaaaaacaaaactaaagtaagtactttgggctgaaattaaagaacactaaacagtaatttgaatacatttgaagaaataaaacagtaccagtaaagataactagccaaatataaaagacagtataaatgtatttttgtttgtaactctttttttctcctagtatatttaaaagaaacatgtattattgataaatctaagttgatgggcatataatgtgtaaaaatacaactcgtgacaatagcagcataaaggagaggaggagagaagccatacaggagcaagtgttttgcatactattaaaattggttttactcagaactaaaatcttataaattaaggtattattggccaggtgcggtggctcacgcctgtaatcccagcactttgggaggccgaggtgggtggatcacgaggtcaggagtttgaggccagcctgaccaacatggtgaaaccccgtctctactaaaaatacaaaaattagccgggcgtggtggcacgcgcctgtaaccccagctactcaggaagctgaggcaggagaattgcttgaatccaggaggcagaggttgcagtgagccgccattgtgccatggcactccagcctgggcaacagagtgagactctgtctcaaaaaaataaataaataaataaataaaataaggcattattggtagaccccaaggcaacactaagaaaataacttttaaaaaatgtactaaaagaaatgggaaaggaattaaaatggtaaactactaaattttttgaacaaaacaggagacagcagtggaggaacaaagaagataagacatacagaaaacaaagagcaaaaaaggagagggaatatgtgaatataatgaataacattttgtcagtaaatcaacttacatgaaatggacaaattcctggaagataaaaactaccaaaactgactcaagaataaataggcaatctgaatagactcatagtaagtgataagattcaattagtaatttgtaaaaactacctacacagaaaagtccaggcccagatgacttcaccattgaactctactaaacatttaaagaagaattagcctgggtgcagtggcttatgcctgcaatcctagcactttgggaggccaaggcaagtgcatcacttgagctcaggagttcgagaccagcctgggcaacatggcgaaatcccttctctacaaaaaaaaaaattaaaaaattagccaggcatggtggtgtacacctgtagtcccagctactgaggaggctgagacaggaagattgcttgagcccaggaggtcaaggctgcagtgagccatgatcacactactgcactcctgcctgggcaacagagtgagaccctgtctcaaaaagaaggagaagggaggagaaggagaagggagaaagagggagaagaagaagaggagaaggaggaggaagaggaaggagggaggaggagggagggtggaggagggagacggaaaagacggaagagaaggaggagaaggaaaggaaggaaggaaggaaggaagagaaagagaagaaaaagaagaatgattagtgccaattcttcatgaattcttcccaaaaatagaagaaggcacttcccatcacattttatgaggtcagaattaccctgatgctcaaactgaccaaagacaacatgagaaaactacagaccaatatctttcatgaatatggaagcaaatgttctcaacaaaatactagcaaaccaaatccagcaacatatgaaaagaattatacaccaggaccaagcaggatttatcctgggaatgcaaagatggtttaacacctgaaaattaatgtaatacatcatatgaataggacagaaactcaaaaatgctatgagtatctcaatagttgtagaaaaagcatttgccaaaatgaaataccctttcataataaaaaaaaaaaccaacaaactagaggcagagtgaaatctcaacatgacaaagggtacctacagaaaaaaacccatagttaacgtcatactaaatggcaaaagactagaagctttcccccagttatggtctgaatgtttgtgtcccccacaagttcgtatgttgaaacctaatccccagtggaatagtattaagaggtgcgacctacctatgtaacaaacctgcacgttctgcacatgtatccaagaacttaaagtataattaaaaataaaaagaggtgcaacctatagaaagtgattatgtcatgatggcatcatcctcatgaatttgattactgcccttatcaaagaggcccaagagagcttgtttgccccttctgccatgtgaggattcaataagaagttgccatctatgaggcacagaccaaactcttaccagacattgaatctactggcaccttgatcttggacttcctagcccccagagctgtgagcaataaatttgtgttgttaataagttacccagtccaagatattttgttataacaggccgaacagactaagacaccccctaagatctggaaaagacaggaatgtcctctctcaccacttctgttcaacattgtattggagcttctagccagggaaatcagaaaagaaagaaagaaagagagagagaaagggaaataaaagttattgaaatggaaaaataaaaatatctctatttgcagatttaatgatcttgtatataaaaatctctaaggaatccactaaaaaactattagaacaacaatgagttctgtaaggtttcaggatacaagattgacatatgaaaatcaatcatatttcttaagcttgcaatgaataatccaaaaatgaaagtacgaaacccatttacaatagcatcaaaaagaacaaaatacagtggctcatgcctgtaatcctaacactttgggaggctgaggcagaaggatcgcttgaggccaggagttcagaatcagcctggacaatatagggagaccctactaaagattaaaagaattactcggcattttgggaagccaaggcgggcagatcacttgaggtaaggagtttgagaccagcctggccaacatggcgaaaacctgtctctactaaaaatataaaaaatagctgggcatggtggtgggcgcctgtaatcccagctactcaggaggctgaggcaggagaatcacttgaatgctggaagcagaggctgcagtgagccaagatcatgtcactgcactccagcttgggtgacaaagactgtgtctcaaaaaaaaaaaaaaaagattaaccaggcatgatgatggacatttttggtcctacctattcaggaggctagggcaggaggaccacttcagcccaggagttggaggttgcagtgagctgtgatcacaccagtgcactccagcctgggcaacagagtgagaccctatctctaaaatacataaaataaaataaaatacttaggaatgaatctgacaaaggaagtgcaaaacttatacactaaaaaccgtaaaatattgttgaaaaaattaaataagctataaatgaattgaacaaattccatgttcacagaagacttaacattgttaagatagcagtcttccccaaattgacctagattctgataatgcaatccttaccagaatccctgccaacttctttgtagaaattgagaagctgattttaaaattcatatgcaatttcaagggacccagaatagccaaaataatgttgaataagaactaagaggaggactcacacatctcaaaacttactttaaagcaactataatcaagacagttaagtaactgcaaaaggatagtatatagatcaatggaatagaattcagagtctagaaataaacccatacatctatggtcagatgactttcagcaagagtgccaagaccattcaatggagaaagaacagtctctttaacaaatagtgctgggacaactgcatagccacatgcaaaagaatgaagttggactcctacctgagaatatatacaaaaattaactcaaaatggaccaaagacataaatttaagagctagatccataaatctctaagaagaaaacatacggctaaatcttcatgaccttatatttgacaaactatttttagagttcacgccaaaagcgtaagcaacaaaagaaagaaacagatagattggacttcatcaaaattaagaacttttgtgcttcagaggacactatcaaaaaatgaaaatcaacccacagaatgggagaaactatttgcaagtcatatatctgatcagggacttgtatctagactgtataaagaactccttcaactcaataataaaaggacaaataatccaaccaaaacatggcaaaggttctgaatacacattttaggaagatatacgacaggccaataagcacataaaaagatgctctaatcattactaatcaagaaaatgaaaatcacaaccttaataagataccactttacacccactaagatcgctgtcataatagaaacaacaaaaaaggaaaataacagtgttcatgagaatatggagaaactggaactcttctaaactgctggtgggaagtaaaatggtacagcccctttggaaaacaacctggcagttaatcaaatgattaaagagttaccatatgacccagcaataccactcctaggtatatacctaacagaaatgaaaacatgtctacataaaaatttgtacacaaatgctcattgtaggattcgccataatagccacaaattgtaaacaaaccaaattttcatcagttgatgaatggataacccaaatatgatatatccatacaactgaatattattcagccataaaagtcaatgaagtactgttaaatgtgacaacatagatgattcttgaagcatgttaagtgaaagaaaagcactcacaaaagccccatattttattattctgtttttacaaaatgcccagaataggcaaattcataaagacagaaagtagattagtggtttcctagtgccaaagggataaaagaatgaggaatgactgctaatgggcataggataccttttttgaatgatgaaaatgttcttaaattagatacttgtgatgattgcacaactttgtgaacatactaaaaagccactctgtcatactctataacgtggtgaattttgtggtaaatgaattatacctcaattttaaaaagttatattcagggtaacacaacagaataaggaacatctacaacatatcattaacaatccctggatacaatcccaaataactaggcatactagtaaaccagaaaaagtgacctttactcagaagacaagcaatagctgttgagcctcagagcataccagatggtaaatgaccaaaaaaaggattttaaaactgcagttataactatgcccaaagagctaaaggggaagacaaagtttataataaataaccaaatagaaaatctcaatagaaaacaatatttaaaaaaaaacaaaaacaataacaaaaaatggaaatatgagaccaacttatataataaaaaattcactggatgtgtttagtgacggattgaggtgacagaagagtcaatgaacttgaagttcatagaatagaaaatattcaaccttaaatacacgaagaaaaagaaaaaagagccgggtgcggtggctcacgcctgtaatcccagcactttgggaggccgaggcaggtggatcacaaggtaaggagatggagaccatcccggctaacacggtgaaaccccgtctctactaaaattacaaaaaaattagccgggcgtggtggtgggcgcctgtagtcccagctactccggaggctgaggcaggagaatggcgtgaacttgggaggcggagcttgcagtgagccgagatgagcgagactccatctcaaaaaaaaaaaaaaaaagaaagaaaaaagaaagaacagtgccttgtggacttgtgggacaatcattaagagttctaacgctaaactaattctaaagggacaggaaagagagaataaaggagaaaaattactgggttaaataatggcccaaactccctaaatttggtaaaagacacaaatttatagattcaagaagctaagtgcactccaaccagaatatgcagaaaagtacatgtaggcatgttttacctgcagaaatccaaagacacaaatataatattgaaaccacaatgaaggggaagaaatggcacaccacatagagaggaacaatgacagaaatgaatctgacctctcatcagaaagaatggatgctagagaacaggtcagtgatattgttaaagtgccgaatgtaaaaaaagtcaacccagaattctatatctaccaaaaatagtcttcaaggacaaagtcaaaataaagacattttcagataaatcatatttttaaaaatttgttgctagtgaccctacaatacaaagtatgctaatgaatgtttttcctgctgaaggaaaatgatatcagaagggaacttgggtcttcaaaacaaaatgaagagcaccagaaattgtaaatctatctataaatataagaatattcttgctaaaaatttgttaaaaacacatatgactatttaaagcaaaaattataatattacaccacggggtttttaacatatatggacataatatgcatatgaccaccatagcataaatgacaggacttggtaattggcccatttcattgaaagctttttacattttatttaatttagttatttacttttttttttttttttttttttgagacagggtcttgttctgttctgttgcccagactggagtgtagtggctctatcatggctcactgcactctcaaccgttcaggttcaagtgatcctcctgcctcagccttctaagtagctgggactataggcacacgccaccatgcctggctaatgtttttcattttattttcgtagagacagggtctcactatcttgcccaggctggtctagaactcctggcctcaagcgatccacctgcctcggcctcccaaagtgctgggattacagacatgagtcaccacatctggcaatcttacattttatatgctgtatacactgttaacactaaaaaacactgtgataaattaagaatgtatattgtgatccagtggcagacattaaacaattataacaataatgcagaggtatacgttaaaagtcaataaaagaattgaagtgaaattttaaacattcaatcaattaatctaaaagaaggcagaaaaggaaaacagagtaataaaaaaacagagggaactggctgagtacagtggctcatgcctgtaatcccagcactttgggaggccgaggtgggcggatcacctgaggtcaggagtttgagaccagcctggccaacatggtgaaaccccgtctctactaaagatacaaaaattagccaggtgtggtggcaggtgcctgaaatcccagctactcaggaggctgaggcaggagaatcacttgaacccaggaggcggaggttgcagtgagccaaaattgcaaaaattgcaattttgccaaaattgcaaaattttgcagtgagccaaaattgcactgcaacctggaagacagagcaagattctgtctcaataaataaacaaacaaacagaggaaacaaatagaaaacaaatgataaaatggtaggcctaaattcagacatatcaataattacattaaatttaaataaaccactcagcttaaaaggcaaagatttttcacattggataaaaaggtgagactcaattatatgctatctaaaaaaggcacactcagtgacagagtgagactctgtctcaaaaagaaagaaaaagaaaaggaaggaaggaaggaaggactgaaaacatatagtggagagagagagagagagagagagagagagagagaaagagaaggaaagaaagaaagaaaaagaaagaaagagaaagaaagaaaaagaaaacatacaatgtcttctctgaccacagtggaattaaattataaataaataataagatatctgaaagaaaccaaatatgtggaaattaaaccacacagttctaagtaacccatggatcaaagaaaaaattatgagaaaaattagaaagcattctgaactacatgaaaataaaaacaccatatatcaaaatttatggtatgcagctaaagtagtacttagagggaatgctgtaactttaagcacttatattaggaaagaagaaaggtataaagtcaattacctatatttcagttttgataatctaggaaaaaaagagctgagtgagtaaacccaaagaaagagaaagcaataaaataataataaagctgtattttcttattttctgtattttcaatattcttgcatctggggccttactgacctgaaaggactgctcctctggagtttgcaaattctgaaagatagtaaatgacttgctctagagcatgcattttatatgcaaaccaaataaccccaagttcatactcctgcttgtttccttttatctgctacgatatccttttgccctaaacaccgcaaagctgggtgctggacaactagggactacccctagagcctagagcccatccaaactcttcaaactatccaatcctaaacctgcttagcttgcttaccttgtttcaattgttccttcctgcaaaaaccacaataaagtcacttgtccacagttcctctctctctctctctctttctctcttttcctctctctctgcctgctcatctcacctgggcattttcctgtgtgatcctgcatgacataccatccctcttgttcttaggagactgtgagtataataaaaacttctttcttcatggaaattattttcatgtctatgtatcttaccacatctgattaaaacaaatcctaggtgctattgaaacaaataaagatatgagcagaaaccaatgaaattttaaacaaacacttgagaaaattaacaaagcaaaaagttgtctctttgagaagaaaaacaaaatttataaatgtttagctataataattaagaagaaagggaaagagcacaaatcatcaatattaggaacaaaagaagggctaccactacagatcctacagccattaaaaagataagtgaataataccattttatgccactacatttggcaaattagataaaattaaagaattccttgaaaactataatgtataactgacataaggtgaaataaaatattaaattatacacacatttatttaaagataattttagacttaaaagttgcaaaattagcacttacaccttttatccaggttttctttttgcttagcatttactcaatttcagtttgatcttgggcaacctactgaagcattctaagcctcagtttcacaatctgtaaaatgagattaataatgggacccatttcactgggttgtcatgagaacaaatgagagcatttgtgactggtttacagtaggtgctcaagacatgtttgtttccttcttatgttgtccctgtatgaaggaccatcagtataagcaatgtccctttaactgagcacttactttatgctcagcattgtgttaggcactttattattttgaaatctcataatctctttgataaatacttgtattctcatatataaatcaagaagctgaggcctgtaaagattaagaggttacaagttcacactggcagcaagaagggggtaagatttggccgaggcacgtctgacttcaaaggctgtgtgtgcctgactgcatccaccatctctgctgcttccaaaggcatgtggaatggcattcgtggatgttcaatgtcttgctccttttggcagatgttaactggtgtttggtctttaatcacagcacagtgaaatctgcttttctacaggctttcatcttgtaaaattggaaatgcttttctagggggaacggtttctactggcagtcctgatatcatacataagtagacagtctcttcacctttcagcacaggactgcacagttctgttggctaaagctctagatataatgtgagaatgtagtgcctggtacagggccatgcccggagttggcacttgatagatatttttgtagtgaatgaattggatgaagtcactgcacctctgctagaccgttctccctacacggtttctaccctattatcctgtcaggctaacatgctggactttgttcctgggacctctgtaggtgcttcgtaggggttgatgacatttagaaccacagagaaatgtggggtaaaggatgaaaagggagagaagcagctgcaaatgagctgacagtaagactcagccatagctgaatcagtaagtccatgaacccaaaatggtatgcaacatggtatggggcaccactggggacccagaggagcccccaggacagctctggaaggataatttcagactggatcttgcttctgctagcatctgtttatttatttaatttatttttgtctttctgagacagagtctcactctgtcgcccaggctagagtgcagtagcaatcttggctcactgcaagctctgcctcccgggttcatgccattctcctgcctcagcctcccgagtagctgggactacaggtgcccaccaccatgcccagctaatttgttgtatttttagtacagatggggtttcaccataatagctaggatggtctcgatctcctgacctcgcaatccgcccacctcagcctcccaaatgctgggattataggtgtgagccaccacacccagcttttttttttcttttttttttagatggagtctcactctgttgcccaggccagagtgcagtggcacaatcttaggtcattgcaacctccgcctcctatgttcaagtgagtctcctgcctcagcctcccaggtagctgggattacaggtgcctgctaccacactcggctaatttttgtacttttagtagagacagggtttcatcatcttggccaggctggtctcaaactcctgacctcaagtgatccgcctgtttcagctcccaaagtgctgagattacaggcatgaaccaccgcacctggcctctgttggggtcttaaagacaaatttctgcaacaaatcttcccattttgtgttgcatgcctatgttacacagagaacctgaatgtatcagagcactaatccaaggagatggcaactgatcttaccaaaagatgtttaaaatactttctgtagacatgttgaaccccaccaaaccaatcccccgacactcaggaatattctcttgaaaactaaatagaggggaaatagaggaataaactagctgataagggccaggcatggtggctcatggctgtaatcccagcactttgggaggctgagacgggtggatcacgaggtcaggagttcaagaccagcctggccaagatggtgaaaccccgtctctactaaaaatacaaaaatcagctgggcatggtggcaggtgcctgtaatcccagctacttgagaggctgaggcaggagaatagattgcctctgtgaggcagcagaggttacagtgagctgagatcatgccactgcactccagcctgggcaatagagtgagactgtctcaaaaaaaaaaaaaaaaaaggctgataggcccattgtattcagttaaaggtgagggttgggggcttaaaggtagagcacccagctgattttcatgggctgtctgcttgtagacagccttggtaggttctggacttgataggctctgccttgattactgcagatccagggcagctgaggacaaagacagagaaaggacagtgctgctggggcagtcagatcttagaaggttcattcagaccagatgccagaacacttagagggaaggcagccatagggaaagggttacaaatataaataattacataggaaaaaaaatcctgttgaaacttagaaatatttgaaaagtaaaaacaaaagcaaaaacccaagaaaacaaaaaacaacaacaacaaaaaaacagaaaaccccccattactgtaaataaaattcctgaaatgctatgatcatgtatttaatataagcaacatagtagccctaaaatgagaggtgggataaagtcaaaggtagtctgtcctagaaacagcaccgctctgggagggggatcttgagaccagagtttgcattccttgggcaagtcagtcaaccatgccccgattcagcttcttcatctgtgaaatcaagaatctcttccagctttatgactccacagaaagggcaggagaagagaaaagaaggcttgcttacatctgcccgatgtctggttaccagcgcatagccagaacaaggctgagagccagaacagctggccttccagagaaggtcgccatgtaaacacaaggtgggataggacacaaaatattaataaatgcagccacactgaccaggaggaagcttttcaaggatagggcagaggacagagagacagagagggagcagggcactggcttttggtacagacagcaaacacatgagagatcgaggcagaaaaccaccatctccacaggctgccctggatcgggccatgctgtcccgtcctctccacctggatagggagaagcaggggtatgaccatgtctctcttcaggatgttcaaccaggaatgcaaaataaaattacatggatcccttgcaggctgcagtggctcacacctataatcccagcactttgggaggctgaggcgggtgggtcatttgaggtcaggagttcaagacaagcctggccaacatggtgaaaacctgtctctactaaaaatacaaaaattagctaggcgtggtggtgcatgcctgtagccccagctgcttgggaggctgaggcaggagaattacttgaaccagggaggcaaggctgcagtgagctgagatcaggccactgcactccagcctaggcaacagagcaagacgccgtctcaaagaaaaaaaagatttacatgggtcccgttccacctcctttgcatgggaaggttgggggagcagcactgtaggatttcctgggcaaccaatgcccaggaggccagcctaaaccatgtcccctgctttttggggcactggctaggttctgaatgttggtgtctcccctaaatttatatgttggaaacctcattcccaagatgatggcattaggaggtgggacctttgggaggtgactaggtcatgagtgcagagccctcaaaattgggattagtgccctcagaaaagaggccccagagagctgcctttcccctgtgaggacacgggaaccagaactctggccctcgccaaacacctaatctattgacaccttgatcttggacctcccagtctccagaactgtgagaaacacgttctattgtttataagccactcagtttatggtattttgctatagcagtttgaagggactaagccaggactccagctttcctttctggcctctgctgggaaacagctcctgctctgtggtcacagtcttgtgggctccccgttccctgagctctgagtgggctcaacaaagtgaaatgtggaagaggaaaaagagatctggggcttgaccagacttgtgtgtcccaggacatctgcagtgactgccttcagaaaaccttccaggaagaacgtcagtcatgccttccgggagctcaggtctgaggcatctggttgtaccacagccctgatggcaggggacttcagactgctcatgccggcctggcacttcctgattcgacttcagcaaggcaggcaatgttctagaacctgacctccgatttaaactgagtttctccttcccttgagcaaggaggacagtgaatcagaaggacgtagatcccctcactgtatcactgtgtgtgtatctactcactgtgcgtgcgtgttctcacggccccattgcattatttaaagggacactagtttattcggatggagagctcagtccaccccacgtcaagcttatgaagcccatttcctggcccccttctaggaatgtcgggaggagggtgtcgcgtgggctttgaagtaggacagacctgggtttgggtttctgttctgccacttgtccttggtgactgagcctcagtctacttggttgggaaataggacggtcgggagtgaacccgcccagggtgggcttccagtcacccgcacatatgcggggcactggccgcccatccctgccaggccccgaggatgcccgcgctcgtcctcggcgtcgcgggttgggcgcgctcccgggcgcattcccggccgggcagcccctcctccctcgtccttagcccaggggccggcgcctccccgcctcgcgcggactgtctcgtgcgggcagctgcgggcgcacctggaccctcgcaaggcccgggcggcgccgatccccgcgggacgcgctgcgctcggggcctcccgcctccccccctgccccagccgccccccggccgcgcggcgccccgcaccctgcagggacggctgccgcatcgctgggacaaactcggcagcggaggcaaagttatttcccctcccaggcagcgggattccgactggcaagatggtgcccagctctccgcgcgcgctcttccttctgctcctgatcctcgcctgccccgagccgcgggcttcccaggtcagtgtccctcccgcctctctccaggccagtgtccctcccgcctctctccaggccagtgtccctcccgcctctctccaggccagcgtccctcccgcctctctcccctgtccctcccgcctctctcccctgtccctcccgcctctctccaggtcagtgtccctcccgcctctgtcccctgtcccgcgcgcctctctccacgccagtgtccctcccgcctctctccaggccagcgtccctcccgcctctctccaggccagcgtccctcccgcctctctccaggtcagcgtccctcccgcctctctccaggccagcgtccctcccgcctctctccaggtcagcgtccctcccgcctctctccaggccagtgtccctcccgcctctctccaggccagccagtgtccctcccgcctctctccacgccagtgtccctcccgcctctctccaggccagtgtccctcccgcctctctccaggccagtgtccttcacgcctctctccaggtcagtgtccctcccgcctctctccaggccagcgtccctcccgcctctctccaggtcagcgtccctcccgcctctctccaggccagcgtccctcccgcctctctccacgccagtgtccctcccgcctctctccaggtcagtgtccctcccgcctctctccaggccagtgtccctcccgcctctctccaggccagtgtccctcacgcctctctccaggtcagtgtccctcccgcctctctccaggctagtgtccctcccgcctctctccaggccagcgtccctcccgcctctctccaggtcagcgtccctcccgcctctctccaggccagcgtccctcccgcctctctccacgccagtgtccctcccgcctctctccaggctagtgtccctcccgcctctctccaggccagcgtccctcccgcctctctccaggtcagcgtccctcccgcctctctccaggccagcgtccctcccgcctctctccacgccagtgtccctcccgcctctctccaggtcagtgtccctcccgcctctctccacgccagtgtccctcccgcctctctccaggccagtgtccctcccgcctctctccaggccagtgtccctcccgcctctctccacgccagtgtccctcccgcctctctccaggccagtgtccctcccgcctctctcccctgtcccgcgcgcctctctccatgccagtgtccctcccgcctctctccacgccagtgtccctcccgcctctctccaggccagcgtccctcccgcctctctccaggtcagcgtccctcccgcctctctccaggccagcgtccctcccgcctctctccacgccagcgtccctcccgcctctctccacgccagcgtccctcccgcctctctccacgccagtgtccctcccgcctctctccacgccagtgtccctcccgcctctctccaggccagcgtccctcccgcctctctccaggccagtgtccctcccgcctctctcccctgtcccgcgcgcctctctccacgccagtgtccctcccgcctctctccaggtcagtgtccctcccgcctctctccaggtcagtgtccctcctgcctctctccaggccagcatccctccttcctctctcccctgtcccgcgcgcaggggaggcagcaccaaggctgggggacccgggcttgccactttccactcggatgcctgggttgagagctcggagcgatgcctgggctggggttcagttttcagagagaggtgcagggtcccccacctgtcacctcagatgcatcgctggccgggcccctgggaggacccgggctgggctgcgaaagcgtcggtccattgtgggcgaggactccacgtgagcaccgccgggaggaagaagatttctcagggagctatgagacattggtctttcctgggtctccatgagagctccaggtcacctaattagcttagagaacgtccccgccctccaaactccgacatttaaatttccaaccgaagtatcagaacactcacgggactttctcagcagtttgtggcatttcccaggcagaggtggcccgggaggtttccgaagcggtcccttcccgagccggcgaggccctggatgtgcgactacattttcttaaacacatatacaggcggcttgctgtttaatttttctgttcttgccgttggcatttgttcgaatctcaccggatttatttgtttaatacttgaccagattcgcttttatgttaaccattagcaactgatttttaaaattaaggcgagaacttgaattgccgagtccgggacccacatccagcagagtagccctggcaagccagggtgaggggcccggccatggactgccgaccccgctacctgcacaataccaacagcggtgggcagcggagagcctgcacacggagtgcctggtgcgcctcaggctccctgcagggcatcttccagtcacttcattcccggagctaccctgtgaagtggggactgttacccccattttgcagatgatgaaagtgaggcccagggaggatgagatgtattcaaggtcacacaaccagaaatgagcggaataaacccagtctctcttgttgggctccaagatttcttccttgcctgcagacacttgcccatactccctggccagagactgacttcctgggccaggcaggcatgcccatggccacctagaggcccctacggtgcaggaagggattccaggcaggcagaatttggctcagacgagacgtggtgatgttagtgcagaaggtagtgagggggcaccacagggagatactcagtgaccaggcagcagaggcccagtttggggccacgctaaacccacccaacagagcaatggggtctcctatcaactttgcaggttacagaacaaagtaaaaccccacctcagaccttgagcccaatgccagaagcataggtgggtacatccctaaggcggctccccagcctaggctccaaggaggcagcgtggacaggatgtgtgatgagatgcgtgagaaccaggccctgccattgtgtgacttttgctgctcggggaatgaggtaaacacctgtctcctgaggttacctagaaaccaggtgagaccgaagcacttgtcatatgtttgcagctgctgcagaggcaaagtgagctcacccagactctgtacccggaacttctgggtccaatccctgtcccgccacatccagtctttctcaagtttcttatcctctaaaccttactgtcttgagctgcaaaacacctgtcttaggtgctttgtgaggggaaagggaacaaaagagattgcccatagatggtcatttaaaaattctagtgagactctctttcacccacagtcctatgtggccaggggtctccccttctccaccctcaaccctgtccgggcaagcgtaaagggtgaattgtaaaggaggccccagggcctggtgcatgctggaacaagcattacctgactccttccacgttttgggtctctgctcaaataagtaatcctctgcagaggccttccagaactctctctactctaaacaagtcctctctctgcccctgtatttcctgtttgggtcccctgaagggctctggcgtagtaccgatcatcatttgtaatgatatattttggtaggtttcaagtttattgtctgtattcccactatagggctccaggggcagggacccacctggccttaaagcagtgtgagccctgggactcctgaacccaccagtaagagccattggttggtggagactcagcaagtttggagaatgagctgtgcccacaggatcatatcttgccatggaggagatgagatgggtcaggtgggaggcactgaggacaggcttcctcgaccaaggcccattgacacagcaactccaaggagctctagatggagactgcggtgctcctcatgggggtgggccacaaccctgtctggggttcccgtttgctggcaaatgtgcttgctttgcgttttaggagacagcgcaagagtaatatcatgagcgtatgtgtgtgtttgtgtgtgtgtgtgtcaatagatgtatgtgtctctgtgtgtggttgtgtgtacacaccttttttgcattggtacctgtggttgtgtgtgcatctgtctgcgtgagtgattgtatgtgtgatggtaagtgtatgtgtgtgtgcatatctgtgctgtgtgtgtgattgggtatgcacatgtctttgtgtgttggtgattgtgtctctgtgattgtgtatgtgttacaggggaggggaggctgtgtgctgcagggtccagagcagtggtcctgcggggatggagtctcatctctctcctgctctcctctgtggctatccactgtgtccctcttgtcagcgcatctgtcccaagtcactttgcaggtttttgtcactggctgatgaagagcaggtggtcatggggaaggaagggaggctgagaagtatggggtgtgcagagagcaggagccctttctggacactgtgcccaccctgtggccttcccactggaagagaaacacctcattggggagatcagaacaaatatctaaccatcatctcgcacttcaccttcagcccacagtggctctgggcgggcaggggatgcgggctcccggccacctcctcgcctgtgtggggagctgctatggtgtttaagcaggcttccctccctgaccctctccctgtgatcagatgtcacaggtctccaaattccaccatgagaggttcattcttttagttgcctcctcccatttgatacattgctttttataattaaataaaaataaatgttgttcatgtataatttcatgattttaaccatggaactatattctatgtgtggcaaccaccaccacaatcagggtacagaacagttccaccgcccccaaaactacatcatgctgctctttgaagtcacacctactacccaccccagccttggcagcccttatctattctttatcgttacaattttgtcttctccatcatgtcatacaattttttattttattttgttttagagacagggttttgccatgttgcctaggctggtctcgaactcctgggctcaagcaatcctcccatctcagcctcgtaaagtgctgggattatagctgtgagtcactgcacccggcctccacaatgtcatataaatggaaaagagtacatggccttttgggtttagtttctttaatctcatttgctctgagaatatgtgttgggcagtgcttgtggctgcagcatttaccccgagataactttgtcacaaaatatcttttattattttcacattgcttagtatatcaactttggaaataacagacatcattctatttatagcattctgttcttagtagtggtatttccatttacaaaatatagtaattcttgatcgctgaaaatgtcaaatcctagaaatatagctctcctacgcgtgatattaacatcgctctggaacagttgttggccgaagattcaattgatgcatccgatttttcccaaatagacgattttaatgattcagacaattctgatgttagttctgctttgaaataactacaagaacagtttttatattttattttcacattgaaaatcattcagatttgcttcagcttcaaaaagcatgtttctgtaaaattaaatgagcactggcagcaagctgcacttttttgattctaaataagaaaattaacttcgtataatgcatctaagaatcacccaagctacaggttcctttttgtttttgcttttgtttttgtttttgttttcttttctttttttttttttttttttgagacggagtcttgctctgtcactcaggctggagtgcagtggcgtgatcttggctcactgccacctccgcctcccgggttcaagcgattctcctgcctcagccttccgtgagtagctgggattacaggctcccgccaccacgcccagctaatttttgtatttttagtagagacggggtttcaccttgttagccaggatggtctctatctcttgaccttgtgatccacccgcctcggcctcccaaagtgttgggattacaggcgtgagccaccgtgcctggcctctactgtttatcggttcacccactgaacaacaaccaccgtggtgtcattccagttttgggcaattgtgaatacagctggtataagcattcaaaatatgcttttcatgtgaatgtattttcatttcttatgggcaaatacctgggagtgggattgttgggtcatatggtaaatgtgtgtttaacttcgtaagaaactgcccaactatattctgtattagttttaccgctttacatttatgaaagacctcactacactgcatccttaccagaacttagagttctcgggttgatttgtttttctccaagtcattctagtaagcatgcagtggtatctcattgcggttttaatttccatttccctaatgactaatgacattggacatctcttcatgtgattatttgccaaatagtctattgggcaaaacgtctgttcgagccttctgcccatttaaaaaattgattgtttgtttctttttctttctttttatttttttgagatggggtctttctatgttgcccaggccagccatggaattactgggctcgagtgaccctcctgcctcagcctctggagtatttgggattacaggcaaatcctgattgtttttaataaattttgagcgctctttatatattctaaatacaaagccttttttggatatgtgagttataaatattttctctcagtttgtagcttaacaatgacttttgcagatcaaaattttaaattttaatgaactttagtttatcaattttttattttaatggattgtgttttgggtgtcaagtctaagcactcttggcctaacctcaggtcatgaaaattttcttctaaaatttttatagttttacatttttattatgacccatgttgagttactttttaaaaatgaggtgtgagattcatcttgagggccaatttttcatgtggatatccaattgttccaataccatttgttgttgaaagactgctgattcacacacttgccttagcaactttgtcaaaaatcgttcatcatacatgtatggagaaatttctgccaataacacacttatcttgattaccgtagctttacagtaagtgttaaaattgagtaaagtgggtcctccaactttattattccttttcaaaatccctttggctattctagtttctttgccttttcattaacatttcagaatcagttgtctatgcctataagaaattctactgggccgggcactgtggctcacgcctgtaatcccagcactttgggagggcaaggtgggcagaccacctgaggtcaggagtccgagaccagcctggcaaacatggtgaaaccccgtctgtactaaaaatgcataattaaccaggcgtggtggcacatgcctgtaatcccagctactcaggaggctgaggcaggagaattgcttgaacccgggaggcagagattgcagtgagccacaagctgagatcacaccatggcactccagcctgggcaacaagagcaaaactctgtctcaaaaacaacaacagcaaccagaaactactggaatttgtattgggattgcattaaatctatagatcaattagaggagaattggcatcttaaatgtactgagtcttccaatctgtgaacacaaaatgtctttctacttatttagatattctttggtttctttcatcagtatatatatatttttagttttcaacacaaacatgctgtgtgttagacttatacctaattatttcatttttgaagcttttttttttttttttttaaattcatttccaagtggatatccctagtatggagaaatccaatgggcttttctgcgttgaccttgtatcttgtgaccctgtggaactcgatcattatttatagggaattttaaaaaatacatttccaggggtttttttacatggacaatcatgtcatctatgtattagagcagttttacttcttcctttttaatgtatgtgtcatttatttatgtatttagccttattacatggactaaaatttcaagtacagtttttaacaggagagcgaacattcttgccttgttctagaacttaggaagaaaggattcgttttttcaacattgagtatggttctggctgtaggttttttgtaggtgttatttgtctggctaagatttccttcttgtcctagtttgatacaatacttattatgaatggacattgaattttttcacatgctttttttctacttcacttgatatggtcctgtgttttttctttagtctgttaataaggtggattttctgtcttctggaagagatggtgtagaattggtgccagttcctgaaatgtctggtagaatttaccaatgaaaccatgtgggcctggagacttctggaaagttttaactatgaattcaatttcttagatacagagctatttaggttggcaatttttcttccctggggtgagttttggtagtttgtatctttcaagaaattggtccatagcacctctctcttgaggcacctacttctaaatactctggggaccactccgcatttctacacaattgatctcctataatgacagataagtgctttgttccataatccactacagagccaagtagtcccctatgattaatttcctttcttgtgtaactttttaattttcctagagtttattcccttttgcctcagtctgccgtctacacaagcacaattgtttccaggatctccttcccagtcagtgttctgccagggctgcttgtccctggagcccagactcccccggcctctctgcatttggctcccgccttgctgctgccctccctgggctcgtggccctgcggctacacaggggctttgggagagagtctctctgctatcctgagctggagtctacattttcgagatcacatgtcttcctctttctttggcttactcccttatttttttgaacccatccttaggaaaatgatttttaactcattattgctggacttgtcaaatcacttgcctacagtagatatcacactttttctacacggaaacttttaagcagccaacagtagcatcatgatcccgggtcgtaggtggggggtctgctgtggccaaaaagagtggtggctgaatcctacagttgggagcaaggccagaggaggaagtgagaggaggaaagctgacccgcgctctctccgactcactgcccgccagctctcctccccactgacttcccagcgaaaatcaagacctcgcgctggagcaggacttgagacttatttcttggtctgagaaaaaaaaaatgagctgaagggtggaaaaatgaaaacaaaagcttgctcctttccggcctagtatggcctgggaagtcagcccatcagtgtcaatttagctgccgattcggattgattgcctgggactgcctagagtccaggttgagatggctcctcagtcactctagagcttggcatgaaaggacaccatgattgacaggggtatctgccctcatcctagcaccaggagtgttcactaaccctgaagtagagattttaatactaatgcatgaagatgagctgaaacagcaggggcttgtgaatcattcagatctattgatctgagataaataccgctatctaaaatgaggtatttcataaaacagatatttggtgcctacaatggcccaggcactgggaacaaaacagacagtgatcttgctttgattttaagagagaagctctggatctgaagttggcaggccagggtagcaatttgagccaagctcagctggtctgctgtgctagtcagggccagactcagctcatctggactggccttgctcgtttgtctgtagtcagctgccaagctagctggggctggttggtctagggcagttcatctggtgcatgcaggctctgctccgtgaggcctctcatcctccaggaggctagctggggcttttctcatggtggttgtggtggtggtgatggtggttgtagagcaccaagactgagcagaagctcacagacttcttgagacccaggcttggaactggagcatgacttccactgcatcctgttggccaaagcaagccacaagtccagcccagatatgaaaggtgggaaaacagacttcctttttgatgaaaagagagcagagtctccttgcatatggcgttggcacagggaggaagacctggggtgatttttgcaaatcctccatcatagtgacgcaaagacttactcccacaggcacctgtgtttagacaaatgggtggaatcagggcagggtggtgatggggaggttctcctggcatcttctgctttctctagcagcctccacttctccctggcacattcaagaatgagatctacatcctgtcaagggcagccctgattgcagaggagaatggaagtccccttgctcccttggggtcatttctggccctgggggcattgggcagtgagtgtaaagggcctgatccacaccatggcccgctgggaaaggagacgtggccagccagttcagtggtttcttgggctagcctggagtctttcaatcaggaacggatgtcctcccaggtctgctcaccctggggaatcctatttggcactagacttgattgcaggcagatcgagccagatgcctttgaagctgctccccttccctttgggtaccagccctccctccatatgctggctcagacctgcctctcagccagcggtgccaggatcagggtccattgtttgggcacagctgttgacaaaggcctgactgtgctggccactctcccctgacccataggggcaagggtttgtgcagccctggggctccagagaagactcccagggtgggttgaactttctttatcctttcaaactccctgccaggactttccatgctcttcagtaactgcctgaaacctaaaataaggacacgacacacatttttgttaaagaaaaaataagcacccataatttgactggacccaaacccatccatttgcacaagtctcaagtacaatttgtaactcaagtaagtaaaatgtgtatctcaaggaagtaatcatctctcctcctgtatataggaaaatgtgttcctctctggacaccagaatctctcaaaggaggcagcctcgatgggaagtgagacccaaggaactcagcgtggggctgggtgcctaagtactaagattgagacatgacagttgttcacatcaaagaccagaggcatgggggatattggtggtgactgggagggaactggaaagtccccgagccacccttggccccgttcttgccatctggttggccactatctgagacgtttccccgtctgctggagattagttccctctggaccttagatggaaggggagggggttatgagctctggagcagccctttcccatgctcaccccatctctgaaggaggggctggggtcagagagcaagaccagcaactggttgcattgtccagaaagcctcaactgcccctggggagctgagagcatcagatgactcccgggctgatttgaacaaaaacagaggaccactgagctccaagacaggggtctctgctgtaccagaagaaaaaaaaaatgcatccagagaagcatcagactgtagtgtaaaaacatacaaacatgttagtatctcctgaacgggtcagtatcacctcagtcctcctgcaatttaggccttttctctgattgcatgacaaaaagaatctaactagtaagataatgtgctcattccacaactatgtcctgagaggctagcacaggaaaaatgctgttctgggaggcctgaggcagcgtagcacgtggtgaagactcccaggcctggcttgatcttggctcggatccttcctggttgactgatctggggcaagttcctgccccttgtgaatcagtttcttcctctgaacagtggagataatagacattcccatctcatggggtcatagttgaagaaaatgaataatattcaaagaccaggtccataacaaatgctaaatacgtgacaggagagagaaagatgcagctgacacagtccccactgccacttagctcaccaagcaggaagagaaaaaccagacaaattagaaaagtatcagagggccaacgattgcctaagcggggtgctgcattggagggtggccacgagctactccaggttaagcaagcaggtagggaactctctaaggaggggacttctaagtcgaagtggaaagacaactctagaggactccactctagaggacctgggggcagattctccaggcagagggcccagccggtgcaaaggccccaaggtgggtgtagcctggggaggttcatggtaagagggcctggattccactggcagaacggattccgctggattccgtgggcaaacgggaagggaagggtcaaatgatggcggtgtgcctgagtacattgtcagggtccggggtcttggagtctttattcttggaataactaacatgaatggtgatgatggctaaataaaaagtggggtgtgttttctgattttcctactctctctaggggaaaatcccaagtgtttctgagtgggttggcagtggtgcaacagaaattatcctctcctgtaccacggcagtcctgtcacatctcccctccctgcatcctcacttgctttcgtaaaatctgtatttcccaaagacagaggtcagaggccaggctgcatcacgcccctgcctacatcccacaagtctcctcgccgctgagaataaagggaaactcctcaccatggagctgacagaatgtattagtttttcattgctgccttctttgattcctttttatctactaaactttctctcccttctatattcatattgtgttaaatcccaaaaggaaatagacaaaatgtgctgccatttttgctggtaggaggctctcaggttgtgagatgtgaggagaaggctcatatacccggcttgtgtacctaggaggggattgcagctgctggatgccatgtgtgtggaccccaagctccttgcttggcttgggcattggggacctcagagacttgctgaagataataccgaggctgtgaaaggcacaacccaatccacaggtgcagatggcctctggacaaaggttagctgggcagcaagcaggtgaaatggggaaagtgagtttggtggtaagatgagcaagagattgtctttggctcatactgacgccattccttcactcctcattcactcgttcactcgtttgttcattcaaatgggcatctagtgtactttcaaggggatgctgtgaagtgagaggatgaatgaggcaggactcacgaaggttctctgtgcacccctctctaaggtgagtccggccatcttgtcacaccagcggctggagaaggcacactgggttttaaatcctggataggccaccgtggctcagagacctatgcggcttccgcccctgccaagtgggtgttgtaatggtgccacgtcctgcgctgtcatgggttcctgtgtgaagtgtggccgcagtgccggctctgggcacccgctgtttttgtcatcgctcctgtggctgttttaaaaaccagactggaattgcgcatggagtgtaaatgtagagttacaggcagccagcagggttcaaactcaaagtaccctgagcatcctggggtgcagagccccaaagggaggctccagctggagggctggggtggttaattttatgtgtcaatttagttaagacatggtttccagatatttgctcaaacaccagtccagatgttgctgagaagcgattgtttagatacgactagcatttaaatcagcagcctttgagaaaagccgattcgcctcctagtgtgggtggccctcatgcaaaagactgaggtcccctgaggagggagttgggcctccacactgccttctgcctttgaccttgagctgcagcatcacctgcaactggccctgggtctccagcctgctcctgccctgcggaggttggacttgccagcccccataactgctcgacagttccttaaaattccttaaaattggacttgccagcccccacaactgcgtgacaatcccttaaaatctctctttctctctccatatattaataagtatgttatatattacaatattacatatgtatacgtatgcatgtgtgtgtatatataatatatatctctttcttattgcttctgtttctgtagagagttctgactaatccaaaggcctcaggcaactccccaagtgaaattctctcacttcctccagaagcacccactttctctcctcatatatgtgggtgctgagcagaggtctctggcatgaagagtagtcgaggatttataacccgcctctggctcagttgaaaaataaaaataagttctgtagagagcacattcacgaattcgacatgactcagacgctgaagactccgagccttggccagcaggctcacatttggtaagttgctcggtcctttcagagacctaaggcatcaaaacatctgtgttcccattaacaaaatgctgacgtgacgcatagctgtggcttgggagaaaccagcgtgggagacggcccctccaagtctaggggtcatccgtggccatcggaggtcttggagctctattgtcaccaaagaggctctcaaaaggtgtcactgtaccaagactgtcactgtgaggaagaccatcgagccaggttacaggagaacagaagccccagggaccagtccccatgtttccgtacatactcctgaagcttctctgtaccctctgttgccttcagagcaggttcggagtgagcccaaacagcatgggggcctggatgggatgagaggggtcaggcctgctggcaggggaccgggtgagccgggggacacacacccatctttggctgtgtccacccttggaccaggaggtagggtctgggggtacgaaatgtctctggaggcccagccatcctgcaagtggtagttggttctcagaggaagggagcctggtgatctctgaggaatcttccgtggacccgccggagtaaacactgtgcgagaaggggctggaggggagatggacaagaattcccggagaagggcaggggtggatggagcgttccatgggccttcttgcttccaagagccttaaaaccagctcctcccctcgcccagctctcagcactggtctgcgtcttccagaaccatccatgccacctctactccagcttggaaaaacctggatggggtgacatctgttgttccttctctaactggttctctgcaaacattgccattggtgtcaagttagatgaagtactcacccctttaaagagtttcata

SEQ ID NO: 170 - DNA, 545903 bp, Homo sapiens
cccaattcactactgctgtatctcttgacaaaataagtagacatagtctgtggccaattttcttctaacttcatctcagaactcctctctcctctctatgcatatctgccctccgcaagcctcagacctcatgatgaacgaggaaggtaaagcatctggaaaagtttcctatgaagagctgctgaaaaagcctgagatgttgtttagtgtagaaaagactcaactttgcatttcccacaaagtgtttcatggaacaccctttgtcttagtctgttccagctgctgtcacaaaataacacagacagtgtggcttatgaacaacagaaatttatttctcacagtactgaaagctgagaagtccaaaatcaaggagctggtgtgttgggtgtctggtgagggcctggcttcctggtttatacatggtttcttcttgctgtgtcctcacatggtggaaggggcaaggcagctctcaggggcttcttttataagggctctaatctcattcacaagggatctgcccttgggatctaatcacccccaaaaggtcccacctcctaaaatcatattattgataactagatttcaacatgtgaattttgggtcaaccaaagctatagcactactcacaagaaatgttaatgggtgttcttaaacaaggcagaagggttccatggacaaaataaatttggaaaaggatgaaataaatataaagcaagtttcttaacttcttcacttttcatagcttttgacagattgttgtgattctccagtaaggactacagaatgtagcatttcccaaacatatttgaccaatgaactaccatcccaggtgtacctattaatgtctcttaggggactagtgggaggttgcactgtttgattttaaagaacgcttgcaaaaccagacaccatgacttcaagttgcccttattagttagacctgtcttctgaggtccaaaattgacctccttcttcctttctctgaaattcatataattatatgattaaacaaatttctactaagacaaatttggtataatcctctagctcttcatttgttattcattgttttaaaagtttcttatttgaaataaacagttagataattataatgggagatcatcttttttgagggcttttctgtatgctctttctagtataagtcacctctttctcttttactgttccttggcaagcaaaaacacaagtttaggaacaagccagagttatcaaaagttctacaggagtgaggaaaaaaagagcaagaggaacgcaggagaggcaactcacttgatgacatggcagaagcatccaagctgctgaattgttttcaaaagatggcaggcagggcccacagtgaaagcatcccatctggttgtccaatccaccatgaaaggggtcgagagtggtaaggattagagtagaggagattcccaggagctattgctggtgatggagggatgtggagactttccattgtttatgtacattagagaagattgacttgaaatttcataaatatatatcttatcttatattccttaatgtacataatggagaaaaaaacccaagagagcactccaagaggagttgagtttggatcaaatcctatcctaagcattatcctattttggagttgagatacctacattttagaaatatttttaatccagaataggtcacatgctaaatattctgggtaaatggtgtttatttgttcattgttttttttcttggcatgtggaagagaaatcatcttgaatcaattgtgttcattggccaaacagtatgataatttgttaaattttactgattaatgatgcagagtcttgactttcattgtaagtaaactcaggacacaaaaagcactaagagatgcccaaagtggttttctataatttaaatggaaataaatttgtatcgaaagtacactagatttcacatttcacatccttttagttttagatttaaaaaaagagcgatactttctgacttctcagctaagatttttatagtggtagtggttgttgatatttggtgtgtaaaacctctttatgctgctttagctatatattttttaagctgactttactatcaaaagcacttgaaatttaaaaattatgtccatgattaaaaacttgcagaagttgcccagcaactattttcattccccagaggcagagagtataatggaaaggaggaatttggggtgagatgtctttcttgtgtttaaattttctactctgaacttggacaagtcacttatcttcctaaatcccaattcctcatgtatttaaaaaaaaaaaaaagaggatgtcacaatcatactgcctattttccaggattattgtgagtatccagtgaggaaaatatataaaagactcttataaccttcagatttcttacacatacatataattgtttttaacacatttctgatctttgttcatatgtatatatggtttcaatcacaggaccctatacacatttgtgttccacttttcatatctaatgttatagttgtgccataatttactagccctttccctattgatggacatttaaatggtttacagttgttccctattataatagtgcagtaataaacatctttgtacattcaggcttttgtctttctctctttattatttttttttttttttggccaatttctctgggactagttccagaagggaggttgtggagtcaaagtgaatgaccatttttttaactaacctgtcttttgagcttttcacttcatccaaatatctttcccttggtaactttcctagaaagtcacagagcactcaaatgccttcttgaagtcagccagaaagattcagaatctacatttggtggccatatttccattttcaggctctttcagaaccactggcctgtgaggcctcccctagactgcaaggcccttcaggacaagattgtgccttaatcatgttggcatcctagcatggcctggcttgtcacaagaactcggtaagtgattaatcaatggagctaaacagagcagatgcctaatacatgataggctccttatggtcacctgacttgccaaagcattcattcatcaaagagtttttaacaatgtcaggcactggtgctagaaactggagacagagaggcaaatgtgacacaggtggcctcatcagcctagcaagcagagcccccctggcagtggaagagcttagtcttgaatctgagaattccttgagaaggggtccaagagtggagttgaccttggcccatgtaatgtgattgcagggaaggcccttgctatgcctaaatattttaatcatctaccccttaatatcagtcattctgtaacacagatcttgttacagagatggaggtgacagaaggggcctctgcaatgttatttgacaaccatatcctgtgtcaaagaacctcaagctctgttgtctgagccaggatgtgagaacagagttccttgacccagcagggttagggagggtttccaaatcccctctggagcagaaaatccctgtttgatcctatccagcatcataaggccacctgctgtgggcatgaatgctggggagggtggggtctctggccaactcaggaaagatctgattctgggcttttcacttgtgtataaatgaatgtgtctaaacattatatgctttccatttgcctattgctggaaaatttgataaagggtgcagaaattgagcaaatagttctgcaaggggatgtagaaagttttccttggcctcagactctgggctgtcttgcaactagttccttggaagtctgtgtaatttacttaaggctggatgaaaaccaatcctaggttttccatgatgcctctggtagtgctggcttagcttgaactctgtgggcagagattgtcaaagaggcagctctgctctaaatttcttgttattgttctctgtggaaactcacagagaacactgacaagtttctgagaccctaggttgttttatgttgaacactgcactgttgagtaaagacttggagttctctttatgagttagaatgttgtggctttccttttataatgctctgtaaagagctctccaaatttggctaaaaatttatacactttatggctatccattgtggtacaaccatatgttcagtttagaacaaataaacacacttgaacttataaacagatgaaactcagtttggtaatatttataatttgttttaatttgaccagaaaagtattatgtgcccaagcctgtcacttagtcaatggtcatcgctgggactgagcactgtttctgggtgtcagatagaaacattaatgatttgcgagtttcaaatgtccccagggagacggctctagcactgttgtgttgcatgggatattggaggcaatttcatatgtgcacatatagttagaggtttgcgaggtgtttattttttggctacctgtagatggtttcattatcccaaatttgtattgatgagcaaattcaaactttttcatttcagttcctatttcaaaagcgcctgtgtctgttttttctttgcctctgttaactggctctgaggtaggcatcctaatgcctgtttcccctgagccaagatcacatcttgtgtttcagctgcaagctaatagcctgtcaggagtatggaaatatatatctgaggtttgtgattctgcatgggatcaggatttccaggagtgcctgttggagaacactctgctctgtgcttctcatgtcttaatgttggttcttaatgttaattcaaaccagctgtggcagacccagttgttcctagaagttgctatctctgtctttcacattctgcaattttatatgcacatacattctatgaaacttcatgaaatttctatgatatttgtgtttcggagaatgctccttataactctgatttcatgcaaaaagttactgccacataaatggggaggtgatatcaattatgcagtactggattcaaacatcaactctgttacttactagttgggtgagcctggaaaaatctcttaacttttatgtccttcgctttcttgatctgcaaaatgaagatgcaaatgatcttggtttggagtcttctagtggtctacagtatatggatgcaacacttttagggtctgctccagttacagtaccaggttataaggattgtaccatcttgttttaaaaatgatatgaagttaaactctgaagcacttagaacaggtctagcacataataaacttttcgtatgtattagttactacgattaccataaaaatctcaagaaaatattaattctctgcttcggatattggacagaactctaattaaatctgatatatgcctaccgtgggaagctcactttttttctgcattgctagagcaataaatacaatcaaatgttaaaaaaatcatcaaccaaccaaccaatcaacaaaaaaaccaatccagattctaaagcaggagaatggcaatcatattcaccactaacacaaatttcacaaaacacaagcttatatcaaagagtcaattcaaacttccaatttaatactctcccttcaggaagtgctcattactcttacagccttcaaaagacagaaactccccacctgaccatggtctttgtcaatgtttttggaagctaaatgaaataaatatgttttagaatgaaatagggggtgacaaatatccccctctgcaatttttcattgattcctaccaattgcagcatcttggattaagaagcattccttctatttgtcctgacatctggagaacaggccacagattttctcaggcctccatcctggagtttaacagctatcactatatggaaatccttcttagagataatctccactgatgcgatttacaacagttttcttcttagccactcttccatgctcatcctttgaatgacagccatgtatggacttgaacctcacagtcctctgtcgcacagggaagaatgccagtgatcttgaataagactcagtttttgtgttgctggaagaaggaacagtatctgggtatctgaggttggttttgtttcctttattttctcaacatctttgagctttgtttgaaatgcaaaacctaattttaaaaattctgctgttggatatatcatttgaaatgtagaaatactctgaaaaaataaacataattgaaatagctttcaactattaataattttaaaaatacatggtttcctttgtctcctctatggttttgaaatttaacaatgggatatttgtcatcattctgcaggttgagtttttcagtccagcgtagagtgattgtttctgtttttattttatttctaaatttttatgcctgcagtggatgtgcgtgagctatggccttggggcctaaacagctctgggtctcatggagagcgaaatgagtgcatttcatgctttcgctttccacaatgtttattctgttaaagtaaactcaacttatggatgtatcattggttgtaattataccattcacataaaaggtaaataatttcaagtaaaattagaatggtatttttgtaaatccttgtactttcctcactgactttcaaattttcctctttcctaatttcatcctaattttctccaggcccaaggacattaaaggcatccatcaacttttccggaatcaggtttctctggataccgtttctgatttggaggcttgcagccatttttttccaagcataaaaatggcttcaactttccatagtaagggaaatctcagtaagggaaatcatatacccctaagtatatgcattttaattttccatgtcttgtcactgttatgataaaaaagaacaacagagtttgaaaactttcagtgattgtaattttctagttagaagtttattttgttacatggttctttctttgaatctcagctgtcttttgtaattagagtattcatcataacatgcatcaactatttatattttctcaataaatagtccttagcaaccaattttgtgccttggtctctttaaagacagtcatacaggtgtcatacccaccttttcctctagaatatattataacctgaataaatcctgggccttatgtcaccaagtttcagggcagtgtaacattcaaagaaacaaccaaaagcaaatgaaactctaagttttgcttgcagtcctcagaacgcattaaaagagattcaatttacagatcctagccacatcgtctaaggttcccccaactccacttcctcactgtcacagcccatctggagcccttgttctccactgccgccttcccactactcgccaacactgtccacttttctttgcctcttgtattctgtttttctagtcctacctctttcttcgcattctcctgtttctgtatcacaggaacccaggagtcaagttggggtagacaaagaagagaagctgatcaggcaaagacaaaattatctttactgggaagtggaggccttgagggttcagagtgaggctgcaaatactcagatagtaatatttttttgtaatattactgtcaccaaggcatttttacaaagaacaccaggatttaatgcagctattaaagttcttagtttactttgttgaactttccaaaagaggcaacctgtccacagttctgaaggctgtggcaatggagtgtgccctcagagaaacctcaggagataaaatcacagtcttcttctagaatgatcttataacagctagaagggcaaaatacacttttaagagttggagtctattccatcttataaggatgggggatttattaggactctgtgccaagattttccagaatttctctctaggagtagctaaaggagggagctgtctgagaggggattgctggggacaatgaaacttgggtttgaatagcacttcatgtaagatggaaagaacatcatttctcacagcaaagtattaggggtggggatgggggtgggtgatcaagatcaatgcagtgtcaaaacctcagccctccaatctactcctggaatttttacagagtgtgagatgtttgcagaccaggaggctttcttgcatttatgcctcaggaaatgggtcgttttataattcttgtggggttctttttgttgtgttgttttttgtttttaaaaaaatccctcttcctatacagaatcactattaacagtggtatgtgacttttcagacattgtatgtgcatacatccccacacacacctttatgttgttttttatttatttgtttttattttttaattttttttttttgagacaaagtcttgctctgttgcccaggctggagtgtagtggtgccatctcaggtcactgcaacctctgcctcctgggttccagcaattctcctgtctcagcaacccaagtagctggattacacaggcaagcgccaccacacccagcaaatttttgtatgttttgtagagacagggttttgccatgttggccaggctgatcttgaactcatggtctcaagtgatcggcccacctcagcctctgaaagtggtgagattacaggcgtgagccattgtgcctgaccatgttttaaacaaaaaaaaaaattgacgttatatttacactttaatctgaaatttgcttttttcaatttacagtttgtcatgaatatccatgtcagaatatttaaatgtaccattttttttttgagacagtatctcactctgttacccaggctggagggcagtggtgcaatctcggctcactgcaacctctgcctcctgggttcaagccattctcctgtctcatcttcccgagtagctgggattacaggtgcctgccaccacacctggctaatttttggtatttttagtagaaatggggtttctccatgttggccaggctggtatcgaactcctgacctcaggtgatccgcctgccttgacctcccaaagtgctgggattaaaggcacgagccactgcgcctggcctaaatgaaccatatttttttaaacagttattttattccgttataccatgatggaatcttgtacacaataattcccctattgttcaatatataggttgcttccaattttgcactatatatacaatactgcagtgaataccctgctatgtatatttttgacacacctgccttagtgtttctatactattgatttctaaacttgtagtttctaggtcaaagagtgtgctttcaaatttttaattgctgatgctacaaccccccgtcttccccaaagttaaaaaccctttgtcccaaaagtcaggggacttaatctggattctgtcgctgtttagttattcatgttgggcaagctgcttcttcacatctctgtgaaatgaggaaagtggaacagaagatgacctctgtgttccaatgtcccatgagcctttacctttacaaattgatttgcccaatttcagagaattatttagggctgtttcaaaccaatatgaaaatctgctctttaaaagattgttgagagcggagctaattttttttctgattaagctttgattagtaaacaaatccattaacctcctataggattattttgacatattcaagctgtgactttttctttcacagttttttgaaagctgagagccaccactgagcaaactctcatttaggccagattttgttttattttgtccagttcgaatcagtttgatggctgtgtgtttatgcatgatcttaaatgttccccagtactgggacagggcacatttgacctgttggccgatgaacagatttggttttaatcaagttccaagtcagataacagcactcatgtgatagtgatctttcactttaaggccatgttttgttcactgaaccttgtaaaaatcaaatacataaataaaatgaagaggtcaggaaagatggtttggtttctttcaacctactgctttttgaaggctcagggccaaaagaaaaggaaagtagaatgatagggattttgttatttactatacttaactgaataagtctgcagatgtctggaactatcctgtataaaacatcctattcaccagttcctaagagaccctcaaagagacaattcgagtttaacgcataaaatatcaaagtgggccagacgcagtggctcacgcctataatcccagcactttgggaggcagaggcagatggatcacttgaggttaggagtttgagaccagcctggccaacatggtgaaaccctgtctctactaaaaatacaaaaattagctgtgcatggtggtgggtgcctgtaacccgagctacttgggaggctgagccaggaaaatggcttgaacccaagaggcagaggttgcagtgagccaagattgtgccactgcagtccagcctgggcaacagagtgagactccgtctcaaaaaaaaaaaaaaaaaaaaaaagaaaaagaaaaaaagaaaaaaatgtcaaagtgaagatttgaaatctgttcacagcaatacagatatggttgagaattttgcattgatagggtactttgaggtccactctgcaaaatattatttgtaaattattttgtttgctagttagccaaaggtgtgaaacctggtgttaaaattgtgatcttggcttggtgcggtggctcacgcttctaatcccaatactttgggaggccgaggcaagtggatcacccgaggtcaggagtttgagaccagcctggacaacatgacaaaacccatctctactaaaaacacaaagtttggctgggtgtgctggcaggcgcctgtaatcccagctactcaggaggctgaggcagaagaatcgcttgaacctgggagtcggagatcgcaccactgcgctccagactgagagacagcaagactccatctcaaaaaaaaaaaaatggtgatctctctgtgatgtagggtcctgactagagtgactactgcacaccacatataaattattcctacttatagttaaggtgccaaagactggtgttaatttgatttttaaataaattggaattaattaaaaattatcttaaagtcactcggaaacacttgcatcctaagtgggagagaaagtgatggccattctcctgataagtcctgcctgcctccaggcctttgctcaagctgtttcctctactaggagtgctgttctcacagctggttcctattcttcctccagttcttgggttctgtgccacccacttagagaggcctcccttgagcacactacctaaggagagcccctcccttttattctttatctcagtctcttgtttcctttatagcccatgcacatttaattttattaattttctgcatgtgtttagtttttagaattttaacagctttattgagatataattcacacaccatacagtttgcacatttaaaatatacaatttaatagtttttagtttattcacagatacatgcaaccatcatcataatggttggcaattttcatcgggtaaaaaagaaatcctgtaccctttagctatcaccccatcatacatccatcacctctccatccctaagcaaccacaaatctacttcctgtctctgtagatttcccttttccagactttcatatgaataaaatcatatactatgaggtcttttgtatctggtttctttaacttagcctcatgtttttaatgttcatcagtgttgtagcatgtatcagaactttatccctttttatggcttaataatatttcaccatatggttatagtgtgttttgtttatccatttgtccattgatggacatttgggttgtttatattttttgtctattatgaataatgctgctttaagaatttgtgtacaagtttttatgtgaacatgtgttttcttttctctgtatcctgtatctaaaagtgggcttgctgagttgcttatatatatttttggatgtctcatttactacagtagaaactccataagaacagggaccacatctgccttgtcactcttactgccacagtacctggcattctaccttacaaagtaggtgatttgttagtaacttggtgaacttttcggtaaactaacatgcattgcacctaccagacatctggcatggtgctggatgcctatattagatatggcctgaaggagttactgtgccagaaatgtcagccccagcaccaacatcctcacacttactaagggaactaacccggagacccacctgcctatttcacaccacataacttagctcccacagcaagacttcacccttgagccataacagattagcccaaaggtgggcaaccagcacaaatgtagcctattacaaactggtcagtgtcctttgaggtacagcaaaaagctctacccaaacagggaattaccaagcctatcatgtcttgtttttaataatcctgaacctagtaatttgaatatataagaagtaggtaagacttagtgggagtagtttacaggtcattggcggagggaagctggtaggtcaagatgatcgtggaagttatacacaaccagaatgatgagaaagcaggacccggaagataaaaaatgtacttatagaatgaagacgagcagccagagagaaggagtatctgggtcaaggtgatgacaagccaatgacaaactgtatacactccttagttctgaacaacatgaggctttttctctttctgagacctggttgtttagcatttcctgtatgtctttgaaggcttggcctcatgattgaaatttctgtgtcctcactgccaagtgtatttgtaccaaccacttcatctcacaaaatcctgccctgttattcaaggttacttgagttgaggcttttttccttgcaaccaggaaagctgatttttaaaattcgatattaactacattttacagaagatgaaaccagagctcaaggtcatgttttagtaaagtgaaggttgtggaattcagaaccagatttatctgactccaaggtccaagctttttaccctctaccatccacccagatgtatttcctgactcattcaggagtttaactttaattgtgatagcaatattctcccatcagctaagtgaaccagcttggaaataagtgtattaatgaatttcttcactaaaatttaaaaatgcctttgtatttatgcatagctaactcctgagtttccattattgataataattaagaactggtttgtatatgaaaatgtgtttgtagcatacatttggcttcattatctccatcagttcacatcactttgaaattaaaatcaaatgagatcatgacacatacctgtcagtgacatgcaaattaaaaattcttggcaacatagattaatgatcatttttgagatttttctctcttttattaattttctcctcttgttttattacatctgggtacttattgaaggaagagactctgatagaggatattgttagtggagaaaaggaagcttggcaactttcgtgaaatggtgtgccttaaagaggaaggaatttacagtaaagcctcagggagcccaatgcttaggcaacagtctacaagttggtgaatatctctttcagattggtgttgtgctttacacgatactgtattacaaagctgctaaacaacaaatggtttttctacagataggggatctctaggcatctcaaggataggaatcaatttttcaaagggacacacacactcacacacacacacacacacacactctcacacattttacccacacatgcatatactgtatatacacacccacaatactttgtagaaatgctgccagtatctctctagactaaaagtagtaaacattctctgcagttttatttttgaattatgttgctaacctttaaaaatggggatatttcatataaaaatccaagttgttgtggtattattgaaaaattgcagttctggcagtactgggcctacatttccctatagcaatatttgtctgaagctgagtggaggctgtttctaacagccacacaggctgtctagttcatcattgtccccataattctctgttgtcacatatccagctggctgctttaccacacatcacgtgcttggctcatggagacatttactctctgattaggaacccagagttcctggccaggcgaggtggctcatgcctgtaatcccagcactgtgggaggctgaggtgggtggatcgcctgagctcgggagttcagaaccaacttgggcaacatggcgaaaccctgtctctactaaaaacacaaaaaattagctgagcgtggtggcacacacctgtagtcccagctactcgggaggctgaggcaggacaatcgcttgaacccaggaggcagaggttgcagtgagccgagatcgcaccactgcactccagcctgggcgacagagggagactctgtcaaaaaaaaaaaaaaaaaaaaaaaaaaagatagaatctgagcggttgaaggtaatctgtagctgtttgaacatattttgagacatgactgtcaacctcagatgtgtatcaacatttcctgtggagctttccaaaaatctaccttttatctcccacttcccagctcccctttcagattcattaggtctacagtggagtcagggaatctgaatgttgaaaaagcttcccatttagttctgattttgagtaagatggagtaagcacacttcatccacggtcttccccattgtatgtggctataaagtctagacaagatgtacgaaacaagctatttgaggactctgaaaaagtaaataatagtagatagattggagaagaccagaatttaagacaccagtgaactgatgatgagtttctcttttgtctgtccagtattcttccacttgaacccaacatagcctgcaacctggaagcaggcatgaatgcagacaggaaagtcctctagttctgtttcgaggaacttaacagtcagagagagtctctgtgtgtatgttgggggaggagggagagattcctcatttttcattttgtttttttccctttctcttctttactctctgtgccatagctcccaaacaatccaagatggccaaaaagagcctaaaacttggagggaggaaagccttcattgccacttggagaagtggtggtcccaacagactagggagaaacactgttgcctcttttttcttctgttttcctactcattaaccccatttctttcaaaacgtgggtagactgagcatggtggctcatgcctgaagtcccaacactttgggaggctgatgtgggaggattacttgagcccaggagttcaaggccagcctaggcaacaaagtgagaccctgtctctgcaagaaaactgaaaaaattagccaggcatggtggcaaacacctgtgatcccagctacttgggaggctgtgttgggaggatttcttgaacacaggagggacaaggctgcagtgaactgtgttcatgccactgcactctagcctgggcaacagggcaagatgctgtttcaatatataaatatatatatatctttataagtctgcttatatatataaatatatataatataatatataaatatatattatatatgtaaaatatatatatattcactctgttctgccatatactctccatgtctgcccatatatatgagtgtatatatataacatatatatatatgacagctgtttctcagaagatgatcaaacagctacagattacccacaacagctcagagtctaccccagctcattctaatattttatataaaatattagacatgaacatatatatacatatatacacatgtgtatatataatacacatgcacacatatatatatatatacacacacacatatatatatataaatattagacatggaacgtgtatggcagaacagagtaaataaagccccaactttatttctggtcagagaaccaaaaagagtcccagggaagctgaaaattatcagggatatcaagaaagagggtgaagttagggaaaatgacttttaaagttttgtagaaactcctgggctcacctctgatctgggcatgaatagatctgaccctcaacagtatatacaaaacttgagaactaaactgcactgcaaagtctttgaaaactgaaatcatgttgggtcagtttaccaaaaagatccaacggtcctaaatgtatatgctcctattaggataattttaaagtacataagcaaaaatggacagaatggaaaagagaaatagacaaatccataattatagttgaagacatcaacagtcttctgtgagaaactgacagaacagacagaaacagatagatctgatggaaaatcagtaagagaaggaagtactgaacaccatctatcagctagatttaatttacatttatagaaccctccaaccaacagcagaatatacacttttttcaagtgcatggagcattcacccaggtagaccacatcctgggtcattaaaacaaacaaactaactaaatgtaaaagaacggaaaccatgcaaagtatgttccctgaccataatagaattagactaaaatttaataacagagagatagcaaggacatctctaaatgcttggaaggtaaacaatatgcttctaaataatccatcaaagaaaaagtttcaagggttattgtagatgtcctttatttggctgaagaagttaccttttattcctagtttgaatggatgttgaaattttgtcaaatgattctttgaactaaattaaagatattttaaattaaattaaaatgaaaatacatcaaaatttgtaggatgcaggtaaaacattgcttaggagggaaattctttaatataagcattaagagcttatatttataagagaaaggtttcacatcaataaactatgcttctactttaataatgtagagaaaagagaataaataaacccaaggaaggaatggataaagataaaagtagaaatcaatgataatgaaaacaggaaaacaatttaaaacaccaatagaaacaaaagctggttctttggaaaagtaaataaaattgataaacctttagcaagaccaacaaagatgaaaagagagaagacacaaattataaacatcaggagtaagaatactactgtagaccctttagactttaaaataatactaagaggacactacagacaactcttcatgaataaattcaacaacttagatgaaatgggccaattccttgaaaaatacaaattatcaacactcacccaacatgaagtaatttgaatatttccatgactattaaagaaattgacttcatagtttaaaaccttccaaaaaatcctagtgcaaataaatatattggtgaattattgcaaacattaaaaaaattctaaataatatcttccagaaaaaggaagaagatggaaaatccccaacacattttatgaggctagcattacctgacactaaaactagacaaagatagaatttttaaaaaagaaaaatataaactgatattccataaatatagatgtaaaaatcattaacaaaatattaacacaatatatctagcagtatataaaaagaaaagtcagtgggatttactgggaaagtgaggctgttttaatatttaaaaatcaatcaatacaatctactttattagcagtttaaggagaaagaccacatgattacatcaattgaggcacaagatcatttgacaaaatttcaacatccattcaaactaggaataaaaggtaacttcttcaaacaaataaagagcatctacaataaccctacagctaaaatcatatttaatagtaaaagactgaacacctttcccctaagatcaggaacaagacaaggatatccactttcaccactgttattcaatattgcactagcagacccagccaatgcaataaggcaagaaaaggaattaaaaggcatatagggtgaaaaggaaaaaaaatatggattctattcataaataacgtaattgtctacatagaaaatccaaagtaatacacacacaaaggtcagaggatacaaaatcaatactcagaagtcaattttatttttatatactatcagtgttcaattggaaactgaattgaaaaaagcaatactatttagattgctcaaaaattaaatacttagctgtaaatttattaaaatgcatacatgatcgatatgctgaaaactacaaaacattaatgaaaaaaagtctaagaatacctagaaggagagacatacaatgttcatgatcaacatagtaaagatgtcatttatttataaattgatttatagattaatacaattccaataaaaatttccacaggatattgatagatataaacaaactggttctaaatttatattgaaaggcaaaggaactagaagaggcagaacaattttcaaaaacaagaaagctacaggaatcacactttatttttttctttttttttgagacagagttttgctcttgttgctggggctggagtgcaatggcaccgtgttggatcactgcaacctccacctcccaggttcaagtgatcctcctgcctcagcaggagccaccaccatgcccagctaatttttgtatttttaatagagatggggtttcaccatgttggccaggctggtcttgaactcctgacctcaggtgatctgtccaccctggcctcccaaagtgctgggagtaatcacactttctaattaacagaaagcaatgtgttattagcaaaggcagagataatgaagcagaatagagagtccagaaatacacctaaataaatgtggctgactgatttttgacaatggtgctaaagcaattcatatgagaaggtataatcttttcaacatatttaaagagttaaaacagttaacccaattaaaattatataaaatgttttaacagatacttcaccagagaggatatatggatgtcaaataagaacacgaaaatgtgttcaacatcattaaccattagaagatgcaaataaaactgtgatgagatactgctacataacaattagaattgctaaaataaaaattactgctaataccttagtgttgatgaggatgcatatcatctagagctgtcatatagtactgatggaaatgccaaatgggccactctggaaagcagtttgtcaattgcttataaaactaaacagatgcttaccatatgaccctgtactcccactcttattctatagctacagaattaaaactgtacacaaatatttatagcagctctattcataatagcccccaaaatggaaacaactcaaagtccttcaacaggtgaataataaactgtgatatttctatacaatggaatactactcagcaattaaacagaagtactgatacacacaacttggatgcatgtcaaatgattttgctgaatgaaaggagcccaactcaaaatgtcacatactgtatcatcccatttgtattatgctcaaaaagacaaaattatggagacaaaaacaaagcagtagctgccaggggctaggggtggagggaggtgtgtgacttcatgagggagtttctgtggttgatggaaatgttatgtttcctgattgttgtgctagttccatagatctacacatgtcaaaatttataaaacagaacacagcaaaaagtcaatttcactgtaggttaatttaaaaccttaaaatatatttcaaagcttccctcttaatcctaatgtgctgtgcagcttgcgtaccacttctctggagcaactaccaatgctagacctctttatcaactctcctccaaaaagttagaacttattttggagaatcacagtaaagggcaagtaacttgcagcagaagatagacggtcatttcaaagcaagagcagtagagagtctgagagtcctttgttctgccaagtcaaacagaaaacataaatatttgtatagctttgtaacaaaagagcaatatgggttttggcagaaagacctcttaatcgcatttaagactttaaagtaatggagccctgctcctattatgtggaaattgcatgcagatgtagtgtacatcagggatcagggtcctgtctgagggagacaatgttaaaggtaaaacccagactgacaaggagggcaatctgtctacttgtgcagatatggtggagcccatttgctttttggcactggatcttgaggagattgcatgtgctacttagaagagtctctctctttctttctttcttttttttttttttttggatcactttgcagttgtgagttcatgactttctattttcagttgcacagatagccttttagttcaaggatggggtgttttgggatcaaagacagaaatattgagctatttggaataagtagagtggtgggcattgagggagactgggatttccagtactgcctcatccccacccatccaactgcaagtctcacatcctctctgcttccaaaagggagatatttgaccctaacttctctttccataggattcagtcaaatgctagtgcatatggttatgatataaggaaatgggtcaagtagaattattggggtgctagaagcaagaccaattttagattacttaaaaggaatgcaatggaaggataaggagtaacccagaatcaatgaaaaagctggtctcaaaaataataggaacctaggtggtaggaattatgtatgggcaatctctccagagaattatcttccagatcaaggaagaaatgacatacatttcccccattctcacttcactcaagattcagcattttcttagtatgagttgagtcgcatgcccactctttggccaggcaagaggagatcaccttgagtgacatacactggggaggggaaaagttctacaaaagtaaaccagtggtctcttgtcttcagcaggggttgggtatttgaaaggcagaaacaacagctttcagatcaccatggtgggttattctacattttaaactaaacacccctggagggtgtacagataagcaaagaaggggtacaggaaggagtggaaaaggtggtgggtattatggcagaaagagcaatagttttggaactagacctggaccagaactcccacagggattggccttcagctggcattacgaccccagggcaagtcagttactctgcctggagctttgctttcttcatctaaagactgaagaggctgaactagctgtcccctaatatccctttttgttacaaatcttaagaaatatatactttgggtctagggccataacttaatttcttagctgagtataaaactgtgttaaactcaataggattttttttttaatgcttatagcagtggtcttcaaatgttagagtgcgtaagaatcttatcaggattagataggtggaaaaaaaaatcccttgtaaaatgcagatttcagggccccatccccagagattctgatccattctttctgaacagaacccaagagtctgcatttttaaacaacgttgtcaggtaattccaatgcaggtgatcaaagctaaagacctgcacaccatctgtttgattcccagtccctagaaggaaaccccatccattggagctgcaagcacttagaaaatgtttaaagttgaacaactggacataccctttgaaagctccctcctaggctccctagatagtgtgaggatgcttggaatacagcagacaccagggtagccaggggctccaccgcctgcatattgggacacaacgtggagatcttgcattctctccttacacttgctcactcactctgactcaagtgtagccattcaataaacccaaagggtagagagtctgctgtgagtaccttgtgagttttccttattgttctgatcgtatgaagaccttaaatagaaccttttcaaattctatgtatttgggctcagcagtgcctgctttagtaaatttctggttgtaagaagtttaaccttcaggctaaacatttacactaaacacctctcatttggggagttacactgaagggagtgttgtccattgttttcttacgtgtagttatttgtgctctaccatgtatctggggatctccaagtgccttttaaaagtaatcagtttcgcatcaaggtgttccttacagacatgtggtttacaaatggtgaaggaatattttttatgtgtataaaatgcctgagtctttccctgtccactaccttgtatgatgctccattaaaatgtagcatggatgccaagagttccttggctttttgaggcaagatagaagagattggtcatttggcccagtatgtccttccaaatatatccagaggcctgaccaaatgaaagtgaattataacaagggtgaaagtaatttaaataatgtcacaacttatactcagttacatccaaggaaaccagttgtgtattaaaaccaataaatagtaatttaaaaagtaataattcaaggaggacattaccacaatgtttgaaataactatgcatattatatggtttacaatgtgcaacacactttcccatacattctcatttcatacaccctcttgtcttcgttgcgtccaaccttaggatagagagtgaatagggaaacttggtctatagcctctaacaacatgggcaaggcccattagggagaagaactctttgtagaggactgatcccctatttctttctgtgttctgtttaaaatgaaattgttgtctctgttcagaagcctgattggttgtgtacgtgctgtgcgtgtctctgtgtgtatatgtgtttaatggggaaacgaaggctaggaaaggagggagataaatttatgaaggatgaagtctacaggtttttattcttgctttatttttcactttctctaatactggggtggagaagctctgcatatactttggcttcatgaaatgttgacattcgagagaggaataaaagtgtttattctctagagttaaaaagaaactcaactcatcaagtgtgtgttctgttccacttggtcttataagtcatttgccagcaagatgagctttatatcgtctctctggtaaaacatcctcccatctcctgatcggcattcctccactcttttgcttcataaattagaagggaggatgccattgtaatacttgaccttataagggggaagagtggcccagccgttccttagctctgccctcctgtcagaactgtatacactctggaggccttttaagggaacgtggtgcgtgcagggaaaacatcccaaggcagaccatccattttctttgctactgcagagttggtgcctgcaagctctgtgtgactctgaagcataaatcataaggggttgctggtgccaagccggagggagggacatgtctgaggatcatgctcactgccaaatgcagccgacctcttagttttcactaaaatcccatctcaccactggccttctgacttttagtgaaaatttcacaagttgcacatcctgacattacttgtacttgcctccctgttgtgaattataatgatggctgcagagaagcaaccactgcctccttaaggtttcagtttatccttcctgcgctgtaccattcacttctgtacagtgaggctcgagtttggagagagagagagagagagctggctttgaaccacagggcttttttgtactagctctgaggccttggacaagtcatataacctctctgagtctcaatatcctctattaagaatggggaggataaaggtgataacatccttttatagtgtttagcacaatgcctaacacatagtaaatgctgaaatgttagctgttattattattattattactactagaagaaggctatagttttggtgtttgcagcaagtatttcctacagttccactatttcaatccagcacgctttttataaacaattttttataggcaaaacatatccagaaatacccatagaggtccctaagaacatcttggcatgattcagtgtacagagaatgggttctggaattggacaggacagggcctgactccctgcccggccacttaccagttcatagctttggacaaactatttaatctcttggtaattcagttttccagttagtagtctgaggatactggttgtttaaatacaggcatttgggttgccaggggcagaaacaaattaaattggagcaaagaaaaagaaagggtttgttgcaaacctatagaaatttcactgaaataaactatggtttattttacaagatggggaagagggaagaggaaaaggggctttgaggggaggaggggcttctacttgtaggcaaataggttgtcttctccagtagcttctaatcctagactcacttccttctttgaaatccacctttttgaagtatatttcccagtaaacaaaagtctgcaggagaggctaaaaatcacagaaatgtgacagtatgtgtcctccaaaggtatgaaccctctgttctgggacaggtctagcagtagcaacgctcttcccagggcacccaggtagccgagtcacccagggaggggttgtttggggagacacttagggaaggctgcgtgtagcctctcttgagacccctgcaccttcatgcacagcctgttcccacttagaggcttccacccagcacccaagagtcatgctaatttcattaacaaacctgcattaaccaggacctctcttctcttctcagttagctcaggggttctcaaactctttttctgtgtgcagccaaagtccacttgcagcaggagcaccacttgctacctgcagtgattttcaaagcagctggggctctgtatattagaatctcttcactcctgagtttttgataatccttcttacgcccattggaatatagtccagagatcattgttcaatcaataggcacccctcaagccctgttcattgccagaccctgaactgagttgatattcagagaaagacacagcccttgtcctcctgaagctgctggagatgcatgcaggggacagcatagtgtgaaaggtgttgtggcagaaatgctctaggtgctatgggacagcagattgtgggctgattgtgtctctctggggaaccccaggaggggcctctcattctagacttcttcacccacttgggctactatagtaaattaccatagactgagtggcttataaacaacagaaatgcatttctcacagttctggaggctgggaagtccaagatcaaggacccagcagattcagtgtgttgcaagggcctgcttcctggttcatagatggctgtctttttgctgtatcctcatgtggcagaagggtcgagggagctctctggagtctctaatgtaagggcactaatcccatttatgagggcttcaccttcatgaactaatcacctcccaaagcctacctcctaataatatcacgttgggggttaagatttaacatatgaatttggagtggacacagacctttagtctatagccctggggctctagctttgcttcccagaagctgagactgaaaggacaattaagactcagctagccgaagtgagggaagcagcatcaccaagccctggagggcaaaaagaatggcttgtctgggaattgcaagcctttggagtccctggaaagtaaaattgaggagtatttcctcaagagaggagagattcttttcctcaaggtgaacttcagctatgggtgccctctgatggggaccccatggtcagagagctttcaactcacacaggcaccttcccctacccaaggtaaggatttctgcctgttaagtgatagctgcatttatggagtgtttatcatgtgtcgcaactgcccccatctctgcctatgagcacgtgaaggcttgtagaaaagcagtgacttacccaagtccccaaagctagtgaaaggtgggcatcaggatttgaacccaggtttgtctacccaaggagccagagcttgtttcactctactgcacagcctctttaatcttagatgcaggaactgaggataagagaggataaatgactggcttacaagtgtcgcagaattaatagtgtaagagtgcaacttcaaaccccagtctgtcagattttaaatccagtgagatgcttacagctatgggggtagggtggggaggacaattgctttgcttacatttaagagagatgtccaggggaggcaagagttggacctcagcctgctggggtttgaccagtatagtcagcatgctcacatggtagactctcataccagcaccaatgttcaatgtcagttcaagtgtgaaccccttttgaggacctcttaaacactgtatgatacatgaatcaaaattcagctattaaaattgtgaatagagatatacaattgcatatgttaattgatcattgtcatttgtgtacagtttgtcttaactattttaaacttgcctaaaaacaagaatctctagaaataaaaaataaaaacaaaaacaaaaacaaaacaaacaaaaaaaccactgcttttaagtactgacacctgggctctaaccaagacctgtaacccagaatattctagcaaagaggcccaggaattcacatttttaattagcaccccaggtggttcttattatcaagaaagtgtaaaaaactttaacctcttccgaaggtgaatgatcaagtacctccagctcccccaactcagaatgttttacagcttgccaaaaagagggggaaacactgtccaagcttgtttgctaggttaggcctttaaggccactatctgggaattccatatgtgtaatcatactgtaagtttaataaaagtttacatcatatgaagtaaatttgccacttttatttggattggatatgcacatttggtttcatgaggggggaaaaatccactgtcatatttcatccagctagaaaatatgttataagtgaaggatcatttctcttttctgactcttggaacattgtttcaagattttcagagaaactcagtcaatagcttagtgctgggttagtgtgctgggattgcatgtgtctgtatctcatattcgaaatctgcataattaactgcattggaaattgacagagaaaatgtgagctgactgagagaattctgggatggaatgttcggaaataaatttgtagaaccttatgaaagcaaaaacaagatatgcagaatattgtaggaatggtggaggattcttcctgaaaccttattgtgcgagaaataacctaaggtcctgctgagttaaactatccttctgtgtccccaaaatacacagccacctacccacttgaacatccatacacaaacacatacaagcatacacacacatacacacatgcattttatccctcattggcactttcaaccccttgcctaggactgttgatattcatgaacccacttaaagacctgaaaacaattataagctccaaaatgaagacatccgcaatgccaacacgattaactgcgtaattgaatatgtataaaataccacatgttgtcactttattcttaaatttaatattcaagaaatcactataacactttagaataatttgtaggatatattttcttcttttgaaaggtttccagagtgtgcgtgagcaatatcattgccaatagttaattaaatgagtgacttgtagcctcgtcatttcaaaagcaaaattataaaaattctttcaagttcttttggagcaaaagtagatttttatgtgagatgtggacatattttaatatttttggtatgatatgggatggggcctcataaacacacattcagagagtttaccaccaccgaatgcttttgcacagggcacacaattggaaaaaataaaatatgccattcaaagttgggtctttaacagctcaaagatggtgaaaggctttcagggcctctctccattgtgtgactgtctctgaagggtgtagtctacttcctgctacaccagaattgtccttagggaacttgaggacagtagattctactctgcctgaattcaggtgaggccaatggtgagctgctgcatccagttgcataggatgtgcactgtgtaagggcaccacataccaagggggcattattcccattgcaaacaccctacacttgaatatttattatgacagcgcttcagcagatggcattaaagtgttctgttctgagaaactcagtgtgctacaatactttttaatagccataaattactggatcttgaagaagggatacctttagcacaaaaggcacagcttgggcttcagccctggcctgacagagagagaggtattcctcctgctccattcacctttatctccctccactgtaggctgtgggattttgacctaaagggactgctcaccaaccccctgccccaccacaagactgtgcccctgaagcagttccaagctcagaagccctggagtcttccattcctaccagccctttgcccttctaccaccagcaggcttgcttgttttctggcagttagtccctgaagtaaaagctccctgcccttctcttagtaggaagtttctcctaagcaccaagagcccctacacggaatggaaccacgcagaccaacatggcccttgcctcagtctccagagaaggggggagggtcagttaagtggccttctcatctccctggggagtctctgcttctccagttgatctcaggaacttcctgttctcaccaacctattttggtctctgtctcccatagacgactagaacctctgagagaggatcggtctcagtgcaggtagcactgcacgggtgatcctgaatgcaaacagctgctgttcccatctccttcctcttcccctaccacatcctctggatctgaaccccagaacaagactgctcaggggaacagagaacatgtcactcagataccaaacagacgtactgtcagccacattcactagccatgccttcagctgtccccactaggctagtcccagagtggatgctaaggcagggctgcccttccctgctgagttcagagcttagtgcaaactaggacctggaggaggggtatctctgcttccaaggcatcaccttccaacatctcctttctcaaggctctttggacaagacatcttgctgggaatccttgatgtgagttaaaagcatttaacatagtccttcttctcccttgctcttcaaaagtgttcagtaggagtaaattcccttggaccccaccactatcatagtcctatgaagaaaatattggttggtaaatcttagccagcattttcccatgtgtgctgaatgaaaccaccaactccacaaggtgctctgtgtaaatgtgagaaatgtatactctaccctctttgtgaagttttacaatgaaatgagcatttggttttgaaatatcctgccaaagtagagagtccacttttaccatagtctcttaccttttcataataaatttatagcactggacttggtaaattaacatataaggttattaaccttttcagccaaccctttgtatgtaattcctttggaaattcatccaccatcgcttaattttatcttaaactttctggtttggttttgttttttgagacagggtcttgctgctgcccaggctggagtacagtggcataattatagctaactgcagccttgaactcctgggctcaagcaatcctcccatctcagcctcccaagtagatgagactacaggtgcacaccaccacagctggctaattttagtattttttctttttttgagccaggagttttgcctagggtggtctcaaactcctgggctcaagctatcccccctccttggcctcccaaagtgttgggattacaggggtgaacatgctgtaatctccctccttatctcaaactttcaatcatcccatgtatttgcttccactggtattttaagaccaagttctggaagcacctttatattaatgtaggaggagtccatgttctgatgggccccatgaagtttgcatgaaatgagcaagtgtctttaagcacttaccttcaagagactaacggattagagaaggagttaggtgtcccagcatctaaggcaatatcctgtgctgagtgtctaactcctggggtttgcagtggcagtacaaagagaggactggccagataaacctggaaagtaaggaagcggcctaagtccaggagggggtggatgaagagtgtactggtgtctttcattttccttcaagacctccactccatctctttctctctgctccccgtcctgtagactgacctatagggactatcaagagatccccacccttccctccagattttagttgggcttgggcaattgggagcactgcagttactagacagaaggaggagaatgcaagcagggatttctttctctccctataggatttccataggctggaaacatgactcttctgaaggtcaaggttcctgccaagcagccctatccacacagatctgtccctggatttcagtaatgaatctagggatgggacgctggtagccctgatgttacttgccctctccactagccacacctgtgtaaacagttcctgtattaaactctcaaactactcagttttgagtgtgccatcaattctgttggggacctcattgatacaaggagtatccctacctaagtgaacgatgtgtgcaaagaactgaagtggcctggtgcttgaagggggctccatctcaaaaatagtttgttatggcaggatgatgccgcagtaggagagttcatgaggccgatcactcttgccgatgcccacggagtgctctggggatccagggctcccaggcctcatcgcatttagtccccactgagtaaggagacatattatcattccattttgtaggtaaaagatccaggcttatggaggttaagtaacttggccaaggttgcactgcaagaaggggtggagctgcgtggggactgagagtccctactctcctccgtgctaagacattaaactggattccacaggcagcgcatgtttgcctgcctttcctgctcactcagccttagcttttgctgtaaaactctcacgtcccacaaaagaacattgacctttccaatattccctttcctcgtaactatgtgtcattaaactgaagtgtttctttaaaagacattagagcagaattagtatggcatgacctttccttatgcttcctgataaaattaaactcaaacctgggtgaccgaaggaaaccctgggaaggtaaatgcagtcttgaagatggttcctttcaggcagggtggctgcctgtgcatcccttgatatatgctcgtcttctcggaaccatgcagagagagctgcctgtgacctgatttggcttcataggaaacagcaacctgcgtcatccattgggtcacagatcagagttacacgatgaaatgaaacaggtggaatgtggtgttcaatccatggtattctgaacccaccatggacagctgacactcacattcccaaagggaatgcaaagttttgcatgttgccctgctcagggcatctccgcctggaatcggtagagttttggccctgagagatattaatctattgtccaaaaaacaggaactccctaaagagagccaaaaataagaaccatacccaggactgatgaattcttttctgtgatattggtggacaggttagcaggagaaaaggaaggggaaatgttcatagtacacaaagtataagcatcatctcttagttaaaaaaaaaaaaaaacaggaaaggttttgagttctattcatgtaaataaaaggcactaagaatcttgggaaatgtccaggctaattaattacagttggcttcaggagcatgcacagacttgccttctgccatcagaggcatagttatcggggagggtagatcttccaagttcctccacagccctggtggcattggtgggttctggctgcttctctgagccaggtggtggtgtgtctcttcatttagtctcattaattcttcagtgttgcaaatatctgaaacctgttattaaagagctggaacgatatcccactaggttttcaatatggactattgatgaagaaacagtaattggaatagcaggggtctgagataatattgcaagacaaaagaacatacaatttcttttttgtggctcttttgcattctataatttggtggccttggactatggctgtttgtcgctgtagaaataaactacagcttgtctagtgcctttctgatggataataggttgcttctgatttagctctatttctctttcacatatagtgtggtaataaacatccttgaacctcatcttcttgtgcgcgtgtgttcaagtttctctaggaaagataccagagaggggtttgctggattatagggcatgatcaagtctactaggaattctcaaacaactctgagtgtaaagtgagtgtaccaacttataatcttgctgtctttttttttcttttctgttttcccatgatacttcaccaacatttggtattagattttttctttttttttctttttttttgggggtgggggggtggcaggagggacagagtctcgctgtgtcacccaggctgaagtgcagtggcgagatcttggctcactgcaatctccgcctcccaggttcacaccattctcctgcttcagcctcccgagtagctgggactacaggtgcctgccaccacgcctggctaatttttttttttttttgtatttttagtagagatggggtttcaccccatcagccaggatggtctcgatctcctgacgtcatgagccgcccgccttggcctcccaaagtgctgggattacatgcaagagcactgtgccctgtccttttttttttttttttttttccttgaaacagaatattactctgtcacccaggctggagtacaatggtgcaatctcggctcactgcagcctccacttcccgggttcaagtgattctcctgcctcaacctcccaagtagctaggattacaggagcccaccaccatgcctggctaattttttgtatttttagtagaaatggggttttgccatcttggccaggctggttttgaactcctgaactcaggtgatctaccctcctcggcctcccaaagtgctgtgattacaggcgtgagccactgtgcccagcctctttttttcttatttggctaatgtgatgcatgtgacatgatacctggctgttattttaattttcatttccctgatttactatatattttcatattggccaatcagtcttcttcttctgtgacttgcttaggtcatctgagtttttcttatcagtttgtaggacttcttcatttagattagccattaatcctttgattttatgcattgcaactatcttctctcaatctatggcttacttcttttttttagtgtctttgacaaatagaaattttataatttttaatgtgattacgtttatcaatctttttcttatatttagacccaacttatagaatattctgcccattctttattcccccctcatagaacatgggacagacagtgaggtccctgtggccttgctgaaacagaatccaatatgaaataccatagcaaggaacaggtatttgctttgggaacactgataatgccattgtatttcagtggatacccatgcctcacagaattactctgttactcatagagtagtgaagcagcattatacaaatactagtcttctctgttctttcttcttcttttagagtgagtatccatttatagttgctgtatattcatttaatgtccagtgcctagatgtgtcctttccctcatgtcttatgacatagattcaataagatttctataatactatctaagaaaacatgctaattggatatagaaaagagaacaaacaaaaatagtttaagagacataaaaagctttgttttacagaaatgctttatctcctgggttggagctgtcatgtcagtaattatcacttttagtttataggagtgaatgaactgattttaaatcttccaagagtattatataagtcatttttttttaagcttcagtaagaggtctgtataacttggaaaatacaaagcaaagcaaaacaaaacaaacagataagaagatgattcatgtcttgctagtctgggaacaatctcatggaagcctgaaggatagctgacaattagctcttgactatctctcaacttagctggagcacttgagacttaaaattccccagccctagaccctcggcaatgtattttctttgaaaataaccagagccaggaacagcttacattaaagtgctcaagcatcaaggctgtaaacacagacagttgttaattccccagatgtaggggtccagattatttaacagttgaagagagtgaacctgtggtagtttcaattttacattttttttttcttggatctttggtcaatttcctaaagccaagtttttcttctttcaattaaagttaggattttcagaaatctgcctgcctatgttgcctaacaaaatttaagatctaactgggaagagtcctcttcttttccccatgacacctacctaaaatgaaagtggagaagcttctaggtaaagcggcaaaggcccatggggttggggtccacctttatttgttttataattggtcaaactctagaagtttagagatactatgagacatgcagttatcttttgctttttcttttaaatattctttaaatgatatatttagttccctttggtttaagtgaaatgtccagtactaagagcagtgataatatcgcaactctgtaggccattttgcaaaattatatactatcccatttgaacctcacaacctctctgataagacaggcaaggcaggggttatttaatatgtggattttgaagtttagaccaggctgaaataatggaggccccaggattgaatagcactgtgctaaaatttatatatatggttgaaaaacttttgtagttatcttattttgatagcctcatgttttatgttcattttattaatacctgaaagtgtgagttgttccatccaaaaaatgggtttaagagtagattttaagattgctattagaaaaccaggtttagctgaactctgcctcattcatatatgaaccaggtaggctttcttgaaaaggcttttaaagtgcaaactcatataagccttttaccatacagcagccccagccagcagtgctagacatcaaagaagggatctgggagtgaactcatcaatgtgaaaatattgaagagctaacttgagggctgttgtgtttaatgtctgttagacattaaccagcatatccaggatgctattaaactccatcttcagtagtttgtttcttgggattgtgtaaacatcactaattcaaacatgcacttagtcataaacactgcagagagctttttcttttaaatatacttttaattgaagtataatggacatacagaaaaggcacaactcataaatgtttacttcaaggaatttttcaccaaatgaacacacccgtgtaactaccatctggatcaagaaacagaatagcacctgaagcttccttgttccccattctgatcatttattctctctcctcctgagacgtaaccactattctgacttttcccatcaatgatgagttttgtctatttttgaatggtacataaatgaaatcatagagtgtatattcctctgggtctggcttattttactcaatgttatgagtatgacattcattcttgttgtttcatctaatggcaggcagttcatttttgttgttctatggtactcctttgtgtgaatacaccacattaaataaatacaccacagttggtactaatttgcatcccttcaacagtacattagggctccacatctttaccagcacttggccgtaccactctttccagctagtcttgtggatacatagtaatatttcactgtggttttaatttgcatttccctgatctctagtgatgttgcatttccctgatctctagtgatcttttcatatgctaattgttatttgaatatggtcttttgtaaagtgcctgttcaaaacttttgcctatttttttaaggttatctgcctttaaaaaaaactaatttataagagtttttaaaatataaactgcatgtaagtcctttgttagatatatacgatgcaaatatctttttctaatctgtgtatttgagggtcttaaaaggggtctgagagttcagtgtgtagaaaatagtaccatgggcccttcttggctcttaagaaagtggacatttgaagatagaggaatggaagagagacctggatcttgtgctctttaaatctatcacaactttcttgaagtaggattccaagagcagctggatatgcctcacacacttgatatgatcagtctgtgtttttttggctactctcttgcaaggtaaacagagccatcaatatatgatattctggtagactcttatcatacataatgatatagtgctttgggttaataaatatttgaatacctactatgagcaagcactggccaggacactggaggtgcaaaggtggatatgtcagcacccctgtgcttagtgagctttcagggcacttttaaggtacttttgtatctactatcctgtttgatcacataagggtagggtgaccatcagactggtcagataaaaataatgtatccttttgctcctcaaacctttgaggatcatttagtcactgcccctcattctgtaagaactgtctttctaagatatgcctttgccacatcctgatagcctcactaattcatacctggagaaattcttttttctcaaagtgactaatttagataaagcatgcagaaatgactttatattttaaagaaagctacaagagtcaaagaccataaaatagatttacttagtcccctgctatttaacagcccttttaacaactccttaaataatatttattagtcaactgaaatcatatagcatttattgagggcaagtctggagaggcactgttttattctagacattgaaggagccatgaagacatacaagatgcaattcctgcgctcatggaagttctagcacattggtggtggtgatagtgtttgtgtgtggagggaaagtgttcagtaagcacacagcatattcaagaacaatgtgaacataaagacccataccacggaagctccgcagcaggaagggtcacgttggattgatttcagtgatgaggaaaggactatactcattaagatagtgtcgctgctactataaaaatatccccaagatgtataaccactcaaacacataaaaaggtgttttcaatcccctaaagttaaaaacaggtgttcctgattcatagttgactctgttccaaatggtgattcagagatccaggtcctcccctctcgtgggtcagccgccttcaacacatggcttttaagattgctgggcttgtccacatcaagctggcagaaggagaaagaacatggaaaatggaaagatcttataaccagatctgaaagaggagttccattggctagaacttgagtttcattggctagaactcagtcacatggccacagctaatttcaagggaggttgagaactacagtccacctgtgtgtctgaaaagatgagatggattgttgaccacgtagcagtcgttgccacaggttttgttatggtctggatgtttttgtcactttcaatattcatgttggaacttcagtccctccaaaattcaggtgttgccaatgtgatagtattcagagatagggcctttaagaggtgttcaggccaggagggctccttcctcattaatggcattaagacccttataaaaaaagcctttacacagcatttggctagcttttcctgctgcctttgccatgtgcagcaagaaggccttcaccacaccagatgctggtgccttgatctcagacttcctaacctctagaactgtgggaaataaatttctattttttataaattatctagtatcagctatcccattataagagcacaaaatggaataacaggctttatgctggaaaagcatttaaggtaggtcttcaggcaacttgaagtattctgacagacgtgggaaaggaggattaatccaggaaaaatgaatagcataaagaaggactgggcagtatacaacaacaaaatttaagggcatatttggaaaataggaaatcattcatcttgttagcagcatagaatacatagggagtagtgtgggagaaactgttggaaagctaggttgatgcaatttccaacctacgtcacattttaggaggttttaaaattctgactaaagagttatatccagcatagttttcaggctccttctcactcgcaggaaaaaatgtggcccaggttacctttctttttttcccttcacactctggcctttcctaggaagtgagttctcatgtttatctccccgacacaatggcaagcagttagggagaagggttcagcccctcagcatgggcagcttcgttttcagcttttgtactagagaatttcagagattccaggggctttctgccaaaaacccatctaatgcatggtatctgctgaatgctgtgtttgggatgaatcccaagttcaggagagggaggagagagggaaattcctttttgaccctaggacacaattaactcatacccaggatcctggaatttgattacccatattgttattttggcttggatagctgcaactgtggctcatagttataaaagtatccggtcctttaaaatccagccgcagctttcagcttgatgacctcctgactgattaattggaaagggtgggagctggggaaatccttttccctcccttcagacctgccaacttggctttgaacctacaagaatgttttggtcagagaacatacatccccacaccccgtaccctccctctcaccctcacctctgccccatgttgcgcattttatttgttatccatatgcattcatctttgttgaattaactttgacccaggcttgactatgtgctgccccagaaggcttctgtgtgacttattctctcttccttgagtttctgatgatgaaattcatgttattctgaccttccatagccttctgaccatgaaaataatgttattataaaggtaaatgaaaatttacctttgctgtatagtttgtgggtggtttctttcattgttcctaccagaatgtaagcatgattctatatctttcttaaaccattgaaaaagagagaagacggaatatttgaagtaacagctgaccacctgaaaagtgcttttcaatgcaaactggaagaggcagcccacagtttttcagtcctgagcacattcattgtatttggggtttgtgaaaagggaggtgttcaccttcccatggcaagagtttctagatgttttttttttttttccttatttgaccacaaagccaacctaaaggaatcattactatgcggcgtattttatcctgtgtttgtctttcttcctcttctttctcaagaccctcattgatcccactctacggtcatcccctgcactcacagccttcaaataactaaatcttgctgttcgtaggcatttggtgtttttctctttcagttgctagctctggggaagatgaaactcttcaggccaatgtctgtggtaccagctcattccctagcctgctttgagatctacatccttcatgaagcactaagacatttgaagagacaggatggtgtaatggaatggaacatgaggagaaattaagcagatctgggtcccaattctagcactgccccttacctctgtgaaactttgaacaaaaacttgacttctctgagcctgaaacttgacagcattgataagttttcgctgttttttaattttatctaagtggaacaatacagtatatacacctttgttactgatttcttttacttaatacagatgctctttgacttaagatggcattgcatcctgataaacccatcttaagtcaaaaatattgttaagtcaaaaatgcatttaatgctggcaatacagcagacagtctctgacatatgacggttcaacttaagaattttgactttatgatggtgcaaaagtaatagccattcagtagaaaccacaaccccaccataagtcataggagctcctcaacttacgatgggattgtatctggataaaccaatcataaaggggaaaaattgtaagtcaaaccatcataagccagatcctgtctgggttatatttatgagattcattcaaattgttgcatgcggcaatagtttgcacaataggatttatggtattacattgtatatcacaaattatttgtccattctactttgatggacatttggattgtttcagttattacaaattgtgattctatgatcatacttgtaaaatcttatatatacaccctgttgagcaacattgcacactaggttccccaggaagcagctctaagagatatttgctttcaggaagtttattcctttctgcctttaagatcaaagttgcattcaagatcaaaacttataggggagtgaggaaggaggattgaacacagagaagttggattgaaatgcagtcacaacaaaggcctcagccaacttgtggggagctctggagctgaaatggccctctagagttgtgcaaaatttgggcaaggaggccaggcctttatatatccctttataccagtcattgcatgtggattaacccaggcatgggaacatgatttggggtgacacatttctctttggcagagaacaggggccacatctgcgagctgtcagcaatcagccttcctagtagctggtagaatgcatatttttatcctaaaatgtctaaagtgtgtgtgtgtgtgcacacgtgtgtctaaggggtagtaggtgagtgggtgggggtaaatctgagcagtgcatcacagttcatctttagtagatactgttaaacaatattcccaagtgtttatgcccaaataccctcttaatttagattctgatatccccacatggactctttccaaaaagataaagaaaaatgtatagaagtgaaacaaatgtaaaaaatattctgtatattaacttattattttctatatggtggagaaagcaaaattgagaaccattgaaatgggttgtttattattttctaacttatggcttgatatcctgaaatctgtcaacactacccaggttgttctgaaatctagctatggatttagtagatcctaaagacttcctactgtgctgagaaaaaaaaacagaaaatgaaatatatgaattgacttttctcaaatttcatttttcagagtggccaaatcaatgaaggtccctgtatatgagaccccagctggatggagattcttctcaaatctgatggactcaggacgttgcaatctgtgtggggaagagagctttggcactggtaggctttgttgggttgatattactggggagggcggctgcagccttttgtgatctcagtttggagatctgtgaactttctgtgaattacagaggaacagttaagtagaggcaaaaaatcagagaaacctagtagagtatgtgctgtgatatgcttacctcttttgtccattttgtttcttctttttagaaatttctctttctttaaaaatttctattatggaaatctttaaagtgtataagagtagagagaatatcgcattgaatccccatgttactgtcactcccatttcaaccaccataaacttgtgatcaatcttcctttatctctaccctcatccgcaggggaacactcctccctgattattgtgaagcaatcctctgtagctcattgttttatccgtaagcatttcaagatgaatctttaaatataagggctcttgttcagaaaaaccacataaccacagtaccattatcacacctaaaatgttaaaaacgttttctttttttacatactttaaatacttcatccagttgttttctggcttgcatcatgtccaagaagtcggatttaatttttatgtttattcctctatgtaaagtactctgtgtaaagtaccccccagtctcctgcctttggctgacttcaatattttttaatctttgattgtcaaaagtctaatcatattaataatgtgtctaggggtgtatgcatgtatgtatttaaccctatgtgggattctcttgaattcttggctctgttgtttgttgttgttcattaattttaggaaatgctcagctattattttttcaaatatttctccttccccattctttgtctcttgtccttctgaggctccaattacacatgtgttagataatttgtgatgacaaatgagctcttacattcatttttctgatttatttctccccttttttcttcttgtgtttcagtttagatcgtctctattggaacatctttaagttcactgattctttccttagctgtgtccaatctgctgatgagcctgttgaaggaattcttcttctccgatactgtgtgttttttttttttttttagcatttctctttgactcttttaaaatagtttttagttctctgaaattccccatctgtttatgtaattgtttatctttttcattagatcatttaacatattagacatggttgttttaaacaccctgtctgatagttccaatctctggttcatctctgactttggttcagctgattgctttatctcttgacaatggtttgggttttcctgttttttgtagatctcataaatttttattgaatgctgaataatatgtggataagaacagtagatattcaggtcaattgtatttatgcctagaaatgggtacaacccttttttggggcaattagtgtggaaggttaagttaacctagtcaagcggtgatctgggtttgggttttactgtttctgttttaaccttcagtgtaccacaggcctcaaattcccccagcagtggcatatttttactgggtactggaactggggaagggtactggagaggtttttaagtgttcctgtttctccctcagttttcagtagtgactgcaagtctgtaacacaaaatacagttctatctccagggtcttaaactttccctggtagcagagacctctgactagtattggtgcaggattctgagcacaagttttcctaccctctccccagaggcagaagagtttttacttttgcccgtctctcagagacaatagatctctttctggacctggggatgagaaggtttttagcgtgtacacctaggaacataaagcatttgtttcatgtaagagaagggtttgggggagcagaagggcttcatccttgtctcccagtgacagctgatcgtcgcttgcatacctgtaccaccaagtttccttctttgttcctaattttttgtgaggacccagtggaaatctgtggaaaagaacttaaaaatgtgccccttgtatctggaaccccaggtgattttaaagtaatgtaaaggcctatactaggcctttaagaattttttaaactcttacatgatttcttattatctggtttttatggcagcctcctctttctcctatgctttgccaaagctgagagaattttcaggatctgtctctccttggagtggctctttggaattcacttgactgtgtggtcatctcagatctctgagttcaagaaaacttaccatgtttgagatttcctggccttttaccattgctaggatgggaatagctttctcttactgatttgcatatcctaaagagaagtacacaagtggaactctaaaagtaatttcttaataatttcctctatcctcattttccccctccccattaacagtttgttctaattggatctaaaagatcttacactgtaattggctgatatgtctcttaagtctcttttaatctacgtttctcttctttacattttgcccttattatttattcattgaagaaactgggtcatatttcctatagagctttaaaattgctttgattttgatgctgctgtcctaattttcctttctaatttgcttaatgtttatatgaagagaagctattgattaatatgctttttctctggtttgcaacttccttagttgcaattatagtaattattaatttaattatcatattaattgtagtggattttttttccaaaaactctatattctcttgggattttaaaatatataatcacataatctatgaataaaatattttttgtgtttttcccctaaaacctacaacccaccctcccttccttccttccttcctttctttcttggctcaggtgcacatgtgaatgtttgttacatgagcaaactcatgtcacaggggtttgtggtacagattatttcatcacccaggaattaagcccagtacccaataattgtcgtttctgctcctctccttcctcccaccctactcctcaagaagacccggtgtctgttgtttccttctttgtgttcataaattctcatcatttcgctcccacttataactgagaacatcatgcttatatagactattgttcccattcctagttacttagagtcttatatattgtatacaataattctgccactagttagtcaaataaatctagcaactggaatgaaaactggtaagtacaggttatcccttttctctgtctttataagcatttattaagtgtttacaatatattatagacttttagtttccaattaaaggggtaaatattccatgtgtaagccatgttacgcttttagtaataagtatttgcctatttcaattcaataaacatttactcagtgctgacagagtaccaggcattgtgttggatggtgtgtagaatacaaaatgctcaacaccacacccttcagaattttctaataatttcctctatcctcattttccccctccccgttaacagtttgttctaattggttctaaaagatcttacactgtaattggctgatatgtctcttaagtctcttttaatctacgtttctcttctttacattttgcccttattatttattcattgaagaaactgggtcatatttcctatagagctttaaaattgccttttaccattgctaggatgggaatagctttctcttactgattttcatatcctaaagagaagtacacaagtggaactctaaaagtaatttcttaattgctttggagatggactcttgctctgtcacccaggctggagtgtagtggcactatctcagctcactgcaacctctgcttcctgggttcaggtgattctcatgcctcagcctcccaagtagcaggaccacaggcgtgtgccatcactccctgactaatatttgtatttttaggagagacaggatttcaccatattggccaggctggtctaaaactcctggcctcaagtgatccgcccaccttggcctccgaaagtgctgggatggcaggcatgaaccgccatgccggccactattactttttactatgtgttctttaaaaactaatgtcaatagtcatacaaatttgccaactaaaatcaagcgatgtaacaatgtttattatttccaagaaagtactctgttgagtctttcacagaaataatagtgttttttaaaaaaaaaatgagcacttagtatgtaccttttgtatgtattcatctttttctagaaatttggaattgaatccagagctgctggcattagcatgagttgtccatacttgtcacaccaaatttttccactgtgaactctgaagtacagcctggtgctcttgaagttgactgttttcatatgtgcccaatttctagcacaagaaggggccctgagtgtgtgtgtattctgtgtcacaaggactcttgagtatctttccagtcttttgaggtttgctggatgcttccatgcatggattccatgccaatattgtaaatgccctgaagacagggcccatgtctatctttctcagctctatttctttgatgaatggtaggccctaagtaaatgcttgtaggatgggtggaaagataaaaggatgaatgggagaagggaaggaaggttggaaagatgaaaggaagataggtgggtggaaggaaagtacaaagaattttcgttttgttatctcttccttgtattattagtagttatctttttgtcatccttaaatggatgtatttctgaagatctgggtatttgggtatcccaagatttgggaagatttataaaacaaaatcacacaaatacagaccatttggaaagggatggggagagatgttatgaatgataacaaaattagaattatataaaatataatctttaaatattttcaatcatcataattattagcacaaactaatagctaacaacatgcttctagggagatctcccttcctggaactagtgttaataaacagattttaaattatttataatttattatgttaacttgtttatttcttatgcctgtagttgttgacaataacagaaatagccatgttcaacagtgggctaggttccagctttagtgatcttttgtatgcaccaaattcttactgactttagcatagtcattttgtgctctgttgtcttatggtttatgttatcattctccagttactttgtgaatgagcactttatttcccctgagagttgtagagtttgtaacatgtttagggccatgcctctttcttcatttatatttcacatatgaatgatgtatatcctaactgaagattgggttcacaatagtgctgttgcacaaatactgagtaagtttaactgtctcttatttatacaattattacatttactattttatattcctcaaaaggtaaaatataggaaaactttagtccattccctatctggatggttattccctctacatttgtctcttttcgcatctgccgattctagtctctaggagagagaaagaggccatatatccatgcatttcagattactgaggtcctactgcacttctttttcttatttgtggccagtgtgtataaatttggctgggttgcagatgtgcggtgtggaggccatgatgacagcattatcagtgctagatgagcagtttctctgtggggctatttgaaacaggctgagtgcatgtgtgcatttcaatctaggctgggccagagcacagaggtgctatgattgacacccccgtgagccttcttataaagccagaaaattgaaactcccttctgggtcctctgtgaatgatcaacccctgtgccgggaaacagaactctcacttagcattggaagaatgtctccatcactaagatccttttcttggaatctcaatggtcccagttccattgatccttctattaatcctccaagctaatgaaaagtggtaagagggagtgttgtgtgacacctaagggtggagcaaaaacaaaggaatggggcttctgaaaccacatctgtactgaccagagtatcctgggactgactgggagtcctgagacatcatggctcttagtcagagactgaagacttccaaacagactaaggggttcttttcccagtgtctagtaagggacttttaacaaggagaactgtcccttgggatttaaaatacaatccctaaagttgtgcttcgaggcttcccaatctgcattctaggagactactggttgctaggtggccccactgagaacacagtacagtgactgtagaagtgacaggtcttcaaccttaaaagccactggagagatttttgattcagtgtatgacctgtcaagaaacaattcttaaacaggttatggtggtttgtgcctatgtgggaagctgaggcaggaggattgcctgaggccaggagttcaaggccagcctggtcaacacaaaaagaccctgtctcttaaaaaaaaaaaaaaaaagagagactcggtgcagtggctcatgcctgtaatcccagcactttgggaagccaaggcgggtgaactcctgaggtcaggagttcaagaccagcctggccaacatggtgaaaccttgtctctattaacaatacaaaaattagccggatgtggtggcgggtgcctgtaatcccagctactcgggaggttgaggcaggagaatcacttgaacccaggagatggaggttgtgatgagccaagatcgtgctactgcactccagcctgggtgacagggtgagactccatctcaaaaaaaaaggacaattcttagagtcctattgttcctatctgccttggtgacaaaaaaaaaaaaaaatgagttgggatgtatgagttaggagcatgctggtatgctctgtgagggaagcatgtcagctggctggccatgatatggttaatgtgctccctgctctgggatggatggcttgatgcctcctaagtgatagacacaattcctagtgcctcctgtactttattttagagtcttcttcacaatgatggtatagagaccctaatgaccccattttgttgatgaagtcgttgaggtttagggaggaatgtcaagccgctggccaaagtcacactggctgagccacaattcaaacccaaccttgctggcttcacagtgtctgctgctgatgttttcagttcatgctgatgagtcatttcccaccctccccaaccccctcctggttattcttttggatgaaggtagaaggaatgccaggggacttgggagaatggtctcatgtaaacagcatggcatgagaagttgagggacccagcttccatcttgactccccctctcttagacaaatagcttagcttctctgtgactcaatttcctcattgcgagacaacttcgtctgaggggatgatctgtaggtttcttccatcatgatatttcaggttgcttctaactagctacccttagtgaggagcaaacctgatgaattatatgcactacatactaaagaggcattcatttattcattcagtgaacatttactgcacaccttctatgagccagcccagggtagagtgcgagtaatttcagacacaggcccttccctcagggagtttatagggtgttgctatggtcaggatatcagccttgtgtgaaacactatttattactattttacttattaaatgtgttgtgacacagaattattcactgggagccacattgcccacagcacaggatgtgtcctttgctgctgtctgactcttctgcgcttgcacctggctctgacttacatgcaggagagctttgttctctaattgatgaacattaggtacatttaagaatatttttttaagcatagaaaggtgacttttttttcagtgagccttgctttttcacctgatgttaaagatctgaacataagtggtttgagaaatgaaaatcaatctatctatcagtctaccgatcgatcgatcgatctccatcacaattctgtagcatgttctcaaatctcagatccacccaaaaagagtgaccccactttaacctcataactccactatttttcaaagacaaatctttatcttgagtagctgaaaaaaggatgagaaggctgcaaattaatgaaaaccatttctaaatgaaaaaaggtaaactggagaaataaagggaaaatttgcagcttgtcctttagaaagcctgccccagctctcaccacataggatgctttacccgctttcttgcaactcctgagggccacagcattgctgggataatccagtggcagttaagtccataggctttggagccaaattgcccagcttggaaccttctttttaccacttagtagctgtgtggcctcatacagatgacctaagctcaatctcttatttgtaaaagggggctatcaaattgtggaaattaaataatagatgcataaaatcccctagcgcagtgcctggtgccttgctgctttcttcttagaatggaatttatcctccttgtgattgtgcttcaaaaataatcaggaacctctttgagtgagtggcctctcttattgtatgaccaacaatcctggtttgtccaggactaagaagtttcatgagatgtgggactttatgtgctaaaagtgggaaaatcccatgcaaaccaggataagttggtcactccaaagctggcaaagtcctcagttttccagatgaaaatggcaaggagaaatcttgatactgaagctgactccagtgagaacccccccatgtgagcaaggccagggccgtgaattaaatgagagacccatggctgctttcccttagcaccacattcaagcaaaaagaggaagaggcctcactcactacccccaggcattctgccccaaacatgagactgcatacggtgcctttctgctgaagcaagtgactttcaagcccggctgcctgtgaaaatcacccaaggagtttttaaaaaagaaataccaatgcctgggccccatcattaaaagtttttattttattggctcagggtgagacctgagcatttgtatttttttaaaatctccttgggtgattctaatgtgcagtgcagggttgaaaattgccaacatatgttacaacttggagttggcaacaggtgcaaattgacttatagttttcctaattgacaaatttagaatttccttatctgagtttcagctgtaatggcttgatctgttagtaatgcatgggatgctttattgagctgatgtgtccatactggtgtttccatgtgaagaaaacatctttaagatgattgagcattctctttatttttcccttttcttttgtgagggcaatatacttattagtgtcctgcctagctcaagtagcatggttttgaagattgagaaaattcaaagtttaatttgagtggagggggaacagtgatatttctctagaaaaaaaaaaaggccttcttttttgtaccagtttttgctggagtcatggcagagaagagctgagcgccctccttctggtatgtggatggagatggctgcttctcagggctgctcagagtaagattgcgtgggctttgggctgggctaggttggatgagaaaggcaaggtgagtggtacttacagctttggaaatatgggtatattctccctgcaatgtcctgagccaggcagcaagcttcaaaaattgtgctggtgttattcaatgctaaaaagacactcactctcaagccataaaaagacatgaaggaaccataaatgcatattattaagcaaaagaagacaataaaaaaatacatactagatgagcccaactatatgactctagaaaaggcatgttttaaatgtgaatttctatgcaccattgacaactttgtttactttatttttatttattgttttttttgagacggagtttcactcttcttgcccaggctggagtgcagtggtgtgatctcagctcactgcaacctctaccttctgggttcaaatgattctcttgcctcagcttcccaagtagcagggattacatggatgtgtctgccatcatgcctggctaattttttttttttttttttttttgtatttttagtagagacgaggtttcaccatgttggccaggctggtctcaaactcctgacctcaggtgattcccccaccttggcctcccaaagtgctgtgattacaggtgtgagccaccgtgcctggctaacaactttaaaaatttatttttttcttatgaaataatacgttgttattgcgaaaatatttaaaaggaaagagaggaaaagcatctgcagttctaccacttcagagataataaccatgttaagagtttggtgtatattcttctgtttacttgtgtacacacatatatacatatctatattttttataaaaatatactgaatattcttttttagtaaactgatttttcatttattaaaattgaatgcacaattacctattggatacaatgttttctatttaagtgatgagtacactaaaagccactaggcaatatatccatgtaataaaactggacttgtacctcctgaaactataaaaataaaataaaatgaaaagaattgaataaacatggttttctgtgttactaaagattcttgtttgatttattttgtctacccacaaggttttgaatgaattttgtgcaatgatcctattgttcaacaattaagcctgggcaacacagtgagaccccatctctaaaaaagtaaataaataaattagccaggcatggtggtgtgcaccttgagtcccagctactcgagaggctgaagtgggaggatcacttgagcctgggaggtcgcggctgcagtgagccatgattgaacccctgtactccagcctgggtgacagagcaagaccctgtctcagaaaaatcaaaacaatatttttccaatttttctttattctcttatctacttcattgaatgtcctatgacttaaggttaagaaataaaatagctgggtcgaaagctgcatgatatttttaaagactgttgatcattattgccaagttaactcttcccccgtcaaacctttgctaacctgacaggccccagatggtatcccattttacacacttttctttgaccacagtgagggtgaacatttgttccaatgttgactattattattttcctctgacaattgcatgcttgtgccttttcattccattgtccattgaggtttctctttttcttattgacctatgaaaacattaaaaaaatatccagcctattatccctgtcatatatatagtgtgaacatttctactcccatttttactctgtttatagtggggttttagaaaaccatttgatacctttgtgctttctggaatttcttgtttaatctgcctgtcactgatacagcatagcgttcacttgcctgaaagcctttttaaaaggagagttatagcccccaaatccactccaaagtacactataatcatccagtggaaacatctgtgtaattgaagcatcattaatgtctctgtcccaaactcaaagaactataaagggcattgttaattttacttcatcatcagccccttattaatcttggcaaatgtttaacttgtaggcaaggatgtccaagccaactcacaatttactatgcaattggctacaaatgttgaggtgggtttttttgtttatccacctaaaagaactttatgtccctctagcactaaattatgacatcttatctcacagatttaacagcatctaatggttctatctctaggtaatgtaatccagctggagttcgaaggtatgcaaagcccatgttttagaacaaaagggtatttttctctagccagtaaataaaagtgattttttttttcagctgtaaaaggacaaaaggttttgaagtgatcccactgggcagggtttcctaaacttgttttttggcagttggccatggagctaactcagtcttccaaacttcttccatttttgtagcagtgtaaagaattcactggataagactaaagacacttcatggtgtgatgattaatgcccagggtcctgttaacccagaggcaaccacaactggacatccaacagtgccattagcagaccgttgatcagtgtgtaggaagaactaaaaacctgaccctttttcttattgattttagtaccttcacagcccccctcaggtttgcatgttttccttattgagaaaaaaagtttaacatttaacaccataaatgtcacaagtacggtaaatggtctgtagctttagttagaagttgtcaaagatgtttgacttaagtattgtttgatcccattttcaggggttaaacagctctgtggcgttgcgtctcccttgttggttttccatgtatgttttgtagttctgaaacccaagaatactgttgtccattctcattgccctgctgcaagaaggtccactctgtggacccagtcctgtttcttaagacattactattgctagagtgagaggataaaattacatgaataaccaagaacaatttctgaaagcaggtattgaggaatcagcaccttgcagtaattcacacagctttattaaaattaccaacaacaagatcaacagcaaagatatgtgatatcccagccactgttctgaacatctgggcatatttagttgcttaatcctgacagtaaccccatggggtaggggctgttattgtccatagattacagatgagtaccgcaaacaaaggtaaatggctgagccaggattagaacatgagaaatctaactctagagcttgtcctcttaacttgattaagttgatacaacaacaatgccgcaaaatgggtgatggggtccccattttacaaatgagaagctgaggctcaggggaattaatgactttgtaataactttccacacatctgtgaagtagcagtttggcttaagccctaattctaaagccttccccaggataccacatgtctcgtactacaacacatttctttacatacagggctttattcacttcagagagagcttataactggctaacagacagatacccaaatgggcctgtgacacactcttctgggttctcattgcacaggaagctggtcatttagactgcagtcttcatttgtgtgcctgatgcaataagaactgcctccaactctttctatatgaatagctgtaggatataccttctctattcattcctgcctcaggaactttgctttttctgtgccctagcttggaatacgtcatccccagatcttggcatgtctgacttcttctcaggggttagctcagatgccattgcctcagtgggggcagaccctaactatctgtattaatctcctagggctgtcataacaaatcaccaccaactgggtggcttaaagcagtagaaatgtattctcttatagttctggaggccagaagtctaaaaccaaggtgtaggcaggaccacccttccttggaaggctgtagaggaggattccccttgcctctttcagtttctggtggctccacatgttccatgacttgtggcggcacaactgtaatctctgcctctgtctgcacatagcttgcccctctgtatttctcctcttctgtgtcttctcctcttcttataagaatgtttatcattggatttaggtgcttgagataatctcacctcaagattcctaacttaattgtatctgcaaagagcatttcccaaaataaggtcacattcacaggttccaggtggacatatctgttgggtcggggaaccaccagccaaccttaggtcaagcagcttttggtgctgttatgctctgtgacatcatcacctctttattttcttcaaagcacttgtccttatttgatgcatcttgttctcttatctacttttctttgcctgtctccacctaactccatctacttggattcaaactttatgagtaaagaactatcttgttcactgctttaccccaagacgtagaacaatgcctgatatattgtaggggtcactaaatatttactgaataaatgaataatctcattgggctaatgagatgtcaacttggctctctgatcccttcagaaatttccaagttttattttttttactattttatttgaatttcagttggatatttttcagaaatgcaaatgtattaggagacatatatttaatataatgggtaaatgatccaatcatttctacataacattcaatcactaactggtcttcttaattcatttagcttttgctttgctcccacaaatgaatgctcagcagaatttttctttcacctttaggctctgaccacctccgagagaaggatggcctgtgggctgtcttggtctggctctccattattgctgcccggaagcagagtgtggaggaaattgtccgagatcactgggccaaatttggccgccactactattgcaggtgaggagaaggggaagggtctctgtatggaccctgaagaactactcctagaacaggtttctaaaactgatgggctagaaccttaaaaaggaggcatcaggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagctgggcgtagtggcgggcgcctgtagtcccagctacttgggaggctgaggcaggagaatggcgtgaacccggaaggcggagccgagatcccgccactgcactccagcctgggcgacagagcgagactccgtctcaaaaaaaaaaaaaaaaaaaggaggcatcttcccagaagatctgaggaacacagaggctggagctgaatcaccccttatagatagttgggggtggtgtcaaaggctaccaagctggaaggcaccaatttcctttcccctgatgacatcactctttaatcttttcatcaatgcctataaggtaggtggccctctcaagaggaactctgaactgcagagctttgaaaagttatttggtaactatcatggctgtgagagccgtgcagtcaaaccagaggcatttcttgttggttttccattcatatttatcaagtaaaaaaggcagacacagaagctgtgacaggttggtatgctttcataatcctctctctacctctttcttacctcctcaccaataatcagattcagtgtccaagatgcctgagctggcaccccttgaaggaacctcatggttcaagagccccagatattgttaaagttttgtcctcatgaaaagaggtacaggccaggtgtggtggctcacgcctgtaataccagcactttgggaggccgaggcaggcggatcacctgaggtcaggagtttgagaccaggctgaccaacatggtgaaactctgtctctactaaaaatacaaaaattagctgggtttggtggtgcacacctgtagctactagggaggctgaggcaggagaatcgcttgaacctgggaggcagaagttgcagtgagtggagatcgtgccactgcactacagcctgggcaacagagtgagactccatctcaaaaaaaaaaacaaaacaaaacaaaacaaaaaaacagggaaaaagaagtacagaaaaggaaaccattattttggaaggaagaaaaggaaagatcagtgggtaggagcttagggttgggggtctatatcactttcccgttgtttaagtaaatgaaagtaagagtattctggaagtgtggttacttgctaggagtgtgaacctaggtatgctagatatgtgtacataacaagaacgaagccatgggttaggaggagggagtaggaaacgatgttaactgtaaagaacttggaggtggggcaagggaatccttgggtagtctcagagactctgtattaaaagcagaaagattgtgactcattttgctttgtttatgaatagttaactactttgaatgtttggttgtgtttcaagagcttaagggacagaaagagagctttagactttcctcataaggtgattatttcttctgttaagaagacttttacttagatatgtatcagagaataaggaagcccatgactgtactcgttaaaatcaaagagattacaaccttctgggagatgtaaacaacaacaacatcatattcttagttcccatttagtcaagaaagctggggatgtgatagcttgcaaaacaactcgaattattcagtgtatcataaaaaatgaattctcaggacaggtagaaacttggtttactcattatttctaacaagtaccaaaaccccctgattcatgtgtgttttcttttcctggcataccaagagttaattggcacatgacattcttctattgcatgaagctgttccaaaacgtccaacctgacaaaatatattatgattgacaacctctggcctagtgagatcgctttgagtcagagatgtgttcctcataatttgtggaatgattatctaggtttctgctggtgtcttgaataattggtgttatggtaactgtatttataatgtagtttattttttgtggccaagagcttacatgataattacttcttcataacaaataccatatttgaaaataatatgcaatacagatttaatttcttctaggacattgagttatgtttcagatttctttccaaaaagatcacagagataaagaaaaagggaggagaaaatacatagaatgaaaggtaaacatttccttcaacccccagcaaatggcaaattagaaggtgcttgtgaaatgtaattattcctagcttgacaattttcttggcaggctgaaaataataaaacaatttcactttaactaatactgagcctgaatatctgagaaaatcttccagattatttttcttgtatgagtagaccccagaaggaatcttccatttaaagatttcttccttgaaaagtgtgttgttattggtggtgatcagacggggatttgggggtggaaggcagtgctagatcctgcttgtatatgaaggtgaacgtttgggcaaacagatctgatgattctcaaccctagactgaacgtgatctatcatattagtggatttttttcaactcctgaatctctttcaatgcctctctgtctcctgctagactctcttctcctgtcttcctgcccctttctccttggttgggtctttaccttctccaaatgtctacctttaaagtgactgcagtctcagaatatatgccctgctgaaaaagaatgttctgagggagttccttttttttccctctgaggctgagaaaaaaacaccttgtgtaggaggaagagaataaaagaaagggatgtagatgcaggggacccattgctagacatggtattattccatattttgcatcttggctaatatgctgatgtttactggatgtcttaaagatcttgagtggaaaaaagtagtaacaactattcagagcttccttcttccagttcactctgagaactcacatcctttctctatgctacaggaagcccaaatgtaagatcctccaagtgacttgggtgcagctgcccctcctatggcttccttcttaaacagacagtcctaggtgtgccattaggtctcagccaagaccatctgacattgtaaaatatagtttatttatggtggtgatggcaaataaaagttgttagctgtttttaagcacaagtgcctggcactgtgccaactcttggtatacatcatcatattttaaaccccacaatgacaaatgcaattggtattatttttagtcttttattttattttttctaatcgacttccagccccattgttacatttaatacgcttggctaggaggacttttttgaatggaacaattgtgatatttcttccaagtttccaagagttctatattgtgctcagttccccttctccctttctttttaccttccttgatttttctctctttccttccttcctttcctttctcccatttttcattccattctacttacatagaacttactatgtactagaaatagcagagagcaagacagttcctggagctcacgttctggtggccaaagacaggcaatgaataggtaaacaaatatacaaacaagatacatacagtttgggataactaccaaaagaaaatatgaagggtgatgagagaagaagacgagtggggaagctgccttagatagatggtcagagaaggtcacattctaatggtgacagtgggtttgaaaatggaaggaaagaacgagcctggtatttgaagagctggcagaagaatgtacaaggtagagggaacacacagctagcgcaagggcccagaggcaggaaagggtgcaatgtcaatgcacactggagaagagaccagtgtggctggagccagtgaacaatgataaaaagacagaacaaagttgagtcaaagaggtgggccagggcagatcccacagtgcctgatagaccaaggttaaagtgttgagttttgttctcaatgtgatgggaatttatagagggatttaatagaaagaaagtggcatgatttgatttttacaagattactctggccgctgtatggggaatggactgtaagggtcagatgaaagaggggagatgagttgaaggtgcatttctgtgctgtccttccctggaaacagaaccaatgattaaataactgtaagtgggccacccagttgctggttctctgattaggtttctgttcctcctgtgtcctcaccaggtttgactatgaggggttggatcccaagacgacatattatatcatgagggacctggaggccctggtcacagacaaatccttcattggccagcagtttgctgtggggagccatgtctacagcgtggcgaagacggatagttttgaatacgtggaccctgtggatggcactgtgaccaagaaacaggtacttgctaggaaatcactacaacgggttatcaggcagaaccagtggccaaaatgtcctagaactggagaggtccttagggatgatctaaggtgacctcattttatagatgagaactgtgcagccaggaaagaggaaagcccttgatgaaggacacctaacaagttagtgcacagggtagattagaacatgggctttctgtggccaggcacagtggctcatacttgttatcccagcattttgggaggccaaggtgggagggtcacttttgagctcaggagttcaaaaccagcgtgggcaacaaagtgagacccccatctctaccaaaaaaaaaaaaaaaaaatagctgggcatggtggcacacaattgtagtcccagccacttaggaggctaaggtgggaggatcgcttgagcccaagaggtcaagtctgcagtgactcatgatcacaccattgcacttcagcgtgggagacaaagtgagaccatgtctcaaacacacacacacacacacacacacacacacacacacaaaacaaaacaaacaaaaaacaaaaaaaaaaacaaaagaacatgggtactctatgtccagtatttgtcccacttggtaatggatagaccaatatgtcaaataaatacagacccaacatttccttatgaaatgtttgtagcctgcaggtgctcatatgtggtggccattattggtgacagattcagaaaagttaccaagaactaaagatccctgtccttggggcctcagtgagtcagtccttggaattgtaaagtcaggagctcagctggcatctttgagcccccgtgccctggataggtcttttccagttttggaccacattcccacttccattttacaaacttttcttagattcaagtctcattttgatgtagaattcaagagatataaaataatgtgccttttaaagtatccttgggatatttttgctcaccgacaaggaaggctcggaaaccattccttcaagggaatggtctaatccgcactcagttatggattttatctacttgcaagaagcttgtctgttgagcttatttgttttgctgttaatgcagtattcctctaccttatatcttcctcagtgtactcagtgcttggataccttttccttagattttctttaactgttcacatcaggccagttctgcaactgtatctcaagttcatctatttatttcatttcccctccccctccataactctgactgttggttttcatttttacactggaatgtgtttgatagggtttggctgtgtccccacccaaatctcatcttgaactgtagctcccataatccccacgtgtcatgggagggaccaggtgggaggtaattgaatcatgggggtgggtttttcctgtgcagtcttgtggtagtgaataagtctcatgagatctgatgtttttataaagggcacttcccctgcacatgctttcttgcctgctgccatgtaagacatgtgtttgctcctccctcgccttccaccattattgtgagtccattaaacctcttttccgctataaattacccagtctttggtaattcttcatagcagtatgaaaatggactaatacagtattgatttcccccaacctcttctacactcttctgtctgagctcaattgtagctataaatggatacatgctgccaggatctgctcttgggaatttttctggtaaagaaagaaggaagttttttgttccttttcccagattccaggacccaggtgatatcttcattggctggtggtcctgagacacactagagcttctttgcaggtctgggtttagctcaaggggggtgatgagagaccagttacttaatacttagcagcatccccattgttggcaagttacagatggttcctttgctgccgttggtcctgttgggtagaggtggaatccctgcatagcagtgttgttgagaccctctcaggatgtcaacatgcatcagcattcagccccagggatagttgagtctggggtacactttaggtaacatagtgcaaaataagcatacttttcaaactatagacatctgaaagacatatttgaatttaaataaactagtattctaaaataaccattaagtaccttggtgcattcattcagtggatatttattgagagcctaccaaatgcataatttgttttttttcatggtacagttttaaaatataaatatatagtatctttattgatatataattcatataccagatggttctctcatttaaagggcacacttcaacagtttctagtatatttacagaattgtgcagttatcaccacaaccaattcagaacactttcatcaccccagaaaagaaatgttgtgctctttagctgtcatcttcctcccaacatccctccaacccacagcccctggcaacccctgatctttctgtctctatggattcgcctatttgggacattttgtataaatggaatcatataatacaaggtcctttatgactagcttctttcacttattgtaatattttcagggttcatccactttgtaccatatatcagtacttattccttttattaccaagtaatattctatcacgtggatgtaccacagtttgtttatccatccatttgctgttggatgtgtgaggtatttccactttttgactataatgctgctgtggacatccatctacaagtttttgtgcagagataggttttcaattctcctgggtacatacttaggagcggaattgctgggtcaaatggtatctctatgtttaacccttaaaggaactgccatatggtcttcgtaagcaattgcaccacttgacattcctgccaacagtatatgagggttccagtttctccacacctttgctaacccttgttattatgtctttgtgatttaaaaatactgttattttaaaacaacctactatattatggattatttttaaattaagatagaaggagatttgatttctataaggagaaacagaactatatctctctgttagcaaagctcagaggagacataatactgccaagtgtctgcttcctacaggaggcaggttgttgtggttctcttcagtattctcttgtgttggagtcagatagacacaggattgaaagctggccttgtcactgcctagatttgtgattttaggcatattatttaacttctttgaacctcatcttgaggggaggagctagtgataattatcacacatgcatcatggggaaagtttgaagagaaagtcatgtgaagcctcaggtacagcggcaagtacctaattgatgctcaagaaatatcagttccctccccttgaccagaatccttaatttgattgaatatcagttcaagaaaaggatacaactattctctctctctctctctctgtgtcacacgcacatacacacacacacacacacacacacacacacacacaaatcaggtgtatatttttaaaagtaataatcagtgtgccctagggttagaaaaccctcacccaactcttctatttattctattttaaaagtactttgcagtaaaatttgaggctcagattgatgatcccaaggtagtgggagattcccagttgtctcttgtttgggttaaattctacttacttaaaaaaaaagtagatagcagaaataattttcaacaatgaattgttaaaatttgtgctgttcccgttttatacagaaattctcttcaagagcagctttctgctccagagcacccaaggcaaccttggtgccattgtaaatcgtgtgagcaatggttgggtgtgcaggcttgaagtcagaaagttttgggtttgagcctcaactctgccacctccttgctgggttatcttaggcaagctattcaacccccctacacctgcatttttaaaatctgtgaaataggaataataattgtggctgtctcatataagcgtttgggagaattaagtgagatgacacttataaaatcctggcacataacaaatgataacaattggttaaataaaattatttatgttttaaaaaaagcatccttgggaaagactgtagcattgaatgaaccagatatgataagaaaagcagaaaaaaaacacacaattttgcagtgtcacataaagatttgagaaggccccttcagtttctaagtcatctgggaattgattcaaactcatatttctccccctctcccatcccccagcacacacactctgctttagaaagcgaaaggttttttaaggcagcttggtctcctttatgtccttgacctgaggtcagagtcaggaaataaaccatggaaaaaaatcctgtttcacatacatctccagagataaagtagaaatgcttctccatccaaaatgaaattaaaatcctgttctggtgataaccaccccactactgccaaccctgctgctgtggaaacgttcagtgaaggctatcctgcctggctttatgggaccattcaaggagcaagaaggaaaccctgaagttctcaacccctgacatgatttcccagggacctccctggcctcaatgtggcatgtttggtttcatgggatttactatggctgcctccaagtgtctgatgcatgtgtgacctcggatgccaagagaaaaattgatgtgtgctttccactatacagggcccaagagagactctgtttgatttagaaagcattttcatgaggcatggttcaacaactgcagttcttccttctatcttcatgaggatatgtcactattttcaagtgaaatctagtcacatgaaggactgactgatgctattttcttcaaatataagtggaaaaaaataagcctatagctacaatgagaataggggagcactttgatcaaatggctaagtagttaaaggagttcccagtttataccttctaaagagataggacagagaggagttgtgtgattcatgtgggttgcagggtgagccactctttcttcaggggcgacttcattgtgcaaacatcgagggtttccatccatcatgctaggtgagctctttcttcccttcaccatcgataccctaaagaatattatcaagattgtctcttactatgatcttttctccatctctaacatgtggcctaagtcctggaatctccactcagtgccacagttgtgagactcccccagctctgatagaaggaatactccaatcctggtattgtgagtgaaggacagtgtgacagaaatggctccacattgagagacagcatatttccactatggtgggtatcaatccagaaccatgacctatattttgaaaactggatttgaaatgagaaaccttgacacttcaggagcaaaatttaagcaactgagtctctttttatgactcatcctaatcctatgttgttgttgttgttgttgttgttttcttttttctttttcttttctttttttttttttttagacagagtctggctctgtcgcccaggctggagtgcagtggtgtgatcttggctcactgtgacctctgctcccgggttcaagcgattcttgtgcctcagcctcctgagtagctggggctacaggcgtgcaccaccacgcccagctaatttttttatacccttagtagagacagggttttaccatgttggccagtctgatctcaaactcctgacctcaagtgatccgcccacctcggcctcccaaaccaactcctatatttctaacaagctcaaaaatcatgaaactcttccagtgctgaagtcatttgcaagtcacagttcagctgatggttaaaaagctgatgtaaataaatgcataccagttaggtgatgtggaaaaccaaatccaatttgattatgtcaggctaactctgagctgattaatacctcttcaagttaagcaggctatgtggaaacattttgatgttgtccttaacctggaaaaaaagaaccgtttgaatttagttcagagaaaaagcacactttgaagactgattttgaagtcagttttcttttagcgttgttattttaatttgcaagaaggtgtctgctctttttaatttcagtgtttagaaatagtaaattggcaatctcaaagtcacattttatttccagcatgtggtgttttaatatgtacctcgatgcaacaaacccctggtcagcaaatatgaagcagctcactaaggtgttgtccccagcactgtataaaagcaactgaatcatatcaactggagaatctgaagctttaagattgagttcttctctcttcagagttagctagtcaaatttcagcttcaactttttgtttttgttttttgttgttgttttgttttttgttttttgagacggagtctcgctctgtcaccaggctggagtgcagtggcatgatcttggctcactgcaacactgcaacctccacctcctgggttcaagagattctcctgcctcagccccccgagtagctgggattacaggcatgcgccaccatacccggctaatttttgtatttttagtaaagacagggtttcaccatgttggtcaggctagtctcaaactcctgacctcaggtgatctgcttgcctcgggctcccaaagtgctgggactacaggcgtgagccactgcgcctgacctcaacttcaactttgatcacattctaatcaatgaactaattgagagactataattgtaacaatttatccttgtcccttttgctggagtgccatttgctggagtgtggtttgcgcatctggaagtagagcctcagaaatcattttagtcacactgattaacccacctatagaatttagttaaatctgaaaattagcatacccacaaatagcacttctacactgagtcacagaactgtttaagtgaatgggctattatcacatttagtttattgtgattcgatgtgggtttaaaaaaacctttttctttgaaaattgtgatgttgaaaagaatctctgcaataaacatatattcctttcctaacttagtctaatatggtgaaggttgttagaggctgattcatttacaacttcatctattcagtgagtatttaccaaacacctactagacgccagtcagctcattagcaccgaggatacaacagtattcaggacagttgagattcctgtctgctgcttaaaatctagcagggaagataaattgatattaaactttaattactgtagagtttgttgaacggtattacagaggaagaacttatttggtgtgcatagcgggggaaactagactagggctctagaaagttctccatagagaggtgatatctaagttgtactctgaagaatgggtagaaggcagcccaggtgaaaccattttatcagactctttgcttttcttcagtccaatgtggttgttatatggttgtttagctctccagataaagagctaaggtttcctataggcattctcaatgggatgctacgataactgtgattaggattctcaacttcagtgctcactctacaacactgtagttggggaaaataaagacagtcgggctctgtattgcactatggcttgtgctaggacattttgaaaaccataggtttaaaaaaataatttctactagccacttttcctgtgattttcctatttgtcctctgaaggccaaacgcatattcagtactttataatgacctgtcagctgatttgaaaataaaatgggaagctgggtgcaatggcttatgcctgtagtcccagctacttgggaggctgagacaggaggattgcttgagtccaggagtccaagatcaccctgggcaacacagcgagacctcatctcaaatttttaaaaaagcgagaaagaaaatagaatgagggagaccctgtttctggttagtcgggaagttctcatctccctgtttctggttaactggagtattgttataaagaattaccttctcctggcataagttgattgctttagaactattgtctaaagtgtcagtagtaaaattgtcctaaaatgtgtagcaagcgtgtaagcattatcgaatgacaacacagttactttctattggaatactaatgtctctgtgttgtcgggtggatgagcttcaccaggaaatataaatataaaagagaaaagctgcaaatgatcacaggaactaagggaggaagctatgccgttgtctgggtaaagtgtgcctgaatccaaaatatcccagaactggggtggatattgtgtgaacagggatcagcagtcattggccaaagaaatggggaaatagaaggtgcatgattttgttccattgttccagttttgagagttggaatttggatgaggaatagctttcaagtcttcgccctccagcagccctctcatcacctagcatggcttttctaggtgagtgctttaaaagagcgtgtaaggagtcacttgaccttgatttccccagatagttctttgcaattgttagcccccaagaaggctggttggtttttaaaagaggctgggtgagaactgctcccaagagcagggcagctgagtatggctgtgcagtcagcacactgcacaatggtacccagcctaatggggaaggagaagctgaagtccaagccagccgaaggaaggatggttttctgcaatttatccatgctgggggtagaggggggcacctgtttttaactcacacaaaagcaccatatggagtaactgctgccttgctcaaccacttttggactcatgctcacagctaactctatgaattattaaacaaagaaaaatgggtaattctaggtgggtttttttagtgtgtgtggaaagatacgtctgttcaatccaaatctcctgctttctaggctgcatgcccacttctacaaaatatggttcagatgttacgaagcagtatcttcaccttgacgctttccagataaatcgttgtgatttcctgtgggagataagatctgagttaggctcgcagagtctctctcttccaaggctgtcctgtctccaggttcacatgcctgctgtggccaactgactatatatgcgacactgtaccagattgcagggccatatgctgttttcccctggaattcatcccaagtcagtatttgactaggtccaatgctgccaaataactgttggtaatgtacagttcacccttccctgcctggctacaacatgtcctacagtctccaaactaatatctggcagctctgtgtgtatttagcaacttacagatttccctgtattgatttacacaagggtttatttttaaaattaaaaaaatagtaaaaaccctaacatttatttatcaaacatttatcagatacctactctacataaggctctgtgtcagctttgggaaaaatacaaaacataagatattgttcagatatttcgcatgagaagcaatgtgtgaatatcagtagttgcatatggttcaacctcagattgtaagcctagagtcagaagacctaaatggaagtaaatgaagctcctccatttactaaatacgttaccttgagcaagtgttttaacttctttcttttcaataaaaagagagattggcaagaatgactctaagatccttctttcaggatgttaagatctgacactcacaacaacccaataagctaggctgtattatttttcaactgctttttaggaaactaaggcttagagagcttaagtgactcaagaccaccagctaaaaaagtggccaagccagcattctagcctgagtttatccagttgctattcttgtatcatttccaaactgactcttcataaacagcaaatcaaagagggggcaaatccagggagaaaaagagatgctacagtgataactggaagcacactgaaggatttttgtgtggagatagctgcatatggacaagggttatgaaatcctttatcaatcattcttcactgggacaaagctaaggtgagcagaactcgactgtcatcattaaagctcacaaccacaggcactgaaaagtaaggaaaacactaagctggaactgaagtgctcttttgatacccacactcctccccaccacataattaacattgtcttctaataaaggagagcatatttttcccttttttgagtgtgtggctatgtgtcatcctggatattccggctactctagctgctgtggctagtgagatatcatgaattctttcacagttgctccaggaattcctacgaagactgtgctaaaaaaaaaaaataataatgtcagatggttcaagaggtggttctgctgctgacaaggccccagggggaagctttcaggattcagtggcatgaagttgttttattagcctcactgtgttaacagccctcctacagtcccagcccagtgagagcctatgtatgaaaccttaaatcctaaagggaccttccttataagggacatgtagcacagtccagtcacttgatagatgaggcaagtgacccagaaaaaagaggttattgcaattagttactgcacattagaatcacccagaaagcttttaaaatcctaattcccaagtaacaccccaaaagaattaaatcacaatgtttggggtgaaagccaggcaccaccattttttaaagacctcccactgatttcaatatgtagcattttgcaattaatgagctaatggtttgcctaaggtcatacatctggggacaagaacctaccatggttcaactccattgtttttagccaaaactggcccttgtcttaagacatcttgagaaatggtggaggaataaacagtcaagccctgccatgatgatgctatgccaggcactttcttagtttatcttttgcaaccactcttcaaggtagatacatcagctctagttcaccatgaagaacgtgcatgtgttttcatgtagcctgtggatccttgctaaatgcgaaggcaggctctctgagactgcctcagggggactgcagtggtgctcactttagttgtcgaacgtgcagtgacattcattcaacaagtgtttatggaaggtctacagtgtgccaggcattgtcctaggctatgtggataaaatgatgatgaatgaggtatataaggctctgtcctcccagagcttgttagctaatgaagaacccaaagtcataactcagcaagtccaaaattttaaggttaacactgcggtggaaacttgttttattcattttcactgagccttgtttcttcaagacttgtggcggcaaaaacacacataatgaagttgttagaatataaataagaaacataaatcaagactagggaatatataagtaagagtagagtcaagaacagaagaagaaaaatttatagtcatgcaagtcatgaggatccacttgggctgaacctcaaatttggcattaagtatcctggcagccatatcgaaaagggaaatgtggttagttacaaagttcttattgtcagaaagaaaaagaatacaagttccttagggaaggaaaggctttcctaatacttggctcttgaaggaatgtctcaggcagagcttcatacagcctctaacaatatttctactagtgactacaaaagtggattttataagacatagcttgtagcatcctgcagtaaaagtgagaacataaaactaaagtgcaatttaataaattcatttatgttaggagtaggtggtgagaggtaagttgatttgagccaaatacaggttcaggtgaacctatgactagaagctggaacaccagggaatggagggattttatatccttataacaatctacataaacataatttctctctactgagattttgataattcaaatggttatattttctatcttatgctgtagggataaaaggcaagtattctatgttgtgaataatgtaatgccttataccaggggtcagcaaacattttctgtaaagggctaggtagtaaatattttataccttgggggctagatggtctctgccacaactattcatctctgccactgcagcacaaaagcagccatagacaagatataaatgaatggacacgactgtgccccagtacaacttgtttcataaaagtaggtggcaggtcaacttcttacctacaggctacatagtgccaacccctagtataacctaaaaaataaatgcgattattggtattctttcattgaaattcaggaacaattggaaactttgcaagtcttggtcagtggtaactttggcttcatagtttaaatgctattgggtgatgacacatgatggaaagaacatggctcgtgtctgggttgcaaattcattaagttcgttgaaagaacatgcagatcccaaagcaatccaatacagctattcacacataaaagggggcctcagcagacatggtgctgggattgttgcagcacagaactaggctggctctaaagaaacccttacattccatgtggagaaggagaattaatgatgttcctcacctggaatggtcttgaaaagcaacatggattctcagttaagatctcatggttagtttcctaggaaagagggaagatgctggaccatttccagtaggctgatgcatgctattcacatctttgtcatctttccaagtgagaaatctattccaggctaccagacataggttctaacaatcttctaggcatgtagcatgtagtatagtcaaagacattataattaacctcaggggaaaacaataacattatttcatttttaaaaggcttagttatgagcagataacacatgtttatagtttgttatgacctgaattcttaaatttcccctcactggccaaaaatgaatctgagaatgttaattgtttaatgggaggtacttcaaagggttgagtctgggggctcatcagaagaggtaatcccaagtgacttggaatctgcaacaggtgggttaggacctcatccttagatattgctttaaccaatttatgggtaagccatagttctgagcagagtcacgtgctcacgcgccccacgtgtagtgacaacgggaatgtaggcttaaacataggtaacagcttcaaaagagtttgtaaaaacaaggctgtgaatatcaatataattgtgagacttttggggatttattgtaggtttgaacgtaacttgaaatacagtgatttgtagacagtcagtaattgcttcacttgctccatttggaattttgtaactattcacttctccagcagcataaggtggttaagaagacagtttctgttcgttgtaaaaaattactccaggcttaaggaggacaactattgtgtctttatattcatatacccaggatttagcacagtgcctaatccataagggccacactaaaatgtttgcccagtgaataaatcctggataatatcatcctgtctgcaaagccagtattacagagtgattggttgccagtaggggagatagctccctttggttacacaaattgtggcagacattgaaccactccaaaagaaactaaagctatttatttggggattgaaacaaaaaagcctacacaacttgaaaaaagcataaagacactcagatggaaccatagtgtctcccagcagatatcaccagatgggggtgggggtaaataattgcagtcacatatgcagcaggtatatatatttttactaatggcttattcttaaacaggacttgaggccagagaaatttcaaggataaattgctttgggagaatgcctgatatcaatgtctcctgagacatagaagttttccaaaataacaaatcaccagatatattattttgttgcctcctcttccttcccctggcccctgccaatatgcttatttacaagagttaccttatcagttgtcttaggagaacacatttccttcaacagaagtcacagtatcatcttatggtcataattttacaatatccctgcctctactgagaagagatacatagcgaatggagatgtgctgagccaatgaggaattaatcctaggcagcactagtagatgtggccacagctctggccccaccccactctggtggtcaggccaaaaaagaagtcaggtaagaagtgtgaaaggaaattcaatcttgggacccccaaactcattaagccacagggaaaattcaagctgggaactgggtcacgcaaacatgcctcccccttttggttcctaaataagatggctacaagatgaaaagctacatgcctcccccatattttgcccacaagggaattcccagtgagctgctagatctttacactaaaggtgtttctattaaaatttcaccatggcaatataaattgatagtttatagatgcagtcacccctggcccaccagacacaaatgcatatctgattgttcccctggcccagttttgtctgttatcttatataaaatgcagattccctgcaattttcctctgcctcatttgtctgtgtcatcttatgttaaaaaaaaatgcagattcactgagccagacaaaggcatgaatgactgtttttccctacccacctcttacatgaaaattgtgtacttctcaatatcctgccctttcccctttaaatttggagccttcaaaatcatctttggagaaaggcatagacctgtctcctaggtgtgcatccttaactttggcaaataaacctcctaaaataattgagacttgtcatttttctcgattgacagaagaaaagacagagccaagaggatggcagtgtacttggctacccccagagcctagctgaggctccagccctgggcacttcactggagcattcccttgccagcagaggaacctgcagcctaacctcatgctggggtaaccttaatgtgggcaatccgtcttactgtaatagacaaattgcctgctttcacttaatccacagatttacaagggacaaactttggccctaggaatatttattgaatatcatttcatccctgtgacttccacttctttctgattcccatatcaccagcccaagagaacttgagtatctgttcacagctttgctcctctttccccacattaaccacaaagcaacggaaatagaataaagagacaaatgggtaactctaagtaggttcatcacattcattacatgccctgtatccagagccaatataaatggtcttgattctgattgtgttgaggtataaaaacatgctgatttctgtggcaggtattaatgattattacttgtgtattcatttgctcactgctccattctggatgttcttggtctcagggcctaaggatcattttctcggatgcatcacggctcatcttccggctcagttcctccagtggtgtgcgggccaccctcagactgtacgcagagagctacgagagggatcccagcggccatgaccaggagccacaggtacagaaacagctgtgctcccagcagtgtgtctcgcagctcctggcaaatttagagagctccatgggcctttagtggggctattttacctcctggaaaggtacatgataatttcagctggaggacaagctcagggcaactccaagcaagtttaattcgttcattacagtgtttgaaacagaaaaattgctctctcgcatctatttgtaatccgtttagaccagcatttcccaaacaactgtcctctcttgactgttgagtggtttgttaattggggtaaagaaaaagcaccttttatagacaaggaaatttagcgttagagtcaaactggtgaaactctcagagccttgactacgcttatgtaacttttgaatctccagacatttggaccatgaccttgaggtgccaatacagatgggctttgtctctgagattgctacattgtccactctgagaggagaggatataggtggccttttaagttaaggaagcacattgacaaggctaagccagactgtttggcaaagtctcctcatgttttcaacaataaggctaattaagaactcagaaaaatcataaataacacaaccataagcctctccactcccacattcattaaagctccagccaacattaattaataccagaaatgactcactttaatgttgggtacttcaagctatacagctggctgctcctgtcttcttggtgtcttcaatctgggttttgaagcaaggtccttgataagatgattttttcagatgaaaacattggttctacctgccatacttcctttgtggaaaagtagagaaacagagaaatactcactgctactcattttagaggtgctcagaatttctagctataatttgccctgatggagtaagatacctggcaggcttttctttctttgtcagtagtttaggggtttttttgttttgttttgttttgttttgtttttttcatggtctgtttctttggagagtctcaaagaacttggcaataatgggtgctacagatccttacacctgaccctacagccagaagatctgtctggagtaaaatcatcctagatgggacaggagaggctggaggaggctgagagctattctcagggttaccaagagcatgagtgggcaaagcaggtggccagcatgaagcccttggctcttcctctcaggatcatagcctttccatgcaggggatgggacacactctgccaaaataattggttagtgcgtacatttctcccaagatagtaccaaatcatgcaagaatttggggcttaccctgtctttccaaataaaacactattctacatctcatgttggggagggagattaaagcaggggcctaaaagtccagagctacgtacgtgaggaatgatattcctggcctcaccaactctgactcactctgactccgggctattttttcctcaacattcttttccctatttgcacagggcaagtggctgtgatatttgcttatttttatttaccctccgcactggactgagaccaggccattagacaagtgtcacaacaatcctatacacacaagagtctctccctgaggcagtccacaaaagcagtgctttttttttttcttttcccaaggcttcctttgaagctgaaagtctccatcagcctactcttagaaggtcatgtgagtaaaggaaacataagtcatgctggttttggtccccatgactgcacatttctcatcctgttggtggaaagaatttgccactttgaagggttggcgaatcccttcactgacgttgctgttggaatttctgatttcccctcccttctcctcagaagcaagagttttcctagacctggctcgatgggcccccgagtatgtagcacatgatctagctaaaagttttacattaaaatagaactccttgttaaaataccatacatcattgactcaccaacttaagccctattgcataatacatttgagtcaggatataacatagagtaagattttaaaagaaatctaaccacctaggggaaagcaagaagattctctcagcaggccaacctgtcttaattactgctgaactctacctaagcctttaagtgggagcattttgagggctccttacagggttgctttccaggaccacctgcttctgccttctaaaaagcctttgattaactgttgaacagagataaaagtaagatgtactcctgaagctgctagtgttattcctgatcagggcctgactggaaagacctgcttgtgttgctttctcagctaccaaaagaaccccttccaccttctctaatctgcagagattccattgctgatcttgttccaattcaacaggtagtttttgatgttttacccactctaacccaatagccatctacacttaaattattttgcaagagaacagagagttcccttcaactggcttattaatatctggctattttactttggccatggatagtttcttttccagacattttgaacacatgtgaacagagcatgttttaagcatttacactgattgccttgcagacatactcataacaatcctagtgatgcaattaggaaaacttgtgatataatctatatgcatttagaccatactcacatgtagattttccatttgcatccttttgtagaacagtgattatgctatttaagttaatatcaatttcttatctacatcaaaaatattttttaaaaattatatccatatgtgcctacgaattggtggtaaggagaggatgggccggggagggccctgatgagatgggcaggttcttgccctgatcccactctgtgtccttggtaaatcaggaaggaaagcttccaaaggcttgttgctggaagactacctagttttttaaaatacaagtttattttaattttaccagcaatcagtaggccttcaatgagccctcaaaccagctggtaatcatttggaaaaaggaatgagccaaaagggtttaaaatcacaggtaaccagaaacagtacaattgtttccgttttctttcccatccaatttattagcagggctgctattattagcttctcgttgaccttcttcccttgtccctttcagcctgtgggtggagtagttaaggaacaatagaagatccaaaaggaaaaggaaggagaagttttgttaagggctaggaaaatcacagactgataatcagcccgtggctaatcaacccttggctttagtactttcaaggcagaatacagtcacacccgatctcaccccagtccttgggaggggcctgattttcccccagtcttcctgaaaattgaggaatttaagtatttgtttgtttgtttgtttgtttgttttttgagaggaagtctcactctgtggcccaggttgaagtgcagtggcatgatctcagctcactgtaacctccacctcttggattcaagggattctcctgcctcagccccccgagtagcggggattacaggtgaccgccaccatccctggctgattttgtatttttagtaaggacagggttttaccatgttggccaggctggtctcaaactcctgacctcaagtgatccacccgcctcggcctcccaaagtgctgagattacaggtgtgaaccaccacatccggctttaagtatgtatttttgataaactgtacctagaaggctttaacaactaatacctaagaaccaggtccctcatatttattcacctgtcaaaccaaaggtcatctgtcattttgttctacctgttcttaataagactttgtaatccagaaataaagtatagagccattttgttttacataggaagaacatatgatttgtcatctaaaccagaatacagatgctcctagatttacaacagggttacaccccaataaacccatcataagttgaaaatgcattgaatacacctagactgcagaacatcacagcttagcttagcctaccttgaacaaactcagaacacttacattaacctatggttggggaagatcatctaacacaaccccattttataataaagtgttgaatatctcatgaaatgaatactgtactgaaagtgaaaaaatcggtgtatggggactcacagtatggtttctactgaatgtgtatctctttcacaccatcataaggttgaaaaatcattaagtcgatccagccaaagttggggatctgtacttttgtgagcgaaagataataattgtaattatgtttagattgtccccaataaaccaggagacatgattactctagctaccagcctgcatcctctcttagaaccgcatctctttggagatggctttctaagaaaactagcaatgaaacctggaaggaaagagggaacatacagaaatgagaagagtcagctcagaggttctcaacccaggcaggctgcacatcagaaccactcaggcagcttggtgaaagtacccatgctttggccccagtcctagagattctactttaattgttttgaggtgggacctgtagtttttaaaaaatttcccagatgatattaattagacaagtgcatctcaaactaattaccggccaatcaccttgggaatgtgttaaaatgtggattctgactcaggtatgaggagggccagagattttgcatttctaacaagctcccaggcaatactgtgctgctggtccaggagccacccattgaatagcaaagagctaggtgaactgtgaagtgctagcagcaggaccttgaattctttaaaactgtagaatgagcagcacctgtttttaataccattccacacatcgatctctgtcttctagacttctatttctgttgcttattggattccacctgaatgtcttatagacatcaccaacttgacatgtgcaacactgatttcccgccagcctcctgtgcactcctccaaaacaaactccagcatgctgtttctttcattcttctccatctcagtaaatggcagttcctaaaacatgttagaccacctcatagctctgatagaatcctcccctccacctcatttagagaagagcccaaacccttaccatgatcttgaatgacatactggaaatggcccccttctccctctgacctcatttcctatctcttttcctgcttctttctccactccaaccgctgtttggtgaacatgacgagaatgctctgcctcgtgttagttacgatggctgttccctctgcctgaaatgcttttccttctgacatctgcatagcttgtctccttacttctcagtaagggtgtccctggccacctaatataaaatagccctcacatgcaggtacttcttacttccctaccctgctttgctttctccatggcatttatcctcatcatatatatatatatttattttattttattatctgtctccacccagtagaatggaagcaccaggaggctgggactttgtcagattatttccctgtatccccagtgcacctggtacatggtaaatgcccaacgcagttttgccaaattattgcaatattgaccattaattactttggaatctctcagcccaattatatcacacaggaagctgaaatattctgtactcaggatgaatgttggtgctatcatcaggtttcctcctatgactgaggtcttgaataaaataaatgccatttttaaggtccctacaacatgcaggctccattctaaatacatcctttatcttattcatcgttccagtggcctcatggcagaattatcctgctttgcttttgcaggaaaggagactgagtcaggaagcaattcagattcatggagtaggtaatttctggattggaggtttaaactaagtctttcttataacaaaatccacattgtccatgttaacgttgaaggcccagaagagaatttctttttatttgtgcttgagtccaaggctacctctggagcctcagtacagtgttattgagaggttttttcctcagatcaatcaattctgtgattccctgacaccaactgggtgcaacaattctattcaagtcagttctgacattatctggatttagcccagaccccacaagttaagggctcagtctcacaagattgctcctactaggaatgccagctgcaaatggggtgcacaggctacccacatttttgccttgccaactacaaatttagggttttctacaatcccccttcagatttaataattcactagaatgactcactgacctcagaaaagtgcttcgcttagcattactggtttattataaaggctagaacccagaaccagccaaatggaagaaatgcttagggccaggtgtggagaaggagtgtggagcttccatgccctctctgggtaagacagcctccagcaccttgatgtgttcaccagcctggaagctcttcaaaccctgttgctgaagtgttcttatggagttttcactaggtaattatggttgattaaatcattggcccttggcggttggatttggtctccagccctgctcccctccctataggtcacggggtggggctgaacattcaaaccctctaaccacctgtttggttcctctggcagccagccctccacctgaaactatgttggggcccaccaagagtcacccactagcataaagtctgctgtggctgaaataataacaaagactcctatcattcaggaagttccaaaggttttaggagctctgtgccagaaattgaggacaaacaccacatgtatttgttattccacactgttaaaagaagtttagcctaaagctgcctccttacataatttaagtttggcctaaaggtttttccatacatagtgaactatgacctaactggatgtgtaaacagactgtaacctactcttgtgacaagtagctgagtctcagccaatcacagtggctgagtttcagccaattacaggcagccactttttcaaaatatgttcaaataaggcaaaaactgagctgtaaccaatccagctatctctggacctcacttctgctttctgtacttcacttttctttttctgttcataaatgttatctgacgtcgtggcagctccaagttgctctgaacctatctggttctgaaggctgcctgattcaagaatcgtcctttgctcagttaaactcttaagtttaatttgtttaaggtttttcctttaacaacagttgtaaaagtgaatagcgtcttaaaaacaaccagttttctgtactaattttgaattagcaatgaataggattcagaaacattatgaaaataataatgttctaaatacatattggatatcttttctagttcataagggatctagagtgagtagtcaaaaacttggagaataaagtagaaatggatataatacatatgatgtgaaagagaaacagaatggagttcagaagtgatgcaaatccacattcacttagccattcactttcatgacaagacaaagatttttgtatatgtatatgtgtgtacatgcatgtgtgtatgagagcaagatttggggatcatactaggtatatatgatttaaagagctaaaagttgtgcctcggtcctggttttgggtcaagtttggattacagtttatagccccccaaaccctgaaaaaaattatatttcctctccttactttcccatatgtagttaaaaatgaaaacaaattcaattttaaaaataaataaaagatgttgttatttaaaaagaaaacctgagcaaggatatattaatagccatatatatgagggaaaacatgaggaaatacctcattttatttttctcctcagaatttggtcggtattgctgcactttggaactatgggggagggcaaagtgttgaagagagagttgagaagagaaacacttggtgaagagttgggctctaaactctatgaccaagttaaggagctggctcattccacttagacgagaggcgtgacttggaggtcttcaggaatttaaggaataatgtgaggcgggaaagatgaccagctgttctccataactaatgaatatgtaatttgaggaaataaactcaagctgaactggaagggattcacgttgactgttagaacaatttctcaactgtcaagactcctgcccaattaggatggctagtttgtgcttttctaagtctctttgcctacatatattcaaataattttaaaacaggggcaagagtagaaagtattgagcaggataatgtctcaaagtatgtgtcagccttaaaattttagttctgtaattataattttttttttttttttaagaaacaagaaacaagttctggtcaggtgggttagatttccctctagtggtgttgaaaggaatttagtatggctgtgttttcataactggctcttggggcggaattaaacttggaaagatgcaaagatgtataggtttttttctatttctgcttagatgagtactttctggaaaggcagacaaaacgccagggcaaacagtccttctttttcttccttagatattgaaatctggactcatactctgccgttactacatattgttttccctggagctgagaacactccttgggagggttggtcatctgatggcatgtgaaaaactcccttggttgggaatctgggagattccctcagggcctagtgtctatcatagaccagggctttttacagttttgatgacaataagcctttttcttggccaaacattgtgatcagatctcctttcaaggtactgagtatgtgaagccctgtgtatccacactccacatggtctaggacttgtgggaaactatggactgccaccgtgaaccactcatgttaatcccacagacagagcccatctcaaatctctctttgtggcaatatatacaaaagaggcccttaattccaaatcttgcaagaataccggcattgccagcttatcccgagaaccagtggtcttaagaacagaccactgaagagccaaaaggcatgccttgatcctggctttaggtcaagcttggattacagtttagaaagcctggaccctaaaaaaaattatatttctcctttctactttcctatatgttgtttaaaataaaaaacaaaattagctttaaaaataaatataaggaaacctaaaaatgttttgatttttttccttataatgctattctaatttctaaaatattaaatatcaacttcttaccaaaatatcttttgttttggtgccagttttaccatgtctaaagcacatgcttaaccagctattggttaacccagtgatgtttatatccacaaatcaccaagtcttgctggatcttgtttactcagcctgaaaaaggagcatgaatgaatttgcagcggtcacacaagtccagaggtcactggtcatcacttctcttgccagatggatgggtttgacaagctgtgtccagcacaatctgcctttcccagcagcctttttgttctagcccagatgcacagcacaaccacatttccgtgcctttcaggagaaagctacccaggtctcatgaactggtggtgattcaggttttctttgaagtggtgtccttccttggtgtacagtaaataatttgctttgcttatataataaacaagagtgtatcttaacaaatggggactgacagtgaacctggaggttgcctgtggccttcagaaggaagctctggactagtgtgtgcaattagccagcatctggaagcagcttttcctgggcttcccaacacggtcatgcttcattcacatggggaatacaggatctgagctgttaaggggagaatgtggctgtttttgctctcccgtctactcttggctgaatttaagtttgatgccctaatcccagaacgagaactcctgttcaagatgcaggtgagggagtttcccatcccttgtttttgactcccaggaacgctggcaggcctgacaaactccagggaggagcatctcaaagccagaatgcttaggccttgggcaggagggaaagctgttaaaggtttatacaattctggtatcgtgtttgtgtttttggttttacttttgagcatttttgttggtacaaatcatcacttgggacatactttggcaggttgggcctgtgtactataccatcatgatatgagatggaaggtagatgaggctgacagagtggcttgaaatgtagacttcattattattcaggtatggggaggccaacagatgatgagatgacggccattgaagagatagtttgttactcacagttcccaagaggaggggacccaacacgccacacagggccacgcagggaagcgccagcgtcggacaggaggcagcatgagcaaagggaaaatgtgggtgaagcctttttggagattctctgggaaaggtaaggtaaagcatgatgagaaggtttaggattagcttgtttgaataatttcagcaggctctggggcacagggactgtccctaatttgctggtacctagccttggggtggttagggcagagaaatagtggcccaagtgtgagagccctgtgagggtctgagaaaggaagtgtttggtttgcatctgaaaggcaagctccagggtgtgttgtttgctgtctctaagaattagctaaccctgggaagaacaaaaccttccagagtcagccaggccccaagatgtcaaagcattagaataaaaacaccagcttaacagccagaggaaaagataaaaccactgtcactttctcaggtgggtaaaattgttagggagcaccccaacaagattttgtttttttcacataccatcaaagctggatggcctctgatacaaaggttgggctttgaaatcagcatttttttttttttttttttttttgagacagagcctcgctctgtcactcaggctggagtgcagtggcgcaatctcagctcactgcaagctccgcctcctgggttcacgcccttctcctgcctcagcctcccaagtagctgggactacacgcacccgccaccacgcccggctaaatttttgtatttttagtagagatgggctttcaccatgttagtcaggatggtctcgatctcctgacctcgtgatccgcccacctcagcctcccaaagtgctgggattacaggcttgagccaccgtgcctggccgaaatcagttatttttgttttgagtcctagttctgccattttccagttttgtgatcttgggcaacttaatatcagtcaaattgagatagatatacttcttattttatattgttgtaatgattaaatcagataattcatatatgtaaagagttttgtacaatgcctgtgtaaatcaaagaaaatgaccaagatgagtctcaatcgttttagaggtttactttgccaggttaaaggtcatggcctgtgacacagcctcaggaggtcctgagaacatgtgcccaaggtggttgggttacacttggttttatacattttaggaagataaaagttacaggcaaagacacaagcaacacatgtaaagtatatattggcctggcccagaaaaacaggacatgtcaaagaaggggaggcttccaggtcataggtggattcaaagattttctgattggcaattggttgaaaaatctaagctttgtctgaagaggtaaagtcagtataaacaaatgcttgagttaagataaagaaagttgtggaagctgaggttcttgttatgtggatgaagcctctaagtagcaggcttcagagagaatagaaggtaaatgtctcttattagacctcaaaaggtgtcagactctccagagaagatctagcaagggaaggggattctctacagaaggccgatttcccccacaaaagatggctttgtagagccattccaaattacgtcaaagaaatatattttggggtaagatgctttgatttccttcagtgcctgttatctgtcatctgatgctatatcagggtcaggttggaatttggtatcttactgctacaaagagtctgttctgtcagtcctagaatctctaaatgtcaacagctaagctccagagaggaggatatattgaggcatatgctacgcccttttcctgttatggcctgaactagttttcgggatccttttggccaatgattaggggcagggaggagatgtccattcagtcagtttggggcttagaattatatttttggtttatacctgacatgtgaataaatgttcaataaatgttgattgtcactaatgttattgtttttgcctttttttttttttttttttttttttagatggagtctcactctgtcaccaggctggagtgcagtggtgcaatctcagctcactgcaacctccacctcccaggttcaagcaattctcctgcctcagcttcctgagcagctgggactacaggcatgcgtcaccatgcctggctaatttttgtatttttagtagagaaggggtttcaccaccattatttttattaataatggtattgactcattttcttatcacatgaggataaaagattcccagattacttagcaatttgttttataatgcaattgacttgtccttttccctcccattaacatctcagagaccaaactggatctatgagaaatgtcccaagagaactgacagcttctaaaaacctaggtcttctctgagagctcccagggctctcatgacatggcattttagatgtaccatgctttgtcagaaggttcaaggatgaagtggagtttctctacttgtctctccattcatggaacaaattcactgccctcctggcttggagtaagaggtagtgagtaggggttgttcaatgatttcatttcatccaaataatgtgcaatctgttggttgttccaagctcttttaccagagagaaagggcttgaacactggagtgggtgtgtgatgaaaggcaggttcattgaagaaaggatgcctgaagtttctttgactagccaggaggcatgtgctctctggcttcaagggattaaacagaaaaactggtcccttggagcaggagtcaagttttttctgaataggcccagagagtaaatagtttaggctttgctagctgtattagtttgctagggctgatataacaaagtaccacaaactgggtggcttacaaagcaagaacttgtttcttattctggaggttagaagtctgagatgagtgtgttgacagagctggttccctctgagggctgtgagggaaggatctgttgatctgttccatgcctctctttttggctcatagatggctgtcttttccctgtatctcttcattatcatcttccttcttgtgtgtctctgggtccaaatttccccttttaataaggacaccagtcatattggattagacctcaccctaatgatctcattttaacatgagtacctctgtaaaggccccgtcttaaaataatgtcacattctgaggtattggcaattaggacctcaacgtatgcacttatggaagacaaattcaacccataatattagtcgtatggtctgtgttacaacttctcaactgccactgttgcacaaaagccgccacaggtaatacataaatgaattagtgaagctatattccaataaaactataggcactgtaattgacttaagataattttaacatgtcacaaaatcttatttttttcccaaccattaaacataaaaaccatttttatggctgcaccaaaaccaggtggtggccagggtttggcctaaggcctataatttgttgatccttgccttataggtttctgaatatgacacgttatttacaatttctgattacattcagtacagcatgtatcaacatgagtttgggtaaaccatacacactataaatttcaaaattacatttgtatttgtgtatatttgtatacatagatgaattgtgaagttttagggaaaaaaatatcaaatctctctggaaatctccagcatgaggcttctgaggttgaactccatagcttttgattgcaaccaaacatgaaagggaaatgattatgtttgtattcatgaaatcaaattcctttttcaggtcttttgtttcttgtcagaagggttcttcatttttctttttaaagcaattgcttacacatgattttcagaagagcagcactatgtcagaagaaaagggaaaaacgttaagaaataaatgggatgaaaaaagaaaagtatgaatatgagccctggtgaattcttacaaagaaagggaagcaaacacgtgacattcagtagtgaccccaagccagggagtgctgtgacattgcatgtccctgtgaatggggcttccgggagctgataacaaggttctagtgcatttcagtcacattaacagtgatcctcaaacccagtctccaaggaacctcaccccatttccctaggaagtagcaattctgttgtttttattctttctttctttgcttttaattatattcttgggaattacagtcaggacagtcagtgtggtgtttaacaaaagctaagatactttgatgatatactgagatttcccagttatacattttagactgtctttgaccatgtaagtgtttctatattgttgaatcaagccgctggctctgactcatatcagcccatgtttttcagaatttgcagtcattatgaattcactttccttttaatggataagatttgataaaaagcttaaaagaaagtacttttacactgtttttaacagcgctttatacttttgctacactaaaggtagttcttggactagcagcatcaacatcacctggttgctacttagaaatgcagaatctcgggccccaacccagatctactgactcagattctgtattttaacaagctcctcaggtgattcatgtgcacattaaagtttgagaagtcctaatgctgggcgtggtggcattagcctataaagtgccatctactcaggaggctgaggtggggaggatcccttgtgcttaggagttgaagaccagcatgggcaacttaaggaggccctatctctaaaaaaagaaaactgatgctggctgtactggcttaaacctccaatcccagcactttgggaggctgagacgggtgaatcacctgaggtcaggagttcgagaccagcctggccaacatggtgaaaccccttctctactaaaaatataaaaattggctgggcatggtggcaggtgcctgtaatcccagctactcaggaggctgaggcaggagaatcgcttgaacctgggaggcggtggaggttgtggtgaaccaagattgcaccactgcactccagcttgtgtgacagagtgagactccatctcaaaaaaacaagcaaacaaacaacaacaacaacaaaactggagggaaaaaagggcaagaagtcctgtgatggatgacctttgggatccttatttccacctctgcttagcaggactgacattgtctccacaccagacaaaccctctaatgccaaactaaataggatgcatttataggggtgcctggcctctatttcttcctcatttaggaaaatcataaagcatgcagaaaataacccagacaaatgtgccaagatccttgaagacttgttcctgcttctcaggtcaattaacaaaaaaagaaacaagaaaatcagtttcaagttgcatctccatagaaaccctttctcaatatcaactcagcagtgttagacagttttcttcacacaattatactagttgagctgagagattcaaaataacagtggatgaggtaaagaaagttctaatttgattttgccaaggcacaaagccttgctaaaattgtgggtagacagtctagcacacttcaattactaggaaaaggtcaattatttaaaacactttaaatatgttaggttaaatggcagctgagtctaaaggcaaaggccataaaagaacatgttcctttgtccaaactgcattcataaagtgtgcattaaccatccattaatttcactaatagtctttctattgtggggaagagtctctcctcgtttacagggctcatttccatgtttttagtgcctggtgttaatgactgtcccactactgcctcctccgtaagactcaggtggccctcacggcagaagttctcttctagtttgcttctgctactcaactctgccactcagctttgctcaatgtggaagtccttgctaacttctttagaatctgatacacccttaaggaatgtgttccaaaagctatgatgtctgttccttctgttgtcaacatcaccttacgcaactgcaatctgattgtactctctctggctggatatatagggcctgttgcacacaaacagaaatgcaggcaagctttcccccactgggtgtgtcactgaccctcttgctgacacagagagatgttgcctctgatttgagtggctttctcactccaagagctgggaacaccccaacattcttaatctctttttattttatcttttatcaaaaagataacatgaactttattttatgggcaaataaacttaagctagaagggttgttgactatctaccaaaggtcagcttattgggactggtatgctggtccactcacctgtagcctacttttctattaatagcaagtcaggcttctgtcttcaatgatgatgataatggtaataataataataacaatagtatcaagtgcttgccccgtatgggggctaggcagaatgctatgtgttttgtgtgtgttatatctcattctcaccacaatccaatgctataggtagtcatgctatccatccatgttttacaaataagaaaactttggccctgagaatttgaacaatctactgtttctaaacagtgtccctggtatttgaacctagatttgggcctcagagcccaagaccttaactaaggtccttattatgtgccatcaaaaaatatgggggtgctcacccacctataaaaagtaaattggagtagaccagcattcccatcttcaatctggcatagttaacacacctcaatccatcctctaggaatgttctagaggcagtcctcaagccccacaattccagactagtagaaggtgtggtctctctttcagtcctcctattcccttttatgtcctcagatcctttcccaagggctagccctttcttagaaggctgtaccctctggaagctggagaatgccactgtgctgcttgtaactggttacctcaagtaggctgtggggtggcagttaggcgaagtacagagagactgtgaactcttctcccggagaagcagcatcaccacctggggtgaacctcaccatgggtgggcctgagaggaggtagtggggtgggcctccaccatctggccactgaggtccctgcctgggccttggcagtccctcaacatgggagggggaagagcacacactctcaggactccactcagccaggagttctccttgccaaagtgggcctggggtctcagcctctttgctttgtgacgtccaccacacagctgctttgccagctctagtgtgctcctaggagggctgggttgagtggagacagttcctggatttcatgtttatatagttctgtttttttgttttgttttgttttttgttttttgttttgagacagagtttcgctcttgttgcccaggctggagtgcaatggcgcggtctcggctcactgcaacctccgcctcctgggttcaaacaattctcctgcctcagcttcctgagaagccgggactacaggcatgcaccaccacgcccggctaattttttgtctttttttttttttttaaatagagacggggtttctccatattggtcagactggcctcaaattcccgacttcaggtgatctgcccgcctcggcctaccaaaatgctgggattacaggcctgagccactgcgcctagcctagttctgtgttgtagtcatgagcagttgagtccatgctgagagtttgcatctcagggcataggcataataggggacggggaggactgcagtacctttactccccaaatggttgctgggctcttacgcaaatctgccagccctccgcagtagtcttcaaggccctcataatacaaaaatctctatttcagaaaaagagaaaatttaaattagaatgccccagattcctggatatgtaactatccaggtaaaatttatacttattaatattaaaattatttcactgcctctagtgtactattgcttgttcagtggtagcaaattcagtcacccaccaacacaggcagtaagtcctagattggggccaatttaagacaatagagcatggtgggcactctggtgatgctcagctgtctttaattattgcattgttaatatgtgagctcaaggttgccaggttttctgattttaaaaggagcaagatatctggactttcaaatgaaatttgatttttaaatattggcaggaaaatgattacaaaacaacacaaatcccatatgaaggacttctaacttttagtagtggtggactaggtgattcaaactaaccttccctctgtaaagagctgaaagaaatatattaaagcatcttattaaaagcatggttgaccaatgacctaataaaacagtaacaagaacaggaaaagggttggcactcaggaaaatgagccaaagctctttctgtcctagggaatttgtccatctaggagaggtactaaagaagaggtgcttttgatgactggcacagggtaaaggtgaccggcatcaggtccaggtggaggaggatctggtctattacagtctgcctctgctaaccaggagactaaccaaagaggcagcaaagaggcagacctgtgtggcattttcgtgtggccaaaagaaatatggttagttaagtacacatcaaaggcagagatcctggcttaacaatccctgctctagggtgtaaacttgaagaagaccattccaaaggtggtatacagactgtactccagaggattataaatccatggctctgatcttctggctccctgaggagtctcatgaaaggaaatgaaggaaactaacaatattctaggtctccagttatttctataagcaatttttcaaacaaaatgggcaccaaacaataaaagattataaagcacttggatacacaaagcaacacataccagaatcaacagaaacaacataccacagaaaaagatctatagatactggaatttattcaatacacactgtaaaatagttattttcactatgttcatggaaataaagcactgaatgtaaaaacatcagcaaataactgaaaactataaaaatacaccaagatgttgaaattaaagagctgagaaagataaccaaaattaagaacataaatggatttaacagcagctgaagaatatcagtgaacttaaaatatttcagaagaaactatgcatctgatttttcagtttagtccttatgatttgcagaacaaagaatataagattgctgcctttggaagatgaaagatcatattcggaaaaatacagaatagagggtaagagacacaaaggatacagtgagaagtgctaacataatttagttggagtctcaaaagaggagacagaaacttgggtataggcaacactggaaaaaatgataggtgaagatttcccagaaccaatgaaggaggtcagcccactgattctagaaagccaagcaggatatataaaaataaattcacatctagacacatcaggctaaaattgcagaaaatcaaaggcaaagaatagtttgattgacaactaatttttctttatcaacactaaaaataaggagactgatggcttagaactcttaatctagtgaaactttccttctaaaatgaaagcgaaataaacacatcttcagataaacaaaagctgagagagtatctacacaaaaagaaattctcaaggatattcttcaggaagaaggaaaattatcccagatagatatttggaataaaatgcagcaaggaataaaagaaatgttaaaaataggagttggtataaatgaacattggctgtataaaatattaataattgctgaaatatgtatattaattaatatggagaattaaattatacaaccacagtaactaaacaccatgagcataattgtagttaaggtaagatccttgaatatattggaagaaaataaaggtatagataaatactagactttgataggtcaaggattcatgttgtagtttctaggtaacgattaaaaaaaatagaaggaaattacataacttcttaagagaggaaaacataggaactttaaaaaattgagaaagaaaaacagctaggtcaatttcatccatgtatacatatgtaactaacctgcacaatgtgcacatgtaccctaaaacttaaagtataataaaaaaaaattaaaaaaaaaaagaaaaacagctaggtcaagtaaaaagcacataaggtggtggatttaaacttgaatttactggttattactttaaatataagtgaactaactgctgtaggaaaaagacaatgtaatggtgattcatacctgtaatcccagcactttcagaggccaaggtggtaggattgcttaagcctgggagtttgagaccagcctgggcaacataaggagaccttgtctttacaataaataaataaataaataaataaataaataaataaataaaattagccaggtgtgatggtgtgcacttgtagtcctagctaattgggaggctgaggtgagaggattgctcaagcctgggaaattgatgatgcagtcagccatgatcataccactgcgctccagcttgagtgacagagtgagaccctgtctcaaaaaaaaaaaaaagacaactataagctcgttataaaaaatacatcttttatacataaaaatacagaaaatttgaaagttaaaagacggaaaaagatatacaaatgataacctaaaactagctctattatttcagataaaatagactttaaggtcaaaagcattgctaaagataaagagagactcttcaaactgataaaagagttaaatcccccaggaagacacagtagttttaaatttataaagaaaaaaaaaagagggagagagagatgaaaatgtaagaagaaaataaatccacagttgcccttgagtattttagcacccctctcagtaattattagaataagtatacaattagtaaagaacatagaatatttaaacaacttagttaacacacctgacttaataggcacatatagatattacaccacgcaacatcaactcaacgtgtaaattcttttcatgccacaggggacacgtataaaaattacctatatgctgaggaatgaaagaatacagagtattataagggcaactgaattcgaaaatgaaaacaaaattgacacaaaaaaagcttttgataaaatgtatcatctcttcatgataaaaattctgtgaataggaatcaaagggaagtcctttaatatcataaaacggtattgctaaagaaaaaacctggacgtaggctatatgtgctgacagtatgctaacaagggagaacgacttgatgggttcatttagaactcaaataggctttgtcttcagaaggacaagcatcagttttacatataattagagtatgttaaattgtttgcatttccctgtgattgttatatttaataatccttaaaaaggtaattttcaaatagtgtgcctagaaacagggaaacttttggcattaagacaaatatatttataaactttcagaaaatgaaaacttttccctcagtataagggcagtctagatagtgagatacagcctagctttgaggttaaaaatcacagtactgagtaggttcagagctcagctttgccacttgattgccatgtgactgcacaagttatgtaatgagtccaagcctcagtttcctcatctgtaaaatgagaataataccacctacctcatagactgtttagagattaattcaatacatgaatttggaatagcacttggcacattttgggtactcagtgccagctattacaaaattactaaagaatcaaaacttagaatccaaggcacaaagtatataaaatggcagtgaggactgagaacactgatcgtggcttccgaagtcttttggagaagaaagggaggaaaaggaggaaaatggagaatggagagagtcctttgagtaacaaactggagaggcaaaggtccttttgtttttttaacctcggtttcaatcttgaagttttatttctgctaaccatttggtaaaggcagaggagatcctaatttccctttgacctagcaagtgtattccatgtgaaagaaacctggaagcctagtgtggatatacccaatgaagagaaatgtgaagacatgtgagggacatttgggagggatggggatctgaaccaattagtaattccccatccttttacaatgttttggtggcagaaggtgaggggagaggtggatagaaagaaagaagagaggaacagggaaaccatggccagggaaacagtcctaacaatttaaactgacaactcttgcaggtaggtttgtagtattcagcagcacagtgaaagggctcagagattgtgcctaaagcctctcagctgctcctacagacagcggccagtgctcttgctctctccccttctccatccacacagggcatggagccaattagagctcacatttgaataagaatatcgggcctggcacagtggctcacacctgtaatcccagcactttgggaggccaagacaggtggatcacctgaggtctggagttcaaggccggcctggcccacatggagaaatcctgtctttactaaaaatacaaaaattaggtgggtgtggtggtgtgcacctgtaatcccagctactcaggaggctggggcagtagaattgcttgaacccaagaggcaaaagttgcagtgagccatctgagccttttatatcaggggctcacatgaacaagtctcttgtaaaaagaagctctctctgatgaaactgagaacagatagcagactcacgcaagctccggatggtggggcagtgtgttaaggaaacaatggggatgagaatgaggaagtagatggggagaaatagaatcagagggtttggcaactgcttggatgtacaggaaagggagaaggacccaccaacaagtacttccagctgagcagattgagagttcagagggacctgctcctagcaggaaagagaaggtggaaccatggactggcgtagcgaggaagttaattttggtttgcaagatgttacatttcatattttgggtttgttggtggtagaatactggaccatgatggtacctccaaacaatctaagagaaacacattttgagtgtttatcttattaattgtgattttattttaatttgcttaaaatttttgattttaatacgcaaagagaccaaagttagctcaagaaagtcaagagtagggtctgtcacatgtccaaatctcagagactagacctggagtatggttaccacctcaggccttcctattgggaggtaatggatctttagagataattgggagtcatgccattgttttctctctaccaactcctttattatttccttctgctctctttaattcttctcctggtttcaccctgctttcttataattttttgtcacctttctcagagtctctgctttctcataatccaggattaccatggagtcttatgccctcatggttaattaattataacctcgtgatttagttcccactactaactgtccgttctttcattacttacagttcaaatccccgaggcaaataatctgctaggctaggtgaagtttttgccccaggctctattgtaggttgctagccagcctctctattggctgcctgtaggtcagacagccacttctggtccaatcagctgcagccagggagtgggatcatgtgatgcaaacaatgcagcctgggtttgggctggagcaaagcatttgacaggcacaataattagagtaccttagagcagtggtcctcagagtgtggctcctggaccaacagcatcctgggaagctgttggaaatgtcagttcttgggccccaacccagaccccttgaatcagacactcaggatgaggggtgctgcagtctccactttaacagacccaccaggggatactggtgcatgttcaagttcaagaaccactcccttagactatgcaaaagcatattgactaaaaatgaatgtttgcatgaaatctggagagaaagcctggcattcaggtttagcaggttttaaacaaagtgggagtgttgttagttgatcctagggatcaggagaaagtagcatttgttataaatctctattttatggatgccagaatgtcagtgttttctgttgttggatgacctacctgcatttctggtttgtattgcctgccccgaaagatgaactatggtaattatcgtcatccacacctattcactctccacccatggctccaatccttccccgactgtacaaatgcacattcctcatagagaccagcccagcactaggttccctccacagattctgacaaatcttgcttgataagtgattatgattctggttagggtattgttttcctccgaaaaatcagttaactatttactttgagtcttgtgacattcagatcatttacatccttcctgtctattgcttgtcccagagtaagaagttcagtttgttagggttgttttttttttaatggatctaatttacatgaaagtggattataacaatgacataaagcaaaagagaagatgggagagaaagtaaaaagagaaactctgtctttccagggagtatggacaagttaaaacctaatctaggatttatgtgggctaggattaatgtgaggttaactgggtgcaaaatttaagtgggtgtggatgccaaaatactcagtaatcaagataaatatcgtagtgcaatttttaaaaaatcaaaatcaatgtccaaaaaattcatgataaacatagtgtcaaaactttaaatagagagaggatccaataccccctgtagcctgtctacattaatggacagcaaacatccagaaaaccctgcaaggtggcagaagatgccatcttgaaaggatgcaaggcctgcttggtttggagcaagataagcgttcactgcttcctactgttgactgtagaagaaatatgttaggcactctaaaaaacactggaattagaaaaaacaatgctatactctaacataattgattaaagtctccattaatttatttcctttattcacaaagggttattttggagtttccaggacattcacataacccacataactgagaacacctcttctcccactgtctgcctggttttggtcagggaggaagactggtcagtcctacccaactcctcatctgatgtgggactcatctggtccaatagggttgcaatcccatgatttccctgctcctccccattcagtgcattttgtctttctctctttatccttgtcactctcagatcttatatgcagaactgtatgatggaaaatgcagtagaggagcccactgtatgttcttatcccagctcagccaccaaacagatgtgtgaccgtgggtcaatcctgtgtcgcactgggctttagtgtcttcatctgtgccatgaagaaatcaaatgacaccaatccacattcctctctgcttttgaaattctgtgcttccagctccatgttagaaaactcacatccacagttcataacccctctttttgctcctcattccaactgcctctccaattgccccaggaaaattaactcccacccaccatgaggcatggtcgatgacatgagagaagagtttggggtttacgtgtatcagaggagtgatttctaaagaaaaacatgagtaaaaacccggcactgttgaccctcccacatgcacacaatgtcctccaggaatgcccacaggagtctctatttgccttatcatcttttcatcaaatatatcattcatttactccacaaagatgtattgagtatctcctaagcagtagatactttccttagccctgaataagacaaagtttctgccctcatcatgtggccactcattctagcacatatatactgtcatgcacggcgtagtgatatctctgtcaacaacagaccacatattccatggtggccccataggattggaatggagcatgtatagaaacctgctacatggcacttgatattgatgttgcgaatcaactaggggaaatgattgatatttagtgatggtgctgggacatttggtttcccatatgaaaaacaatatataaataaaaagatatataccatctaggtttgtgtaagtacactctataatgtttgcacaaggatgaaattgcctaacgatgcatttctcagaatgtatccccatcattaagtgatacatgactgtttaatttatacactcagggaagaaaaaatatattagtttattagccttaaaaatgggagcttgccgggcgtggtggctcacgcctattatcccagcactttgggaggccgaggcgggcaaatcacgaggtcaggagatcaagaccgtcctggctaacactgtgaaacctcatctctactaaaaatacaaaaaattatccgagcatggtggcaggcacctgtagtcccagctactcaggaggctgagacaggagaatggcgtgaacccgggaggcggagcttgcagtgagccaagatcgcgccactgcactccagcctgggcgacagagtgagactccttctcaaaaaaaaaaaagaaagaaagaaaaaaaaggagcttaacttgaagtttcctttccagaaagctggcaaaaaattcaatcttgggtatttttagggacttcttcccaggccttcctggggtcatacaaaatctaaagaagttctgtggttcctggaaaatggctgaaaagactgaacatcagtgaggtggtcttcttcccaaacactcatatttcccggaaggcagatgactccatggcatctgtgccggattagcccaggctcttggctcaggatgggagtcctcatatttaggagtttcctcatgtggcattttcttcccttcagcttgcataagcaccacggaagccctcttctctgacatgaacagaagaagggacaagtgcttggttgatgaatccagaaacagagttaagtaggtccactatacacatagatatcctattacatttgtatcataaaacatataaatgtacatgcatttgccagtattttgattttggcccaagacctgttctttaatatgagcatactgtttgccattgtgatcctctttcttcaaaagattcccactcataattcatcatctataatatctgtctttgattcctttatattacagcgggaacttaaggacaattgtgaagcaacctgaaaaaataattcttctataattttaaaatttctccctaatattttgtagtatctcacccacatctaatttgacaggattagctaatcaccattatctgttctttccaaaacactcaacttaattttcatagaaaaaaagtcttcttatttgcattcacgtttcattggtttacatataattaaattgcatagtctcaataattagtacaataggcattaacatattgggaacaaacttaactgactcctgataaacacagaactcaactgctgaagggagaagtaggtgagcatattagaaagtgatcttttggtcacggacatctagtgagctacggacgtgagtcaggatgttttactgaagaagtggaaagcacgcgttagtttgtagagttaagtggagatcagaaaagagaacttctctggtgtttacagtatttgttaaaacttgcttccccgcccttttgccaataggtaccaccacttaaagatgtggagtcaaaaaatcttgaaatttacaatgatgtaaaactgaatatgttttaatcctttagttccgtaaggttcaaattcattttcattgcattttcttaaaataataggatagtatatgtttatctttattcaccctctaaaacctcagctaaagtgattgagtttaacttcactctctttttctgtctgagtttaacttctttgataggtgttaatgaagaattacataaccaaaaagggggagcaggaaagagggaagagaagacaggaagaggagcaaaaactaataattgaatttctgtacaaaatgggcactttgctcctaaagaatagagatccctctatcttggcatcacatgggatatgtcctggcaaaatgtgccagtgtaaaatgtttctgggcaccaacagggttattaagaggaaaagaatcccttctgtttttacgaatcaagatgatcaacacggaaccggaggaaagtgccactttcttgtgttctagattttcatttttcttccagcttccaggagtctatgtgagcttgtccatctagccatcttcatagagtaagataatttaatacatgtaaccataaattgctgccagatcaatatttccaaagcacagctgtgatgtcacctttcagcccaaaacacttcaatgcctccccttgcctaatgaattaaaaccttacacctcactctagcatttaggtccctcccaacaagactggctcacatctctcaggattcttctgtatctacatgccactcaggacacaatggattgcttgtgatgtcttgtaccttgtgcatttccttgtgttcctgttgtgtggattggaatgtgtgcactccctttatgcatgggaataggttagggcccacaaggaactgaattcctctccccctcccaaaatgcaagccttcttttcctgaattacagaatttttgtttcttccattatcctaatattacccaaacttcttttctatcagtatctctatattaataggtgtctttattttttattttatttttattttttctttttagagacaggcagggtctcactttgtcacccaggttggaatgcagttatgcaatcatagttcactgtaaccttgaacttctgggctcaagccatcctcccatctcagcctaccgagtagctaggactataggcacacaccactgcactcagctaattcttattttttgtagagatgcggtctatgttgttcaggctggtattaaactcctggctcaagtgatcctctgcctcagccttccaaaatattgggattacaggcatgagccaccacgcgtggccaatatttgtctttaaattgactcactttgtttttacctcaatctacttatttattataaaagtactctacatggaaaaaacaataccacttgataaatataagcacatcatgaacatgaattcaataaaaacattcagtgacattacattctagctgggtaactcctgaggcatgcactatcttggttaaattgttaaagattggcagcaaacagagtttctccttgatgaaatcagaaggattgaagaacggaaaatagactgattttctcactgttttattagcaataccatatccatgcaccactgaaaatcattgtgagtgttgcatgctccacacctcggaaaacaatgcctcaatcccatgaaacaataagaaagaaatgagtcttcctccttctcatgtccttcaacttcccaagaacctattccttaggcttctaaagcatgcccacctcctccagaaaacccactgaggtgcctcataagcccagtgttacgtaatgggaaggcatgatcagtcatttctgcaacgttggccaatgaattggtctgtcatttcagaaacatcaggattgtgggttctttaaatccatggccctaggatgaagaatgagcttttattctcgtgtgtgtgtgtgtgtgtgtgtgtgtgtgtgtgtgtgtgtgtgtgtggtgaggatgagggtgtagcagcagaagactggagtttttctgaactcccttaattcacaatgctgtcttcatacagtgctctcatgtttggtagttgggttgtacattttcctattatagataaatttcttttgaagctggttaagactttggagatcaccttctccccctactctcctgccctgcccattccaactaccattggtggaggaggaagcaaatgtcctgctcatgaagactgcctgtaaacagtgaattggaatctgagtccagatgcttatggtagaaatccatcagaatgccccaaaatgtaactgacttgagttgttcacagactttccttttccttttgcaggcagtgctgagccctctcatagccatcgcactgaaaatatcccagattcatgagagaactggccggaggggacccactgtcatcacctgaatagaggaaagatcactcaccagggccaaagagagtgctcagcgggagatgcttcactgatgccttcttgctacctgtttgtgcctcttatgactttggaaaaacaaaagatattttgcttttgggggatagagggtgggtgggaaaagaaaaaaaatccatttggttttggttttgtcctattcctccaaatgcagcagggcctttagttgtctgttaaagctgcactataatttggtatctacattttatcacacaaaggaacctccccttttgacaacaactgggctaggcagctgttaatcacaacatttgtgcatcacttgtgccaagtgagaaaatgttctaaaatcacaagagagaacagtgccagaatgaaactgaccctaagtcccaggtgcccctgggcaggcagaaggagacactcccagcatggaggagggtttatcttttcatcctaggtcaggtctacaatgggggaaggttttattatagaactcccaacagcccacctcactcctgccacccacccgatggccctgcctcccccatcccatccccaacatccctgtaccaccttctctcacatcttctaaagctttgtacaaatcacaatggtgcacttccaacaaaatatatcaataggtgttttcctctcttattttgtaaatagtattattttagctattaagctggataccttctttcaaattcagccattcagttgtaaagttgggaagaagtttcttgacaagactctgcaattaaatgcttaaaatttggaggggatccttccttgattacatcaagtatgttggtacatgggtttatacaagttcctcttgagaaggcaaaaagaccaccatgtgtgagagctctttgacttggccaataggggcctatcttaatgcacttgtttggacacatttctgatcttatttgtaaaggctgcaaaaggagaggatgaaatgctgtaaaagtaggaaatgaagtggaagctggaagaaaatgtaattggtggtacagctatgggccagatggtggaggggagggtggggacccctgccggcaagcagagtgtcacagctggctttcctcacttgggaaaagggtactgccggtctagcagcctcctctgtactcagccaggacacccagcgcgtgggacctgtttgtgtctgttttgcttccttgggaacggcacagtcactcaccctgccatttgcggaaatgacctggtgcactttgactgttaagcaatgcgttattgctgtagtcaaggttagtgcaagcaaggaaacattcccagtaaggtatttgtttccattttctgtctgtgcttctgtcagaaacttgctaggacatttagtggccaataaaaaagaaattcctaatttcaaccttatccaaggattgtgggtttttacttatttgtttgtctcaccagttgagaaactccagtactggtcacctatcctgataaatctgcctttcagaaaacctgcaagggctgtttttcactattatggcaagagacatgtattaaatggaacagaaaaggtaagttactcaaaactgcctttgggagtcagcagaaactgaaatggcatctagacctccactgtaactgtcttcatttcaaaataataggaaggtggctttgagctgagattctaaaacaaaaccatttcaagattgatcaccagtggaatcaaattcatgtcatagctttggttctcaggttcttgtctcaagagtggacatctatgctagccatccatgtgttcattaatcacggatgtcttggttgggacgctcagatgtattcttaggtgtatcagctctaggtaagaaaatatttattttctcaagttgctgaacttttaatgatctctaacttgtaagttcatatgtaaattagtccttacataaaaattatatttctttattttgatatggagtcatgcgtggacagtagcccaaatatatatttagccatcagtccatccattcatccatctatgtgttcattcattcattctgtggacattggttgagcaactcctctaggcagagttctgttttagatggggcaaagaaatggataaaacattattcctgatcttataagtttataatttgggagtaggaggctatgacaaacatacacaaataatcagttagacaaaaatgttatgagagacacaaataatgtgctgtgggactacacagagaggggcaatagactcagagacggtggcacgagagtggtttccacaagagtagagttgcttgggatttgtaagcatttacagaatttcatcaaggatgagtgaagtcagaagacagactaggagatgagggttaggatggctggagaggagacttgcttggggtctcctgaggagttggcttggatgcatggggttgaagcaggcacagggttgtgaatgtcaggcagagcaaagccttgggcccagccaccggaagaagcagctacatagctgcctattttgacagagttttttcagctatgttgtcaagggaaggtcttttggtgggtctaggacacagtcattctctggaacctgctctgattcacattgccaagatattatttctgccttacttgaaatccaaacttctcttgccgaactatatgtgtacatcctcttgcctaattctcgggagaggagagaggcaggaagtcactgttccccatatgatgttctttatgttcttaaagatgaagctctaggctgggcgtagtggcttacacctgttatcccagcaatttggaaggcccaggtgggtggatcacttgaggtcaggagtttgagaccagcctggccaacatagtgaaacattgtctctaccaaaaatacaaaaattagccagacgtggtggtgcatgcttgtaatcccagctacccaggaggctgaggcaggcaaatagcttgaacttaggaggtggaggttgccgtgagccaaaatggagcagtgtgcactccagcatgggcaacagcaagactctattaaaaaaaaaaaaaaaaaaaaaaaagagctgtagccactgtagccactgatctttgagagtaaatgacttgaccgggcgcagtggctcgtgcctgtaatcccatcactttgggaggccgaggcaggcggatcacgaggtcaggagtttgagaccagtctggccaacatagtgaaactctgtctctactaaaaatacaaaaaattaactgagtgtggtggtgtgtgcctgtaatcccagctactcaggaggctgaggcaggagaattgcgtgaactcgggagacggcagtgagccgagatcatgccattgcactccagccaaggtgacaatgtgagactccgtctcaaaaaaaaaaaaaaaaaaaaaaaacaggaaatgactttaaaggccccaaatttcatgggaactgcaagagtcaatcagaggaaactatggatagagtgtggcaacttccagggcaactctggtgatctgctgttacagaggggttcactcattacagcacgtgtctgcagaaaaatggcaagcaacactatacatcacatgctggttttcaaccagggcgggtatttggaaatgtgtgtgtatttgccagagaggcatttagtggcagtagtaggaaaccaaacacgctaaatatccttccaggtgtcagccagtcccccagaacaaaaatttgttttgtgtcacccaggaatcttgagtttattcaatgtccttgaaaatggataggcagtcattattaaaatgagatcgtttgtcaacttttactgatctaagtgcagcatacatccgcagtatttgcgggacaaatcgtgttgcatgacgttataggtggaagggcttgcacgtggcatgcaggctttctgcacaggaagtcgaagcttgatgcacggtctcatggatcagtgtaaggcatgggatttactttgacgttcagatgggtgtagggaatttgaaaagcacctgcaggagctggtaatgacataactgtgtgactccattccattgctggatcatgcactggatactctcaaaacatgtggacactgaaatcccagacacatgtcttaaggagcttcccatccctgagtgtagaagggtctgagaaacggtgtgcctttggaaataacgtaactgccagtaaatcagcctttggccctttgacagttacaaacagcaagagattatccgaagcagcagagcttagcagaatgcctgttccactccaaccagctggagtccttactagaagaaatagctcatgcagctgacagcccacttggtatgtgagtcagcctaggttgtcatggaaccttgtagaatttggagaagatatagattataagtccatgtctttatcatctttccatgcctatctgcacctaatatgtgccctacaatgtaggtgagctagagcaatgcctcaccaaagacagtatatttaaatagaatcttaaatgatagacaggagtgtcagtaaaagcactggtaagattttgcatggagggtcgaaaatgaacacagtacatctcagatatgcaaaagacacagtataacttaatctataattgaggataactgaccttatcctcaccttctggagtggtggtaaggcctactcaaactttctgctcaaagggacattatgagattacaatactggagggccttcaaccctgagaacttcccttccccattgacatatgaacctaccatccacaggtgagagaagagaatgagcaaagactctttgtagtggggatttttctcttttcactttcttatgctgcatgtgctctccctgtcattcatggaattgctgtttccaatccttgaccgtaaattttataagcttcagaaggaagagcagaggcagtatctatttatcttgagtgaatcctctaggggatgactactatattattattatgaaccacaatcggatatttttgtctgatttgtccagtggattttaattgctgggtctctcgaatgtagaatttgctttgtgtcctacccttgttctcgacacatgattcagagtacatatgcagtcgctggaaactgctctgattcacattgccaagatattatttctgccttacatgaaatgttaaaaaaatgaacaaataactactggtattttattttcaaaaagacacacccaagttattttccaaatcagcagttagagttcaataatgtttgggtttgcagaaagatcaactcattctgacactgtgttagtttaaccagagaataatactttgacttatggtcttttattgatttttttttctgatgcaaaaaaaaaatggcaaaagagaaatttaagtacaaaatttattgcggtaaagagattaaaactatttcttatgtaaaccaaaatcaacatttgtttcacttgactaccagtagttggaaaaactatctattacaaatgcaaattctggacaaaagaccaatgatggtccttgttcaagtcagtaaatgtgctcagaccaccagggagaatttcaggataactgtcttagtagagagatagaaagagatgacaagaggaataataaattacattactaataaatgatcacttccctattggacaaccatgagtgaccttcatatctttatgccctcaatgccaaggattcaaataacagattcccaaattcatgcttcatggacaaggatttccttttatgaagcttcttatgcatttttcaggatatacttaatctatgcattcagcaatgatggagaagatgaggccacagaggaggctccatcccatctggaccaccctcttcctctttgaaagatgtacatccttctcaccaactgtctaaagcccttcctgtgcccattcaccaagggctatctccattgggaatcattcttcatcatcaatataatgatcagggggaaactctgctatgaggcaagggaccagtttctaggcagaaaacctggaggacattttacgtattttaaaagaagccgattaaccctaaagcaatctctgccacttctccaagggctttaagatattgcagcaaccctggggctccattttctgttacagcccattttctgaagggagagagaaatccaaactgtctcctagaaggagagaagttagacagggctacctagctcaaaagtgtgaagtcagtcagtcctcccatgttcctctaggaaccgttcttcaccctcctagaagtcattgtgttattggaaaagtttcttaacttctcacaatgtcagttttatgcatatgtaaaatgggaataatcataatgcctgtctcttaaagatggaatgagggctaacacgcatggaaagctcatggcacagagcctgccatataacaggcattccacaactgtgaagccagcatgaatgcctcacttaatagaggagaaaactgaggcccggagagatgaagattcttggcccaagttcaaaagcatcaggctgcatctctgtctaccaccctgcaaccagacttgtcctcttgtatttaaaaaaacaataaaatataataaagttgaggagaaaccatcggatttaaaaatgaatgtcctaagtctaaaagtcaagatctgtatcttgagacacaagaaatttcctgttaatgatgaacgtacatcattagagtttcttatctttcaaattctagagatttatatggggattctttgaattacatacaaatatttttaacctttataagatttatatcaagtggtatattaataccatctgtggccagtacaaattccaccctacaccccggaattccatgtattatgaattaagtattctgtctattccatttgggtctataagcattcttatcatgtctatttgtttaaggacctcttttaagaaacagctcatttaatattttgtgtttgaaccatcttgaaggcaaatattacagtcattttccttttacatagaaaaaatacatatcatgaaaataaaataatacaaaataacattcatgggttccgagggcatatctcccaggatgtgaagtactgcctcactctggtagtatggtcagctggaggtaactaggaaacaagctaacaaaacaaaaggctgaacaatcaataaattaaacaacaaaccttcgctttgagattactaggtgatatagaacaggaaggcatgtggctgtcctgacaaccagcatctattcctccctggctggagttgaggtgatgggagggaaattgagtgacagcagaaagaatctctgtaagcagagctctcagagtgacacctttggggacccaaggccagccggggttaagattagtgtgaatgctctgaaatgtctgcttggtgttggccacacccttccagggcccctggcctgccctgccctggcatggccagttatgtctggaattcagggctgtcatcccctccccaagctctcttgtggggtccctggtgtggcttttcctcccacagtccctcgtttgcctttattatcagtagctgctccccacagtggtggcatcatgagtgctggagagctttctctgcctcagcactcttggcctcgcctctgggcgtcctctgagattgctgtcaccaccaggccggctatggactctctataagatggtggggcctctgggtgggagtcatttccatcctggaattccaggcccgtctctgtatatagaggtggaggaatgccagaggcctctctctctgcaggacagctctgcttttccacctcaaggctctcttcataagctggagggtaaaagtctggcctaggggacaaaacagcataaacatgcgtgcgttatttaggcattaatgccaaagaggcagacggctgcctctctcagctcaaattgtgcgaagctaaactgttaagaaacatggatttttgaaacagatgtacttcttcctggcatcaccagttttttaaaaatgtgctgctcttccaaaagaacctttttatcagccacaggatgcctgcctctagtcacatttttttcccagtgggttatgccaagctattccttctctattgctcattcactcatgaaaacagggccattcagtgtgagatccttgtcaacattagaggaggtgggggctttggatagggaacttctctctaccgagtacttagtccatccacatccttgctccctttctcgcatggcatcatcccctcaattgcactcactttctctgatcatcacagccaacaaaataatgaatgaaaaccaactctgtgctgatccctgaactataccagatgccatgtctctatcctaacaccctttcgagactcagtagctagtttcaaagaaaatatacaaacatattcatttctcaaatgatatcaactgacaactttacacagatttcagttgtagccctttctatgccagtaggctaaagcagccattcattcgggggctgatgtactcattggtcatcttgcctggcatttctaattgctaaatcctcctggcttctccatcatgaatgaatttgggggaaggggagaggggaggaagagagaccggtgagcttggctgagttgtgtatttatagagtgatccttccagtgcctacagggagtgtttatggtgtgtaaccacaacagaacagggactgccatttgtagccacaactccattccaaatgttaccaggcccaaagccagtagctgaagaagctgtctactataaggcataaatctcagccttcgctcagaatagccaaggctgagtcacggggcacatgtgtaaaggcattttacacagaaaggtgagatgttccctggagtgatgtgaaaggttccaggatgactgctgcctgccccaaatcccagctacctctcccaaccccaccctccttcaactgccatccatattcccagtcccctgaattccatcatcggagacccatttgctttgatatctcaacctgggtatccattttgagtgcaaatgctttggagaaatgtgacttcccaggctgacttgccagccattctgcgtgggataagcatcttattacatgcagcgagaagaggcagtaaaatgggggtgttacgatgtccataatttactttcaaacatttcagtatactgtaatattatgcagtgttagtcaatttaagctatatcctaaaggcaatcagttacatttatcagaaattcacactctagaggtagtcctctaacatttatacaaaaagaaatcatcactctagaggcatcttctacaatcacttcatttctcttaatttttaatcaaacccagaaactctgctggttagtataacattggaaataagttttggttttcataattattatcttattaattagcataaaggatgccaaaagtggatgctcatgggtaagattacttatattcaagatacatggagtagctaaaatattttagatactttctactcttgcacgaagagggcaaaataattatagtcttgtagcctgtatcttgagaatgatgcctagggtgttatccctaaatggtcctgtggctagccaagaattaggaggtttcttgttgcctgatactgactataagattaactgaatcttttttttcttgtggtaaaatatatatgacataaaatttactgtttttaagtgtatagctcagtggcactaaatacactcatattgctctacaaccatcaccttaaaactctctactcattaaacaataggtccccagtctctccttccaccagcccctgggaccactgttctactttctgtgtctgtgaatttgactacgctaagtactcatgtaagtggaattatacaatatttgccctttgtaactgacttgtttcacttagcataatgttttcaacttcatccaagtggtggcatgtgccaggatttccttcctttttaaggctaatattccattgcatgtatataccacattttgtttatctactcacctgttgatggacatttgggctattatgaataaatgttgctacaagcattggtgtacaaacatccatttgaatccctgctttcagttcctttgtgtataaactcagaatgtagaattgccagatcaaacagtaattcaatatttaatgtatagaggagtctccacactgttttccacagtggttgcaccattttaacattcccaccagcaatgcacagcgttccaatttattgacatcctcaccaacactagctgtttggttttgttttttgatgataactatcctaatgtatgagatggcgagaaagaatgaatcttgcctctagaatattatcaccttcccctgaaggaatgttttatgcaaggtgagatcacaacacctaaaaggacagtaaactgggacttttctgagctcacagagattccaggactcattttatgcctgcttcttcatttgttgtgtggcagaatttggtctgggacttgctttccttagaacctcatagccaggttatgggaagtaactaaccatcacctgccactaattaatgacagctgccatgatataacaaaagagcctgggtttctaaattggcttaggtgggttttcactgggggtggtggtagggtttctctgagatgagttgcccctgcgtcatggttttccccaaagatggcgccactcttcctaataacaaccccagagtaattccctgacaataaagctttggttctagacagacagcccatgggacatgtaagtcgctccatagtaggatcagaaattactcagatcttacacaactcagcccatctcagcccttcttggtccctctgcctgtcagcacgtacctgtctactgtggccacgggcagggccccatgagcaaggtgttgtcggagcatgtgcctcaacactcctttgctttcagtcacctggcgatagttgctccagaaaattccactcagaaggatcacaaaccccagaggcagaagcaaataggccgcaatcaggctcccctgacagtcgaatatggagccccaggaaatgaagaaggcccccaggcagaccatcaggaaacccatcaggagggcaagagcacagagaatgaggccagttctgttctgcatccttgcaccttaggaacccagcaccctgaccctgctgctcctctgcttccctgcttgctccaagagaatgagctcattagccagcttgcagctttatatgctctgggacccactggcctttggacaactaaatgaaacaggcacttagaagctattcattaaccattgaaagtaagtgtaatatccttggagaattagccaaaaaacatagcattgtatactgcaggcaggagtggcttcgtgtagctgttttgttcttcagagttgggtgggacactcagctgttcccagttatttgaacgtacagccctcctttgattaaaaggcgctggtctcttaatccccatggagggcaattccccactaaaagctggagaagttagcactctttaaagaacgatcttctttgaggtttggtaagaaatcccttcctgattccttctccctttttctgtactaaaaaggcatttcttcaaggctgttaacatgtttgtcttgcctccctcaatgaatccccacttattgcccccacactatgatactggcataattccaagacagaagttcagagtgtgaacttcgtggttcctgctctgttgacaagatcgaaagagcctgagtgggagggaaaggagagtgctggagaaaaggactataatagacagagcctcgggaatttggggggattttgggcctgtaattcctgcaatctttccccctttcataaagtacatatgaaatagaattcgttttagaggatgctgctaaaaatgttccctgtcctctcctccacacctctgctctatgtagcattgcctcaaaaaatctttccagaaccagccttctgtttcctggctggaatttgttttctttagcttgactgtctttgattgtggatagcttatttcagacgtgctttatgccctggctctgcccttttttatttgataatgtggcatgtctctgccaaaagtctccttcccataggaaccctgggttgcttttactcaggatagcttatcttcagttcctctttgctgctgttccactccactactccattaccattattttccatttactttcccaatgagagcagcagttttttgtggcgtgccctaataatccctcatataacctttagtctcacactcaccatctccttagctctaccttcatgttagggctgggagacacggatattagagaggtacacactatggatcaaaaactatataaggcacttctccattccaacccttagcctttacctttcttagcttcaatttcgaccttgaactaccttgatcttctagtcttgatattgtctttgtaatcttaaaacagctcttattccctccttccccaaactgtgagatggaatatttctaagatgatccctaaggatcccacctcctgatattcatgtccttgtgtaagtaatcctctcccctgagtgtaggctggacctagtgacttcattctaatcaatagaatatggtaacggtgatcggaagttacttccgtggaggctacacaagattgtggttttcatctttctagcagactctctctattgtcctcttggcttacgccctttgaagaaggaagctgccatattggagaggcccatgaggcaaggaattgagggcaggttctggccaacagtcactgaagaactgaggcccttagtccgtcagcccatgaggaactgcatcctgtcaatgaccacgtgagcttgcaatcaaatcctcatcccactgagccttgagatgactctgctcccaagcatcaccttgactcagtgaccctgaagtagaggacccaggtaagtcatactcggattcctgacccacagaaactgtgagataaaacgtttcagccagggtcctggatgccacaagatggcaagagccataatcaatgaatgcattatgatcaaatcatttcatgtttatggatgtcactattttaacaaataaaagaggtcaaaagtttaaaaaaagtatattttaaaaatatgctaagttttgtggccattttttagatagcagtagataactaaaaaaattctcttagaactttgaaaatcagaagagacaatcaatgttaagtatttatcatagtacctggcacagagagtgccctgtgaaggttatctataatcaccatcaccaatattgttattatcattgctgttacaattccaaaaatctgtggaagacccaggacccccagctgaaaggtctgcactaggagttgggtcccaggaacaggtagatggtaaagccccaggataatgttaagaatcaggtgatggaggaagagtactctcaatcggaactgcccatcagacagttgggcttctctgttttagacaaaaatggaggcagaaattagactggggattatgacaggtcaggcctcattcttgtgatcacatcaacacatgagtaaataagtttctctatactttttcctcctccatgccaataaagtacactagaaccattgccttatagtttgtcagacagttccttcccctccagtgccctttgaggaggctcctgtcattccacagcagtgttgttgttgtgatggtggtggtggtatgtttttggtgagaaattaggtatggaagagcaaaatccaggaagtggcagggggatggaaggactcagtccctttacataaaatttatgtgaaattaagaatagttcctgggctcagggtatttgaggaatttattttgggcatcaaggggaaaaggctgggaatatttgcagcatctgtgggaaggagacgagaaaaggaaaaaaaatcaatatggaaatatgaagtatcacagggaaccatatttctccttcaaaatgactaagaaatactaatgaacaccacacagtctatctgtgtaataaaactgtacctgaaatacctcctaaatctgtacaaataaaaacaaacaaatttaaaaggcaaaagagagagaaatactggtgaagttgaggttattttgtatgtttatgtttattattaaatatacattactaaataattataattttttaaactgtgactctgcttcagttcctctttttgcccatcataaaattttattatgaataattaaaactttactcgctggtaagaaattaccaatgcttaaaatggtaattttaattataagaaaaattaggttgaaaagatagggtgttccctcgcattgtcaaataacatacaatgccgcagataaaaacagagatcagcatcgtttttaggaactatgcttcaccctcaaatttatttgtatacctggaaattcagttgccatcatcaagcttaggttaattgattataaactggttaacacaattgagcatcatagcatcttgagacagttctagtctgcaaatataagccaccagtgtactttacagtaataacacaaaatcagcataatactgtaagcaaaagatgctaagttatcatgtgttattatgaagttatgaaggttgtcattgttgtgcatactttctttttttctgaaaatatttgatctttactttttatgtgctttgtaatatgtgctatgagtgtagtcatatatatatggagattatatattaagctatatctatatcaggggtatgtgcccactctttaaacttttaagttcagaggtacatgtgcaggttcgttatataggtaaacttgtgtcgtgggggtttgttgtacagattatttcatcacccaggtatttagcctagtacccattgattatttttcctgatcctctccctcctcccaccctctaccctccaataggacccagtgtctgttggtcccttctttgtgtccatgtgttttgatcatttagctcccactataaatgggaacatgcagtaaatatgttttctgttcctgtgttagtttgatgataatggcctccagctccacccatatccgtgcaaaggacatgatcttgttctttcttatggctccatagtattccatggtgtatatgtaccacattttctttatccagcctattattgatgggcatttaggttgattccatgtctttgctattgtgaatagtactgcaaagaacatatgtgtgcatgtgtctttatgatagaatgatttatagtcccttgggtatatatccagtaatgggattgctggactgaatggcgtttctgtcttcaggtctttgaggaatcaccatattgtcttccgcaatggctgaactaatttacactcccaccaacagtgtataagcattcctttttctccacaaccttgccagtatctgttatttttgacttttaacaatagccattctgactggtgttagatcgtatctcattgtggttttgatttgcatttctctaatcatcagtgatgttgagcttttttcatatgattgttggttgcatgaatgtcttctttctgcttcagttctaaaccacatggatcactgctatataagcattattccccttctgtgcctcaaaaatgaccaagaatcactaaaaccaattacttgtaattttaaacaatttttattacttgcagtttccctcctatttatgttgcagtatgccctctttccccacactcactagtagtaataacatttttgaaaaaaagaaatgaaagcagatgtacacttgctttactcacagtgaaacagcatagacatggagagaaagcgtcttgttcttcagccatcttgaaggtgtagaagaaactcaagcagaagagcagttgtaataacagaagagaaaatcaggccacattctcagggctggggcaaaataaaaagaatgtaagaaagaggcagtcaaacactaagaagttgccttgaagagtcatttcaggagacctttggccctttacctgagctgtatcctatcttctggatctgccttctctcccatgccaacttttccattttctcccccttgccactactcagcactgattatgagagtaaggggccatttaaaggtggcaacactgcagaagagagagactgatgattcaccaaagttcacagacagtatgaaactgatgggaaaatggatacgctggaggggtatggttcacacctctagagagaaaagttctgggactcagtggaggccaagccaaagtcccccatcactgtttccatctccttctcaagagatccaccaaggaaatgataccttgcttttaaactagtctatttgcttattattcttcctcttaaaaattcacccatcaggccgggtgcggtggctcatgcctgtaatcccagcactttgggaggccgagatgggcagatcacgaggtcaggagatagagaccaccctggctaacatggtgaaaccccatctctactaaaaatacaaaaaacattagccgggcgtggtggtgggcacctgtagtcccagctactcagcaggctgaggcaggagaatggcttgaacccgggaggcggagcttgcagtgagccaagatcgcactactgcactctagcctgggcgactaagagagactccatctcgaaaaataaaaaaataaaaataaattaaaaaaaaaattcaccaatcagcagaagtgtctgacatagcagtaagcaacaacatgttatttggttgacagccaaattatcttaaaccataatcactctttcaacactgttcctttgagcatgacagatccatgaggattgttctgaacactgagtgccttaccttgcacatcagagcccccaaaacctcacccttctttcagtctccggtgcaatacacaaatgccttagaacttctcacagccctatgcactctagtttctgtttaccaggcacatgggccaatacccttgtttcgaaaacaggaagagcattgctgtgaatgagaagtcagtggggactttggaaggaaactaatggtgtgtagaagctgttgcataggagggacatggggccaagagctgaggcagactggccagatttcagaaggtcactttggtttaggaagtgaggctttgtgggaggcagggaaggggcgcataggcgtagcaagagatgtcagccctgcctgatttcacggtggtgattactgagtgatttctggattagcctttcacacttgagggttcactgagcactggccacttcctcctcttttccattcttgttttctttgcttttgaaactgtccaccctccctcctcttcccccactcaggagaagatttatatgaaggcttttttttggttggcaaagaacagcttctcacaaagtgcatggcacagtaaggtaagctgatgtgagagcagcacgtgaggccccactcaccctgggtggaacctagtgggtctctgggccaggggactctgtggagaccaggactaggtggaactatggggcagttgcctaaagtgcaaaatttgttgggggttatagggggtggggagggtggaacttagtaatcaagaaaaatcatattttccagcaatgttttaaaaaatctaattggcagaatatggctcatggggcagcagcctgtttctgtaaataaagttgtggtgaggaaatttggtcctgtctattggccaaacagaaagataaattttgttctagagggaggtcaatttaatccacaaataagccagaacaaatttaatttctttggggatccttggaaaactgaaaagaccacacttccatggccactttggatcagagcagaagcctcaagccagggcagaatctgactgcctgcattgacaccacctggcatgatgggcagggacttgtaaataggaagcagtttctgtgcccactttatgaaattctctgtaatattctgtttcccttttctccacttcctagttttaatactcttgaataacttaagtgatagcaaaatatgtgttgctcaaagatttagtagaactccctcataaaaccactgggtccaagacctttttttctcttacttttttttccttgtaattttttattgactgctaggtactgtgtgtaggatagtagagactgagataaacagtagatatgccatgcctgaacatgggcacaactctgccattgctcacctctcggtgtagggagttgagcaaatctagtcaagatttgggctgagtttgggttttgttgttattatggttcccttcagtgcactactggcttcaaattcctctggtattaactggtgcttggggtgagggatggcttgctgaagggtttttttcaatgttcctcctctatcctcaattttagaccttcactgagtactcgcacctgagtggggtgggtcttcatactcttgcctattttttcagcagcagactatgcttattacctgatgcttgctagctgggtggtagggggagggggtttctctgttgtcttgatccaccttagtcttatgcaggccttaagatcctggtgttggagactggggctttctcagtgaacctactctttctccagcattagtttcctctaacaatctgacctcaggatagttccctgatcctcccttacagagggctttttcttttcactttttccagccacatgggtttcgcctgtgccctgggggaaggagggtttgccacctcccgactctagcagctcaacagagtccagctggggcttgacaatttcctgcagcagctgggtggagatccactggagaagagcccagaagtgggtgcaaacccccatcgtgtctacagctcctagtgtttctgtactcccacattagcccacatttggcatctaacaattagttaaaaacttcagctgaattattcttacgatcttgtatgacatttgtgtctcttatacctgggccctgtcataggagagccagggcttgtgtcccggcttccattggaggctcctgtctttccttagattgaagctattcacttgccctgtaacctcagctccctgatggagtcaagaaatattatgattttgtaggttgtcaggcattttctggttgttagatgagagcaatactctttcaggctttctaactcctgggcagaaggggggatatccttggcatcatttctttatggtaaacttcaattagtttttcaaattctcctaaaggttttaaggttatctcttctcctgaagtcattttttataatttacaatttcctaaaaaacattccacttacatgcctacaaattctcttcacacacacacacacacataacgttcacttataatataatatatggttataatattatatgcagtattcaattataattttaaagtcttatctgattttctaggtatgtcacctttccaattcttaacattgctatttgtgtctttattcctttttgtttttttgatgagactaaccatagctatttcattagatttttcaaaactacttgttcatgtattgatctaagagtcagcatttggttttataatcattcaggctttttttaaagaaagattttattttgtttataaatttatatttcataagtttctgaagttatcatcaataattcctctagtctactttgaattttttgtcattttgggatagtgtcttcagtaaatcaggcctttttaaacgattctattagttttatgattcaccagtttttgctttaatctttaacaatttctttagtctacttttaatgactgttttgtcatcctttttgcagtatgcttaatttatctccaatcttgttttcaaataaatataattagtgccacccatttgtgtcactttgacccaaatcacacacatttttatatgccatgctctcattgtcagtcatttccaaataataagtaatttcacataatataaaaatgagcaaaatatataagcatataagtgtttttaaaagaaataggaaatagcccttaaacaattaaaatatgttcaaccccacttataataaggaaagtactaaaatacaatttcttgcctatcagatcagcaaaaatctcagtttgacaacacactctgttggcaaggctgcagggcaaagatactcatatattgcaggtgggaatacaacagctagcaaacttacatttgcatttttctttctgacccagaaatcacacttctggaaatatattccaaagatacattggcaaaaatacaaaattttaaatgtgcagatttacttattgcagcagcattgtttgtaattatataagactggaaacactcaaatggccatgaataagggcccagttgaataaactaaggtacattcacgtgtcagaatgctattcagttataaaaaggaatgagtaacatctctatattactagggtatactgataagataacaaatcaaataacaaagtttatagtataaaaaagaggggatacaaatatgtatgaatatatgtcaatattttcaaaaagaaacaatgagattatcaaagaaaattaatttttataatggttacctttaggagggagggaacagggtaggaaggatacagttggaagacagatttatctgaatgtgtctttaaaatagttacaaaattggaactataagcatattttacataattaaaaaccaaattaaatcaaagcaaagtaatccttaaaatttttctttaaaaaaggtaacaaatgaacctaacttcttatcagtttgattgcttgccataaaaaaagtattctaagtaaatttaaattgcggtattttcactcagtgggaaagactctagtgtaaaacaatacaaaaacaaaatctacaaataaatcctaatatgcattcagtagtcttatggatggtaagaatatggggtattgtaatcctagcattgtgggaggccaaagcaggcagatcacttgagtccaagagatcgagaccagcctgggcaacatggcaaaaccccatctctacaaaaaaatacaaaaatcagccaggcatggtggcgtgccttagtcccaggtactcagggtgggtacgctggggatgggcatgctgagggaggtcaagtctgcaatgagccattatcatgccactgcactccagcctgggcagcagagtccccttccttacaaaccctttaggtagacataggagcttctggaactctatttatctctttgcactgtgtcctggaagagtcagactcaatattgcagctcactaatttaatactcatttgcatccatttggatattcagcccgatttttaaagtagcagtgattgtattttcaataatccagaaatccgattctttttctattttatggctgtgacagtcatcccagtgaatgaaggttctgattatgggagccataatcctctagagttttggggtagaagctggcaggtgttcaggtagatgatgttgatgtgagggggtttctctccccagcataagtggtctgggaacttctcacatcagaagcagctaatggtttccttttcttcccaccgctcctcctgccacgccttgttgtatatgtagaattactcaaccctgctctgcttctctgtccagagtcagcccttctgataggaaactccccaggttcactgtttaaagcagttaccgaggctttaaccagaaagcaaacaccactcttgccaaaaatgcagcacgtgagagtgataggaagatcataacaggccaggcaattcataatgtaatctttcaattttattttttatttttcttgagacaaggtcttgctctgtcactcaggctggagtgcagtggcatggtcacagcttactgcaccctcaacttccctgggttcaagcaatccttctgcctcagcctcccaagtagctgggaccacaggcgcataccaccatacctagctaattttttaattgtgtgtgtgtgtgtgcgtgtgtgtatgtgtgtatgtgtgtgtgtgtttatagtagagacagggtttcgccatgttgcccaggctggccttaaacttctgagctcaagtgatcctcccacctcagcctcctaaagtgctgggattacaggaatgagcaaccacgcctggcccataatgcaatcttttaatttattgatcagataattactgacaaggcccctccctgcactgtacgagttaactctgagcttgaaatttctctagaacattagtgcacaaaacagccctgacctttgcagtaatctccttctggtcattttctgctttgatttctttgtcaatcaattctttggtctgtattccaggaaatcttcagaatttctgatcttcgactgtaacttttcttgtttggtatttcagtggaatttgaagtcggggcggggggagtagactgatgtgctcagtctgccaattcgatcccccatttttttctgagtgtataaggatatgagtgggtattgtttacaaaattaggatcacgttgtatacataattttgtattttgcttttttagtataacaacatgtgttttttgaaaacagtattttcagtgattatattttgaatgagtcttcgctgtttatcatactgaagtataattactgatattcttttatttcttccacactaaataataaggtccttgagaagagagaaaatgtcagcactgtagatccttaagacgaattgaaattcctggcatgtagtagttccataagtcttcatgattcaatctgattttttttttttttttcagttaaataggtgaggaccaaggcagagacttagagaggggatggatgggaaaaaaagggagtaagtttgacttggcaataggggaggattaaatctgctcattcctgtcttttgattttattcccactttccttgtttgctgctattacagaagcagaatccttagttgaattggaaaatatggttgttgagattttcctcccccttattagagccctagagacaagaacctatctttggaacacaatgtttctttcagcacatgtcacaatgtgtataaagtatttctgaggggatgtgtttctaagttaaaggtattctaagaagtataaagatggtgctgatctacccaagttgctatttactgcctcagaaagatgagtcatgccctgcttatgttgagggactgaagtaacgacttctcatagccaggagtataatcaagtcgtgaacatccataacagtaactataaactcttatgggattgtggcattagacggttagaaacctttgtttaagtgttttgggatgactagttcactgcacttgaacaagtgttggaaatccaaataaaaaggcaaaacattatcctcacatagatttatcatcaagctcacatttttttttaattttacaaatatagttgagtgtctcaaaaacagatgattcccattttctagcccacaaaagcttaaaaataaatcctgggtcttatttttttctctttctttttttttttttcaatgcatctgtttatttaatgtgagtcactaatgcctagcccaagaagaagctgaataattcatgaccaatatttttttctctgaatgagacttagacataaattattgtaccttcatatacatatataatgttcattatctttttaaaaatcaataggggcccacattttttagtttttgaaaaatgggtagaagaaggaaggagggagaaaattgctgctgatctataggaaagaatagcagggtatatcttggtttaaactgaactatgtacagtttctcgtgtttttcacttttcacatggtccaatatgaaaaatacacctaaaacaatcataataattatgtaccaagtaccaacatgtaccaggcaattttacttttgctatctttaattatcacaacaatattgcagtgtaggtaagttccctttaagactgaaggatgctgagtcctaagagtatcagtgacctcctcgaggtcatttagagccactttacaaacccatccctactggctctatgtcctacactcttcaccttacatcacaatgtctctctgcacagctgattttaacatttgcaattttacgtaatacatttacaattgatgataaaattattaattgctacttctaatagatttgcaaaatattttagattcacagtatttatcaaacacctgtcatttacaagtgtatgaatcaggatgggctaggatttgctttgtagcaaacaacctcatatctccatggttttaaatgacaaaaatgtattccttgttctctcacagagtccatcataggtcagctaaatctttgctctaagttgaccttttcttcactttaggatgcagctgagggagtagctattttcctaaacacaaatagtcacaatagccaagagaacagatgacactgaagggtcttgcattgacaattaaaattttggcccacaggtttcacacatcgctttgttataactcattagcaataactggtcacatgtccccaaccaaccacaggggaccaagaagtgtaaatctactgtaggcccagaagattcaaatagctagaaatatttggtgggcaccattaattctacctcaccaggaatgtaactaagtgctggagggaacacaaagaatgagttatgctctttgtcctttgaaaacttaccgtgagccatgcaaacaagcaaccacaatgcaaagcaggtaagagtgcaactgtagtaaaagcaccatgttcaaggaagacagaggaaagaatgattaatttaaaatggtgagactccagaatcctttgcagagaatactacagatgcattcctaaagtttaaagggttttaaagcatcaaaaggtattttagggagaaaagtacttaaactaagggaactgcatgaaagggtctggtgagttcaaggcaaagatgagtagactgatgggacaggaccagcaggtaaatgagactaggaatgaaacgagagactgaaaagtcatctggggacagagtataaaagtctgaatgccacacaaggaaacagtgccctttatattgaaattgctacattttattagagctaaatcagaaatgttcttgtctcaaattgattaatgtttccatcttgacacatttatgtttttttagaagaatatattctcatgttaagtagagtaaaataacaagattgtcagaacagagtatctggtacataacaggtaatcaataaatatgaatgaatgtatgggtaggaagaaagtcaaggaaggcattatatattaatcctttcataatttatcaaattctgagtatgcacaactgatttttttaaataaagaaagagcatatattactgaagagaactggttgggtgatgcctcagtaaaatgttatctaattctacatgtttaattacttctctttcttcctttcttgagcctcaggtatgtgaatgattttaacattccctcttaggtttggtcctcccattctttaagcaaatttgttcttctctgaaaatttcctaggctctctgtttgtctctttaagcctcagagcctcaaacactggagagaacttgctgcatgcgagcttattctaatacttaatattttctggggcctcagggtgagggttgcctcacagtccctgtgtatagaagttctaatctagagcatgcaatcttgtgcactaagtaaaagcagctatactaaaaaataaaaaaaaaaaattaaaaacaagccaacaaaaccccaaaccccacctagagttgttaaatacagaacttttcagcagccaagtgaccctgtcagcccttagctagaatttcatgcctcccaggaacagggtaattgaaaggaacaatgctgatggcttgggctagtcacagctggaaggttgctgcctttacactaagactctgttctgcctccttctgtggaaaatgaaagaggacttgttaatggagcaaaaccttgcaaagcatgtgtggtgctgtgggatttgtgatggaagtacaagtgggagaaggaatggacaaacagcagggtgacctgagtcaacatagcagacaccatgggcccccttgccatctaggccagggcttctcacacatggccacatggatcatttggggaatctcaagaaagtgcagactctgattcagcaggaagggggtagaactggaaattctgcaactctgacaagcttccacgtgatgctgatgctccctagaccacactttgagtagcaaggagtacaggcaacagcttccccttcccaaggaagctaactccttcctgttatgagagccttaaggttcaggtgttcaccctgccctatgctcaggcagcatcaccccttcccagccccacagagtgaggactttaatcagcctgagccaagtgtggtcattccactctttttgccagttactgtcttggacctagttgtgtgaccaatcttggtgaacgaaacaaaagggaaggttggtgggagcttttagaaagagtttccttggtctactggagccccaggtagagacttactgcttcctctgtttggaagttacctggctatcctcagagctgttgtattcatcttacaaaatgtaaggagagaccttgctggtccctgggttctttctgctcacctctccattggagactcactatcttctttcaggcaccgccttctctagttgaccctacacaatggacttcctcaggggtctactttggccccttttttcttctcattctgcattccctaaattagacgtttcaaactatgcatagccactcattgatgggtcattaaatcaatgcggaaggttgtcagcggcattaggagaaagaatagcatatgattgaacatcacatatggccagattaagaattgttcaggctaaccttgatttatggagtgtgcacgtttaatacaaaacacattttacatcgtagatccccttcaaaaaagctagggagccacaggtacctgtgacctcatttatttgtatgactctcaaatctctatctctgcctctacttctatctctatctgtatgtctcctatatctatctgtcagttccaagctcatgtcttcaactatctactcaacatgtccactcagaaagctcagagcaattcagaatcaaagccagactcaccatcatccccttcaagcctgcccccatcctcatgccactgcccactccaaacctccttctcctgtgtttcttgcattaggaaaggacactaccatctacccaaactaatgagactggaaccctgggagtcattcttggcccttccctctccttcatatccaacattctctgtctccacatgctgtttatttcactcccattcacctttccaaaaggtaattttgagataccttttacccctctccactacacgctaccatcctaatctaaaccactgtcatcccacttctggacaaggacattcgcttccttaacttgcctccccatgtcatctcttccttctttccaattctttcttccctctgcagacagaggacctattagccatgtcacttccctatttaaatataaggggaaattgcaaatcaataacctgtcatggaactggacgtggtggctcacgcctgtaatcccagcactttgggaggcctagatgggaggatcgcttgggtccaggagctcaaggccagcctgggtaattggcgaaaccccaaaattcaaaaattagccaggcatggtggcgcacctagtttcagcttcttgggaggctgaggtggaaggatcacttgagcccagggggcagaggttacagtgaggtgagatcgcgccactgcactccatcccgggcgatggagccagctcctgtctcaaaaaatacattttaaaaaacctgtcatggaaggccctttgtaaagatccctgactgtctcccttgcctagccctcactgcttcctgtttggggctgctcacagcttttcttacgtgccacactctctcatggctgtgactttggaggtgcttctctttctaggaagtctcttctcccctcatctcttcatgtatccaactcccccttattcactgaagtctcagaaggctgttacctccttagggaggtcttccttggctcctgaataagatgaagtcctcccagaataacacacaaaacaactgtaagtatttatttgttctacggtcttgattccatatgaaactacaagccccgtcgaggcaagcactctgtctcccctcttcacctgggtactcacagctccaagcccaggatctggtactcagcaatgatggcatagtcattatttattgaatagacagatgaaggaagctgtgtcaaagatacttcttaaataattatggtgaccaatgcaattttatatctttaaaaggatacctgattgtctaaaaatggactgttgccatttgaaacattctagacctatttagcagtccaaatgactgtgaactccagctgaagttcacgtgtcgagcagaagcatgtgttcactaggggtctgattttaccactcatctgagagtaatgtcctggcaaatccaatctctaaagtggttcaccctcaatctgacttcactgtatcgctgttcatcagaatacacatttatagatgtgacttagtgacacctagaatagtgtgatccattctcacacttctttgtgttatttgtgtgtctcttccactcttaggccaatgccaagtctataaacaggcaggagataacaaggctgctggtttctgataatagaggcctcacgtatttttcatatccttcaaatattattcctcaatatgtccccagggcaagatactacaataatccccttggccttggccttggcctctctttgaagttgaaagttaaaatgcattttctccagttgcttttaagtaacatagttaaatattacagtgtggttgacccctgcctcccaactgctacccttttgatgtgattctggcttgtgctgactggcctgctgagcacacaagcatgggtgagctgcggaggcaggtaccagggaaagggacacgttatactttaataaaaaagcaatttcactttcccgaaagagttaccttgggacacgtgatggaggttcatgtactgcatcctatagaaatgacaaaggctaaacctcaacctgcattcatcttctcttctacaccaaccagtgcggtagacaatggaagtacagactccttcctgctgtagctggtcctctttcctagctaggctgggtaggtgtcagaaagagatgaagtgtggcctccctgccatgagctgagactctggaagcatctctatcccttgtcacctagtgctactcagcaggaagggagcataggccatgttgctattgtcccatgccagagaccagacgcagatggaaaagacactcatcccctatgaggccatggagggcctctgctggtggagcaagttcaagctgcattcaaataaagtccctggcagtatttcccctgctgtcttcatttaggcctttgggtgccagaaaaggctgagatgagttgctgcgtcttcttggctttgggggaatgacacttgttgaggttcataggaaagctccgaggaagtcactgtgctcttaatgaccactctgcttctaggtactgtttgcttcacctccatttaatataccttgtagaccctcccagtcattctcccttgctcttcactttgcttttactctttgaccctcattcctttcctccctctttccggttgaacatgttttggtgaacttgacagcatttgtatttctttacttatttcatgtataagagcaatgctttgtacatcaaacaaagcagccttggcttagattgggttccttggaaacagcctctgagatagagaattgcatgcagagttgactgggggtgctttagggagctgcaccagtaaggaagtgaagaaggcagaactgggtaaggggagaagctgatctacaaaggggctgccacccagaggccttaaccaatcctgcagagagttctggagctagacggtcctccagaggtgtaccaaattgaagctaggggcccagcctttccttccctgcatcagccacccattggccactggctcacccttgggaaggaatttattcttggacaaggtagttgccttccgtgggggggaagttctcagtgaaaatgtggagctcagactcaggcctttgaggagggggagccccctggcagtggctggtactttcaaagtggcacaataaggctggttctgaaagtgtgaaggaaagcaggaaacagaaaccagctgttgcttccagggagaaagtaagtaccggggtcatgctggtgggtctggcaaccacatacgaagctgtaagtcccttctcccacaatcctgccacccgatctctctctggtgccccctgttggcagaatctaacacgaaagccccagcgttatggagcagcaggtaggagggtagacagtcgcttcaccaccagcctgtctgcaattctgcatccacgtgcctgcatggtaataactggcaggagctgcacatgagctgccttttgagaaagggtcacacgcccttgagttcactaggtccccacccagctgctgtcttactcatcaacctttccaaccaggcccttgtttgttacccttgcggcgggggaggggggcgaaaaaaaaaactgcttccctcaaaaggatccaaatcattttttgagaagggttccaggaatcagtatgaacacaggaattcatgctcaaaactttcatcacagctaacataacttcatgatgttttttcctgccagaactaactgactcttcctcctgtcttcttgagcaagccacaggcaccccacccagcccccttgctgagggaagtttgggggtttggcattgtgttgcaccactcagggcttggtttttgacctatcgctcagcctcccgcattgtttccgccctccttcccttccactttggagaggctgggctgcagaggccaggtcactttccacagcacacagctcagcaagcgctgtctcatggagtaaaaattcccttgagataaaccaaagccccaactacaattattttctctttgtatggatttttttcttggagtatggctgtaatcagagcttggcaagaaagtcatgttcttctatttttttaagaaaggctacaaacattttagcaaattaatagatagcgctgaagccaataataattttgtaaattaagatcctggggccaggatcatggaaatatggattataggtgtctaatgtctcccagaagatgaacagatttcttacatcaacagccctaaaagcatctttgccttgtcactgttgtcactgctgaatgtgtattgtcactcccacccacctctcctctgttggtcttctagaacaaaataagtacaagtgagagcccagatataaaacacagagctaagatacccagcatacatttttgtctgcccccacaaagcgaccgttaatcataatgacttactgagcacttactatgtgccaggctacagctatatgttatatctgaacctctgaagttgtttgcattttcagatagaaaacagaggtgaggttcagggcagttagatgacacagaacaaagaaaggacaaaaacagattcggaaacctctcattcattatgattatgttaaggagaaagtcttactctggtattaatatatattttcattttattttgtttctttgttttgtatttatattttggatttgatatttttaacacccctacaacactagcccttctccactgcctcccttcctcccttcctcttaacaaaaagagagccaagctataatttttttttttttttttttttgagacaggttctctttctgcagcccaggctgcaggacagtggcaggatcacagctcacctcagactcaacctcctgggctcaagtgatcctcctgcctcagcctcctgggtagctgggactataggcatgtgctaccacatctgtctactttttaattttttgttgagatggggtctcactaggttacccaggctgatctcaaactcctcagctcaagcaatcctcctgcctcagcctcccaaagtgttgagattaccagcttgagccaccatgcccagcctcgagctagaatttatatcattgtttttcattagttgtatccatttcatagttacctcctatttatgaccagtgatactgattttccttttacagtagagacatgacattccattttaaaataaacttaagttaaaaaaaccaagtcagctgggcgcagtggctaatgcctgtaatcccagcactttgggaagccaaggtggctggatcacttgagctcaagagttcgagaccagcctgggcaacatggcaaaaccccatctccacaaaaaaatacaaaaattagccgggtgtggcggcgcacagctgccatcacagctacttgggaggcggaagtgggagaatcacctgagcccgggaggtcaaggctgcagtgagctacgattgcaccactaccttccagcctggaagacagagtgagaccccgtcaaaaacaaaaaacaaaccaaacaaacaaaaacggagtcaagttctaaaataataaataagtacctaatagccaaagtggtacttgactgggcaaataatgtgaaagtatgaccttgcataacgtttctgaacatctctgtgcctcagtttccccaggataagaatggtacctacctcacaaggtggttgtgaggattacccatcttgacctatcccgaaggcataaagcagtacctaggacacagtcagcactacatgagtgctaactggtgttgttcttatgcaaatgcatgaattcagttcttgtgtgcctctgggaaagaccagctggtaaaagcaaagacaaccagggcatcagacttctaaatgtagatacattggtagaggctatgcctagcttcatactgctctgtaaaactgcagagtttaaggggaaattttactgtgatgtatagtcattaacatgcagtctttcttttttagtaatcaattgtgtttgttactataagaaacttaaaatctttgaagtactctatttctaacaagcttccctgccacctcctccccacgtgtctacaggaaattgagaacagtacgcaaattgcagagattgcttcaataattcatttactagatacaaagcttaaattttaaaagtcctgggacttttagatcatgcattttactcacagggattataattatgatgagataaaactttgatggtatcttctaaaacacacaaatttctggaaatgcaatgtggaatcaatgtgtcaaagaaaagctttaaaagagtttgtggagcttatttttgtgttatcatggggttttcataagaataaactttaaacaacccaacattccaacccaattttggaaggagaaacttggtatgcggtgttggtcatcagagactgaaacgcaacttccctggggtctcaggtgtgagatatttggtggacaaagcattactaagtccctggtatacgaagcaaatcagcattctccctgatatttaaggtacaaaggtaccaaaagggcatggaagagaaagtatacaagcctgctaggtctggattgtttatttagggaacaatggaaacagtgggattgttgaggattatgtagtctcctgtccggcagcagcagcatcagctgggaatttgtttaaaaggcaaattctcaggttccactgaatctagagccactgaatcacaaactgcgagttgggccaggcacagtgggctcatgcctgtaatcccagcacgttgggaggccgaagcgggcacaccacctgaggtcgggagttcaagaccagcctggccaacatggcaaaaccccatctctactaaaaatgcaaaaaattagctgggcatggtggcatgcacctgtagtcccagctacttgggaggctgaggcacaagaatcgcttgaacccggaaggcagaggttgcagtgagcctagattgcaccactgcactccagcctgggcgagagaccaagactccatctaaaaaaaaaaaaaaaaaaaaaaaaaaaaaaaaaaacccaaaaaaatggtctgggagttggtcccagccatctgtatgttagcaagccttccagggcattctgtaatgttgtagaaccactagtttaggggaaagacatagcatctgtctaaaagtaattttcataaggtgcccgtagacacaagtaaatgtagaatgatcattagctccttttttcatcttccctttgcatcctgaggaacataaacacaatagccttctaggtcaaagaaggacaattttgccctactgactccaagttctccttttttttttgaaacagagtctcactctgtcacccaggctggagtgcagtggcgcaatcttggctcactgcaactgccgcctcctgggttcaagcaattctcatgcctcagcctcctgagtagctgggattacaggcatgtgccaccatgcctggctaatgttttttgtatttttagtagagacggggtttcaccatgttggccaggctggtcttgaactcttggcctccggtaatccacctgcctcggcctcccaaagtgctgggattacaggtgtgagccactgtgaccggctgactccaagttctttagggcaaccagggcttttctggtggccaaggcttgactcacagagagcaaagaataagaaacattctgattcttattttagcaactcaagacatagcaacccaagatgtggaatctgatgcagatgggtgccctctgaaaagatgagtcattctatcatggtccatgacacataacctggacaattcagaatgggaaaggggtgcagctggaacacaagcgaggagagagagaggagagagggtagtggtaagggggtcacttgcttcggtgaggctatttgtcaggaagccaggctgggtgcctaatcagtgtggccgtattctctctcttcatggctctgcaacctgttcattggatgaacctggctttgttccttcccacctctgggtattaatatattaagaaaacaaattacagcccaatcccacaaaggctagggaacctgcctttcttcttcttcattgtgtccccagagcctagcagattgcctgctacgtagttgataaatatttgaaaaaaatcagtgaggctggaggtagagtttgttctcaaggtgagaggtagggcaggatttcctcccttaagtaaccaggcaggaaaagaacagagtgtcacttgttatagggtaccatggtcaaaccaaggaaatcaggattaatttgaaagtccaaaaggaagtagcacagatgaaaactggatatagtcagaggtcaggacttgggcagacctgaacttaaatgggatcaaagaaaggaaatgaggtaaggatagccctgctgtccacaaattgccccatgcataagtagattaggttggtgtaaagctatgttaactaatattcaacaaatatttattcagtccctattatgtgacaggtactactctaagaggcactcgcaattctgcagtaaacgaaacaaacaaaaatctctacagccacgaagtagagagcactgaccccaaaaggaataataataatagccatttgatgatttaataatcgtaataaataattgcttaccaggtgccaggcattgtcatcgttatcatacatagaccacccaatcagttgatgtggaagtaagttctatgcttatgctaactttcacttttccaaaggactttcttcttcagaccatcacctctgggtgcagaaacgacaggaggaagtaaagtctgaacttacgacctgggatattacatttcagtttggttctggccaggcaccatggctcacacctgtaatcccagcactttgggaggctgaggcaggcagatgacaaggtcaggagttcgagaccaggagttctggccaatatggtaaaaccccatctctactaaaaatacaataattagccgggcgtggtagcaggcacctgtagtcccagctacttgagaggccgagacaggcgaatcgcttgaacccggggggcggagcttgcagtgagccgagatcacgccactgcactctagcctgggcaacagagcgagactccgtctcaaaaaaaaaaaaaaattggttctaacaagtaggcaagtcgcctcatgacttatattactggttactgaaagattgagtaacaagattgcagttaatgaaataatatgaggcttttgatgggtgtttatatgaatagtaggtaaagaaaatggttttaagagaatgagcatcaaaagtctttctctaaaatcctttgtggcatgttgtcagaggaacattaataatgaactattctagacatcctctcgacaatgctttcacaaaaacataatatcactcaactgacatgggtttagttaaaaattccagccagatgatgattattaaaaaagaaaatccttaccagttagacatgcatgtagacccttgagtgtgtttttaaaaagatagatacatggaaacattagatatataaagatgtatattccagccagaagtgcctgtaagacaacagtactcctaaacataaagtaagttatttagaaattttcagatttgacaaggggttttattgtttgcctcatatactttatacacatagaacttgctgtgttaaaaagccctaattcactaacttcatttgtgtattattcaatgcctttccatgtattaatatttctggggctgtccctggtgaatgattgtgtatggaagagaataaattatttggttaagaccccagcctcgggaggcaagttgccaatgcttaattactggctccgtcacttactggctgtctgatattgagcaggttatttaacttctccatgcctcattttccccatctgtaaaagggggtactaataatgtgtcatagggtggttaacaggtttgaatatgcttataaaatgcctggaaaagtctctggtacatcgtaagtgctgtgtgaggtgctgatgtttttctgcttctgcaggtgtgcccttgctgtcctttgcctcctcagctgggctaacactgctgctcttcccttctgaagctcaccatcttccatcctcagatcccctctttcacagtgctgctgacatctcttccacccaacctcacctcccataattccccacacctcagaagagccaagctctgccattgcacgtggaggtagaaactagagagatagcaccaaaaaataactttcctccttgacataggcccacatccattttagggtgggttcctgagctggctcatgacatggtcctggcatcttccctgtaaccagagtcagttctgcccaaccacccactccaggcctccccacgcctcagaccctaactccaggaaaaaggaccatgttgtcccctcaccctaggctaaggcccaccacagttcatttcttgcctttggattgacctcttcctaggatggctgggaataagagcttcccttcccttaaggacaagccccactccacccacagggctgtgggacagatctgaggctcaacaagatgatcccattagagtccaatttagggattgctgggaagtgcagtcatcactgccagtggggtcccaccaaacacactgtgctcaattcagatcctactcagccagcttctctttgtcaaggttttcacaaatcctggggtcgagtctcacccagggtcaccttgagccagtggagtctgggattctgagaggcccaggtggtgatctagggttcagtttcctgctctgtcaaggactattttagctatgttacactttaagaagaatttgtgggtccctctgggaacttaactctatttataacattgtttctatgggaaagagtgttccaagtgacaatcaatttaaaacggaatgcttagtacacagccttttcatcgctgggggactgctggtaattttttcttcacatgtagagattatattgaagtttcaaaacaaatctagtataaacaagtagagcaaagaaaaagcaggtgttgcttcttgtattttttaggagacattttaaaagttgaagttttttaagaaaaaaagtttatttcacagggtaacatttattgagcatttactgtttaccagctactaaattaaagacagagtctgtgtaatctcatttaatcctcacagcaaagctctatggaggtgtgataaagaatcaccggcatttttgatgtttagccaatgaaagctttcaaactccaccaaaccctcccacttctgccccacatctgggcaagctgatgaaagagcacaggtgcgccctcctgtggtgctggtgggacatcccatccatgtaaacccagctgcaagagcgaagcttcgcccagccccactctcccacctccacaaaaccccaaggccagcctccgtttcccactcccttaaaccattcttggacctcttggaagctcactttacttccccccgaaagccttactgtgtgaaatataaagcttttcacaccttgtgtgtgtgtgtgtgtgtgtgtgtgtgtgtgtgtgtgtgatcattagtcccaacatccaagccaaatcttcggtgaggggtccatcttctctccatgaggtgactatagtaggtgagtatagtagtctctgttttacagatgaggaaactgaggctcagagagattaagttgcttgtcaactagataacagtatcatcttaaccactctgctctttctttacttcagctcagatgcgtcttgccttttgaaaatcagtgaaggaacttacattgagggattttacctcttgctaatactcaacacctactgattacctaccctgagctaagcttttttcatgaatgaactcatgttattcttttttttttctttgagacagagtcttgctcttgtttcccaggctggagtgcaatggcgccatctcggctcactgcaccctctgcctcccagttcaagcgattctccggcctcagcctcccaagtagctgggatgacaggcatgcaccaccgtgcccagctaattttatatttttagtagagacggggtttcaccatgttggtcaggttggtctcaaactcctgacctcgggtgatctgcccacctcagcctcccaaagtgctgggattacaggcatgagccaccatgcccagttaacttatgttattcttttaataactctatgaactaaataccattgtcagtcccatttttatagatgaggaaaccaagaaacagcaaagttcaacaactaatacagggtcaccctgctaataaatagcggaaccgggatttaaacacagacagtctgctcagaacatgttctcttggccatagggctataatacttcttacatagtccacaagtaaagctgataattcacccagtttttaaggattgtggtttggccactgcttaattggacagcagttgtttaaagaaagaaatcctatattaatgacacatttactggtttcattatatcttgtatagtgttcttatgttattcatatgtagtttactcaatacagcaaatgtctataaagaaaaggcaatgcttcagtttctttgatatcttcttccccacccgacccccaataactaggacattgctttttaggcaatgggaacccaacaaatgtcatctgaatggcttaaaatcagtaggtgttgcagaatgaaaccccacaatttcacctttgccctagatactacactacacatcattacaaataggccagggctctccaacaattgccatggaaactgtgtagaattcctgttcgctgtctcatgccatctgtttgactaaaggtataacaaggaaaataataatctgtaatttctcatagcaaagttccccaaattcacaaagacaagagtatttttttaaccatctgctttcccttcaggcttttcagcaacttctgtgtagctaatacataaaattgtgtaacatttatgagggctggttcaccatatatggtttctagctctgaaaactcagttatgtggaagctagaattaaacaacatcaaaaaccaaaaacaaacaaaaaaaaaccatgataactcaaatggaatctgcatgatgagttacaggactgacagtggaaacaaaagttaaaagtagtctcttatttctgtctgggtaccaaaggcaaagcttgctgcttttcagtttggccctgattgtgtctctgtcaaatgccttgggcaaatagatttaaaatttgcccacgaacaaagttagcttaataatggcttccatgcagagctgtcagaagataaaagagctctataaaggattctgaggaataaaactttatggaacttagtgccatatatgacaattcctttgaggaaatacatcaaaggtagagatgaagtgtttgagctggaaggcacttcattcagttcagtggttttgaatccgtgctccatggagcccctgggtttcctccaatttccctctgcagctgccagaggtaagaagttagtagagtgaatgtctggagtcaccagcccaacttccactgagcacccttgtgtgtatttgattttcttttgaatattctcataaaatttattttaacaaaggactctgtattagtctcttctcatgttgctgataaagacatacctgagattgggtaatttataaagaaaaagaggtttaatggactcacagttccatgtggctggggaggcctcacagtcatggtggaaggcgaagaggagaaaagtcacgtcttacatggtggcaggcaagagagagaatgaaagccaagcgaaaggggaaaccttttataaaatcatcagatcttgtgagacttattcactatcacaagaacagtatgaaggaaactgtccccatgattcagttatctcccaccgggtccttcccacaacatgtgggaattaatgggagctacaattcaagatgagatttgggtggggacacagagccaaaccgtatcagacttcgtggcttaacaatactttgataagattctgagctaatccaactccctcattttgtagacgaagagattcagtgatttgctaaggcctcagagatactcagagatgtggctgggactagacaggtggtctggcttcccaatctgctattctctcagtggtctttaggctggaaataaattgctactgcacacctgcaactcagggacacagtgctgaacaatttcttcaagagacagaattctgaacttcttcccagtccttggaacatcattctcctgtctcttaacttcttgcttctctgattatatttttatctagccaattggattttctgcctagcatgacttttccaacaacaacctgtttgctccccaggtagataactgataaatgtttatatcctaaaaatctccagtgcaatatgtccttggagggaaaacaccctctgaggcatatcagtaaggtactggatcttgatgtccccaagaaatggtactacgaaagttgcccacttcaaagaagatgtgatttttatttatagagtggaaaaatcatgaatgggtctctttgacaaaagttaaataacgagaattattgtattattagtaataacttttcatcaaggtcccccggagaaaatagtaataatagtaacaacaataataaaggtgaaaagtccatgttgcctttgttaaatagaagcatctctgatcacagcattggaactggaactggaaaggaccatgcagaccagttctccttcaaaagaattcataatttccagtaggaaccattgtcatcatcctcaatactgctaccatttcttgagcacttgctatggaccagccaactgtgttaagtaagctctttacaagcactgtcatttaatctctgtaaccattccaagcgttattattctcccctttctacagatatgaaaactgaggttcagaaagtttaaatcagggtcatggccttgtacaactacagggaacattatttactttgttttctatgtaaatggaaccttctggagcacaatgcagcagccttggtttaagtgactcccaatttcccagaactggtaaatgacaaattcaggaatcacctccaggcctgtctgaagccaaaagccccgttctgatcactacacaagcccctgcttcagaaatccatatgtgtgctcgcactctggagtcttatattgatgatgatgagttaagaagaaattcagttggctgttgtattagtccgttctcatgctgctataaagacatacctaagactggatacttaaaaaaaaaaaagcggtttaatcagctaataggttctgcgggctgtacaggcttctgcttctgcggaagcctcaggaaacttacaatcatgtcagaaggtaaagaggaagcaagcacatcttcacatggccagcagaagagagagagagagagaagtgggggggccagtgctacacactttcaaacaaccagatatgctgagaactctatcacaagagcagcagtggggaagtccgcccccatgattcaatcacttccctccaggcccctcctccaacactgggaattacaatttgacatgagacttgggtggggacgcaaagccaaaccatgttagctgttaagtggtgagcatgacttgaactcaagacaaatgcccaagaagactttattcgaactggttttctatttgtttagacaccaagtgttagcttcataaggtataatttttttaaactgtattttgaaataatttcaaacttagagaaaattcacaccaatagtaaggagctcccaaatacctgttacccaaatccaccaattattaacattttgctgcctttgctttctctctctctttctctctttctgtggtgtgtgtgtgtctgtgtgtgcatgcatatgtgtgtgtgtgtgtgtgtgtgtgtgtgtgtttgcgtatttgggaattacatcctgaatatatacatatatacacatacggaatttttagtgatccttgaggtgtgctccctatgaaccagcattgccttggtacttgttagaaatgcagattactcagtcccacctcagatgcactgaatcagaaactttagggggtggcatccagcaatctgtgttttaacagtcctccaggcgattctgaagctcacctatttgagaaccattgtcctattaaagaatacttcggagaagattgttctgagcaataggacaatactattattttaatatttaatattttacattaatgccattttctcataaaaggagagaagttgggaaaagctgggaagtgtaccttagtttttctggggggttgagcatgacataaaagaatcattcttagatttttcaccatgcctgaactaattcatataaagagactctataggctaagctaagttttaggacttagtgttctaattaaagatttaaatatgactttccaaattattgcctggaatggattcatttctgtgagcctaatccctttgcaagtgtctaaagcttgctctcacattcacacaaaaaacttacagaaatacaaatacagtcattatagagaagcttactgattatgtaaacagtcatgtccaccaaaattgtttaatataattttcagagggtgagagcctgaatatatcctttctagaaagctgcttaacaaggttgtcaaacattgaggtaactgacaaaatcatcaaccacgtaaaatttcattagtctttacaattacaaaatcaaatttctccctttaaataaatgctttggggttttataacatgcaaagtgaagactcccagcttcaaagtgtgcctgtgtgtattctcaagtgtagcctgtgtcccacaatagtggacatagttaccaataattatttctttctgtaacctgagtcagttgacagccatataaaatgggctgatcataactgtgtctagagggaaggggatacatttctaaaagaacactgaacaatatttctctgggattttaaagtctgggtaactctctatgaagtagtgtcttgggggagatttcttcttagttaacatgacaattaagtcaaattacaataaacaaatattcaaagtctagatgcttcatttatttaagtcaattttaaaaaatataagaagaagagaagcaactgggaggagggcagtctcttgaaatcttttgaaatgaagctaacttgtatttagaattgtgtggggaagagagaaggaggtttagtattcatttcctggggcttataagctgtggaatagtgacagtatgtttattctaaaacatcaaagatccctgtctcacaacatctcagacaacaaagatgggaaaacaaatgaaccaaggacacatcctaatatattctgcgatgtttactccccctacaggcaaatcaatcttttgaaaactgtctttaataatatccttgtaatttttacactgtttctttcttccagcagccctagccattatttataagtcttctaacttctgtctcgtactactctctatcccatgtagctctctctctttagcatttatttttatatttgtcaactcctttctcctctctcccaactgtaaacgccaaatccagcattggaaggaatgctctacatcaaatcacatttctgataaatgaacagtgaaaatttaacaatacgacttttatgacaatgtgatggcaagtgccctgaacttgggtgtccagaaacctgaactcgagtttgggtttggctactaattagtttgtaaccttgggttcgttgtccttgtctataaaataacatggttgaaggaaaatgaactagaaaatacccttgaccaactcaacttctatatcttttcacattatatttaatatctcaagtgctgcaaatctaagttcttttttttttctttttttttttgagaaggagtttcactcttgttgcccaggctggagtacattggcacaatctcagctcactgcaacctctgcctcccaggttcaagcgattctcctgcctcagcctcctgagtagctgggattacaggtgcaggccactacacctggctaatttctttttttggttttggttttttgtttgtttgtttgtttgtttgttttttggcatttttagtagagatgaggtttcaccatgttggccaggctggtctcaaactcctgacctcacatgatccacccacctcagcctcccaaggtgctgggattacaggcatgagccaccgtgcctggccttgcaaatgttaagttctaaaaaattaaatgaataagagttgaaaaggaaatcaacattgttaaagcaaaatataccagaaacagtgttgagttgatgtccctggatcatcttatgtgtataatctttacaacaactgtgcaagatgattggttttacctccatttgtatacatagaatttcacaggggggtaaataatttcccaagattgcatggttcaaaatggcaaatctgtcatttgaatgacttgggttttcgatcaaagagtttcgagtctatagttacaatttactcactaattggacttccacaaattgccctgggtgagtttgtctgtaagtatatgtgtttatacacatgtaatacttagtttggaaagtaggatcaagtgtttttagatagtgaggaaattaacgcagaagacaagtaacttggttaagtattaattttctggtagtagaatcaagaatgaaaggatttttaatttttatgggttcatagcaggtgtatatgtttatggggtatgaaatacttggacaccggcatgcaatgcatactcacatcatggaaaatgagatactcatccactcaagcgtttatcctctgtgttgcaaacaatccaatgattctctctcagttattttaaaatgtacaattaaactattttgactataaaatactaggtattattcattctttcacactattttttgtacccgttgtgctataaaatactaggtattattcattctctcaaactactttgtgtaaccattaaccattaccacctcctcctgaccccacactaccaggaaggacaggatttttcataaggcgattttggagtttcagaagtcagagttcacagtaggtattggagaagctacacagccataaacagtcttctaaggaaaatggcaaaatgcatactctgaattaagctttaaaaaaatcagatagggccaggcacagtggctcgtgcctgtaatcctagcgctttgggaggccgaggcaggcagatcacttgaagtaaggagttcaaaactaccctggccaacatggtgaaaccccatctgtactaaaaatattttttaaaaaattagccaggtgtggtggcaggtgcctgtaatcccagctacttgggaggctgaggcaggagaattgcttgaacctgggaggcagaggttgcagtgagccaagatcatgccactgcactccagcctgggtgacaaagcaagactctgtctcaaaaaaaaaaaaaaaaaaaaatcagatagttatttaaaaagttgcaaatgtttggtgtcatgtgagatgcctattgagggatgtgcgggtggcatccctgcctgagatcctcttctttaagagccatgcatatgtactgggatcatttaaaggagaaaatcttctattttttaagagtgtcagaagtgaagatttcacacctgccaacagaaggtgccgtcaaaaaaagacagtggagatggagctgctcctaatggaagactgtcagacaatgaaactcacctcccatttcccgtagacctctgtctttgctagacaatggaggttgccagttggtcaatcaagtaagcaaccccttgctactaagtcaaccagtcagtgttctattcctgcaggcaagagacatcctgggtaaaatgcccatagctagtaactcataggcattcaatatctgattatttaattaatactgcttttagaaatttaaaaataataactgcgaatgccaacagctttcgggctctgcagcaaaccagtggaggcatttgggactttctttttcaactgttctcattggggctgagactatcatcaagaagtaccaaataaacatattttcaaaaatcgatgttatttttagattctttggatccttgtttttggcattagcagcaggaagaaaccttgtgttttgaaacgtttcttttctaattgtgctgttacacacacagttggacaaaatgtctggtttcctttgagagagaaccatcagcataaacaaagatggtaaaacagcttctttcttttttgtcattattcctgttcactgaagagaaaggatggtctacctcagaggttacacactggtggcctgtggttagcatttagactggagatgtattttgtttgaccagcacactgttaaagcaagcaaacaaacaaacaaatgcaatttaaaaaaggcaaacaaaccctgatgttgaatgcctttacaggaggtctgatagtcatcaggcttttgcaatttctgtttcttgtatgactcttgtaggtattttattatgcagccctgggtctgcggagaacaatgtatgcacagccaattgtttttctctcataaagaagaatactgattgagtggtggtagagggtggttaagggagtcagcagaaacctgcaggtaatctacctaaaatcgtgactcctcccccaccgagtttccacctgcaactatattctttctgtagaagactttggctagacaggggttggagtccactttacaggacaggctactcccagggaggaggagctgtcacaggatgggtctgttgtaaggacattaattagaccatggtgctaggggatgatggacggggaggagcgaagctctgagcccactccaaggaagtttctctttgggtcctttgatcctttggttggtgcaatgaggtgagtctgcacagggcctctaaagggctcgttgctgcaggcttcaccaagcaggctttgttggcaacaggaaatattccccaaggtcagaggcggtgacttcatccacatttagaaatcagaaggtgagaattgactcaaatgcttgcggctttcctactcagttcaatattttggaatatgtacaaaatttctttctagaaagttcctcaaacttttagcacacagaatggctctaattcgctactaatccatcctttttaccacagatgtttacactcattttcttaggaccagagattccatcacatgtttttaatcccctgcccctgaccccataacactctccccaaacgcagagcaaggcaaaccatagggcctaataagtggttaatgggttgagttcattttcagttccttttatttcacacttataggttgggctataaaaaggtcaaacttcccttggtgatagcatattactactagtggttgaagctcagaaataataatagtctggattaactgtacattttcaaaccatagaaaccagctcaagtttgtggtcagggcttctatttatgcttcctttaaagagtgtgacaagggttagatgagttctggtcttaatccttttaattcaatgtgcacctgtccactgcaaggacacatgaagcatacagaccttctggattcaaatatggcagaaaggaaatggcccgggctcccttctggaacatcacacactgcagcatctcagccttccagagtgcctttattccattctcaaccctgggcccatagttgagaatcagaatgtactactttttgtttccttgtttgtttttaagacttcaaaacacacaagattttcataacaatgtctgtataccaggatattattttagggtataatttctgtaataatgtttgccaatagttgattgtctagactggataaatggagtgatatgcgatcatcccttgtattcacatatatttctactacattaccatctatgttgaaggtcctttaacagagacataagaaagaaaagtattgactgggcacggtggctcatacctgtaatcccagcaatttgggaggccgaggcaggtggattacctgaggtcaggagtttgagaccagcctgaccaacatggtgaaactccatctctactaaaaatacaaaaaaaaaaaatagcgaagcgtggtggtgggtgcctgtaatcccagctactagggaggctaacgcaggagaatcgcttgaatccaggaggtggaggttgcggtgagctgagattgcaccactgtactctagcctgggcgacagagtgagactctatctcaaaaaaaaaaaaggattatttgaacattatcacttcatgtaggcaaacttacaaaatttctaccaaatagtcctacatatttgaattaaacactctgaatgaaggtgattctgtttttaatgtttactccttcccctgggccagtaggtgatgagtatctctctgttcatgagtgactggggacagagctatcacgttattctgagtttttgaattttcatttatatgtccatgccttctcttcgtcatcatgcaggagatttactgacataaaaattattttgtagactctttattactgctgccgatgtgcctgctcctcacagagatatctaacattgatctcttcttcctgcctcttccatgatcaccttctcaagctgcctgaggacctccagggtcctagttcctctttggtcacctccttattagtgaggcctggggttctctcgtccacttgcatgctaggttcatgaccttactgatgacatttttctctctctcatattacacttgtaatgcactgggtattccatttctttagaagttctgactctggcaacagactcagtcctgctgtctcaggcatgagagggtctattgccctaaccccagtgtgatggttagttttatgtgtcaacttgactaggctaagggatgcccagatagctggtaaacattatttctgggtttgtctgtcatggtgttgtttctggaagagattagcatttgaatcataaactgagtagagaagacctaccctcatcaatgtgggcaataccatctaatctatccagggcccaaacagaacaaaaaggtgagagaagggaaaattcacactcttgaaatgtgaaggtatgatttactgaggaaatgcttcctggagacagggacattcatctcctgcccttggacatcagagctccaggttcttaagccttcagcctcagagacttctatgagcagcccctcagcttctcaggtctttggactcaggccgaattataccgctggctgtcctgggtctctcatttgcagatggcatatcatggacttctcagctttcataatcacatgagccactttccataacgaatattttcttgcatctctttattttgtaattttttattttttgagacaggatcccactctgtcacccaggctggagtgcagtggcacaatctcagctcacagcaacctctgcctcccaggctcaagcgattgtcccatctcagcctctcaagtagctgggaccacagtcatgcaccaccatctgtggctaattttttgtaaagatagggtttctccatgttgctcaggatggttttgaactcctggtctcaagtgatctgcccaccttggcctcccaaagtgctgggattacaagcatgagccaccacacccggcccatatctctttatatatatcccgttggttttgtttctctggagaattctgactgatacacccagcggcctaaataaggaaaaattagctttctaggtgagcaatgtttctttaccaaaatgtagtcaatagaacattgggcaattgggatgtaaatacacataatataaaacaaaaaagtaatgccctatgtgttaaaattagatttttggggccagccatggtagctgcctgtaatcctagcactttaggaggccaaggcaggcggattatttgaggtcaggagtttgatactagcctggccaatatggcaaaatcctgtctgtactaaaaaatacaaaaattagccgggcatagtggcatgcacctgaaattccagctactcaggaggctgaggcatgagaatcacttgagcccaggaggtggaggttgtggtgagctgagatcacaccactgcactccagcctgggtgacagagcaagactctgtatcaggaaaaaaaaaaaaaaaatcagatttttctatataaaggaagttttgggggtcttcattcatgaattcactttttgatgagagctttgggagacaccattgaaaccttcccagatcccactcccccttggttctctgtgcccacaccccagcttctgtgggctctgaagctaactacttgcagctttgccctctttcagagatttgactgtggctactgaagctactttgtccatttagagagttgaagtgcctgggagtttatgacccaccctagggtccctggtctctgccaccaatgatggacggatgttgtgggaggggacattcaaaatgccagctaaggccgggtacagtggctcatgcctgtattcccagcattttgggaggtcaaggcaggtaaatcacatgaggtcaggagttcgagaccagcctggccaacacggtgaaaccccgtctctacaaaaatacaaaaattagttggacatgatggcgggtgcctataatcccagctacccaggaggctgaggtgggacaattgcttgaacccgggaggtggaggttgcagtgagccgagatcaggccactgcactccagcctggacaacagagcgagactgcatgtcaaaaaacaaataaacaacaacaacaaaaaaaaccagctatgcctcagtgtgccccatgggatcaggctgagactgggactttctcctggcattgctcaattgcttggcttcttcctctactccaccctgcctccccactcccttagcagtttctccaggaagcacttccttaataaatcatatgcacccacatttttggttaagtgtctgctcctaagaaaaccccatctaagacaagcaccttctatgcaccaggcactgtgattgtgttccagtagaagaggccactatgaacaaattaaccaatatgattaatgtattttaaaatgctactgggcatcacgtttctctaatgaaacatatggtgtgtcagccaggagatggcatactcactttgggtaattcgagaatagttttgtaaaaatattgtttataaaggtatgggcaggatatagggaaatcacaaagaggagtgcaacgccccagcactagcaccagcagggtaccagaaacccctccagagagaagtcagcctgactgaagttacagcctttgatcaagagatggaaccagaacaaggtgacctggcagggggtccagggagaagaagggcagagtatgggtctgcgctggttaacaagcttttcagcacatatggtgtgtaattgccaaaagttacctgaatatagaaaataatttttatagaccacctactgacaactcatggaacactggtgttttgtaggattccatttaacactacaggagagccctgtctgaagatgatttccttaaggaacaaaacatctcaatctgagaactttttctgttacaaatatcccccatcccactgtctctgcccaagtaacagcctatttccatgcaacaaagccagcaccacattaaaataggaccactcttgatctcccttgtgtatggactctcaaaaagtcaaactcacagaagcgtagagtagaatggtggttgccagaggtcaagaatagttgagaggggtacaaagtttcagttagactggaggaataggttatggagatctattatacagcatggtgactataattaataacaatgcattgcatacttgaaaatggctaagagaatagattttaaatattctcaccacaaaaaaatagctatgtgggggtgatgaatatgttaaaccacttatttaattataccacaatatatacatacattaagacatcatgttgtatactgtaaaggtatgcaatttttatttgccaaaagtaaataaatagcttattaggaaaaaaaacatgaccattctatctaactcccactgccctgtcctggatcacccgccgcgatctccaggtgccgcattaccacttctcaccttgacatttgcacccttggttacagacatacacaaccttgactctggttgagattctcctccacttatgctgtcctgggcaatatccgcttagcattctgtttatccacacctgcagaactttttttctgaaacctcagtcctatgtagcacacggccctccccaccaccaggggacagcgcttccagcccagggagcagaaaccaggccaaggaggcaaagatgaaatcaggcaggggacggtggctcacgcctgtaatcccagcactttgggaggcctaggcgggcggatcacatgaggccaggagtttgagaccaacctggccaacataggaaaccttgtctctactaaaaatacaaaaattagctgggcgtggtggtgcacgcctgtaatcccagctaccccggaggcacaggcaggagaatcgtttgagcccaggaggcggaggtggtagtgagccaagatcgcaccaccgcactccagcctgggcaacaagagtgagactccgtctcaaaaaaaaagaaaagaaaggaaagaaaggaaagaaagaaagaaggaaagaaagaaagaaagaaagaaagaaagaaagaaagaaagaaagaaagaaagaaagaaagaaagaaggaaggaagaaggaagaaagaaagaaagaaagaaagaaagaaagaaagaaagaaagaaagaaagaaagaaagaaagaaagaaagaaaccagggctgcctccaaagctccccgctcacaggatcagctgcccgtcctagagaaatttctttttaacactttcattcttttaactctttcccactcactggataaggattacataggcactaaaaggcatgcgtgtatttagaaaagacatttcgtattttgcaaaggggagagcatttccagtattgacgggggtctgtttattctgttgataaattagaattatagcaagctttgttacctcacttctgatcccacagcaggttagaaggaaggaagaggtcaggagtggtgttagagactggcagcaagacaatgagggaaaaggtgaaaatggaaacagaaatgaaaacccagaaagcattgcaggctgcagggagttcgcatgcaggcttcatagtggaaaaaaaagtagaactgtgatcagatctcagcagcttctgagcatttacagctgtttttcatggggccggagccaattttttaaaaggaaaaatctgaatctctgagaaaatggttaatgtcggtcattgtactccaagcaggcagcaaagaatgcaatgcatttttaaaagacatacagccctaaaagaatgaatgagaattgactcgattctgcttttagggaatctttgagggagaggaggtaattcgtctttagcatctttcacgcaggccccgctggtctttgccggtctacaaagacctcctcctgccctccacaagagggcgccagaattcctaggacaggacccggtctgtggtcaagagacccgatgaaactcgacatgaccactagaggggggcagtgaggtccttaaactgcattctgagattccaatttgtatttgtttatgtcattttaaagatgctttcatctaagagacatgctttgtcctgtgtgcatgatgccagtgaaaaatgtgctcttcaaaccatgggagcacacttcagttcagcatttccatcgcatcagggctggtctgacgtaagcaggtgactttggcgggaggtggggggattggggggcagggagggggtgccaggtactctttacccagcagaaaaggcattttgttctgctcagtctatccacaacagtttgcaggaaacattaaacctattaaagtgtgccttgtttcaagaatgcatgtaggtcacgaacaactgctaaagatcgatccttgccacttctttttgagggaattggagttaatacagaatatccaaagataacaggaggaatcaagtcggggttgatgtgcccccaccccccacccccaagcaaatgaatcatctctcttccgaaggaaccgttccatccaatagcaccacctaaagacccttttggaagactgcggtatgctccactggagtgctctgaaaatagccctgtagtgattaacgtaaggacaagaatgattctgctgggatttgtttttcaagcaccctgtttttgtggccaagaacacattccttgaatggatacacttcaggttgttatatagacagtagtgggggattggagaaggtttaagatgtacttcaacatggaataataagcgatcatttttcaggggtccccaaccctcgggctgcagaccggtatgggtccgtggccttttaggaacagagctacacacaggagatgagtggtgggcgagcgagcgaagcttcatctgtatttacagccgctccccattgctggcattgccacctgagctccacctcctgttatatcagtagtgatgttagattctcatagaagtgcaaaccccattgtgaactgcgcatgcaagggatctcggttgcgtgctctttatgagaatctaactaatgcctgatgatctgtcactgtctcccgtcacccacccccccacccccgccccaccgccgatgacacggtctagttgcaggaaaacaagctcagggctcccacgaattctaaattatggtgagtcgtataattatttcattatattttacaatgtaataataagagaaacaaagtgtgcaataaatgtaatgcacttgaatcattccaaaaccatcccccacatcatccctggagaaattgtcttctatgaaaccagtccctggtgccaaaaatgttggggaccactcctttaaatgatgctgaggagtacattgacatagatggacagtcgcaatatgttgctaagtttaaaaaaataggttctaaaacagcatgaccccatttgtgtaatatatgtgtgtatacatacatttttaaaagtctgacagatatatcctaaaatgattattcctggatggtacaattataagtaatattaaatatttctcatttttccctccatttggtttatctgtattttcacattttatctacccaaccatgtattacatgtgtaatttttttttaagtttgccaacacatgcactttatatctttttttggtattaaaaaagacccagtcttggaacttttttacactattatcatacactaaaagaatttttaccattccacgttaataagataaacacaaattccttcaatatattattctcccattttatatatgtatatacagacttattaaataagcatttattagcactttaaagagttatttttaaggaagagatagagtgattcatctttttgattgctcgctttcatctaagccaaaatgatacatctatagaaacattatgggtgagaatcagagtacactccttttgttactacatatatatagtgtatatatagtaacaaaacatatactatatgtatgtatgtatactatactatgtactatacatatactgtatatttacatatgtttcttaaccttacttttactaataaaatttcttaaagggaaacctttgaaagaatcatacttgacttcaatcataacctaaagatgttctttcaggaaattctgggatgatgtatgggttgtcgtgaaaatgattctgaagccaattttagcagcactgaatctcttgtttttctgtaatcagtaagaggaatgcagcgattcttgagcttctcagcctgttctttgtctcacctgtgacactaaaatagtccatttttctaagtgctccagccttcccaaactcaattattaacagattaaatttctatgaatgtttaaaaacagttgaggtagataagagttgtgattctctgccattttccaaataataaatgtatattcactgctgcgttagtaagaaactattctgtattcataggcccttcaaacttttaaggaaatttagatttatctaaagcttagggtgtatagtcagaaaactttttttttaatactttaagttctgggatacatgtgcagaacgtgcaggtttgttacataggtatatacatgtcatggtggttttctggacacatcaacctgtcatctacattaggtatttctcctaatgctatccctcccctagccccccaccgcctgacaggccccagtgtgtgatgttcccttccctgtgggaaggatgtggccatgtgttctgattgttcagctcccatttatgagtgagaacatgcagtgtttggttttctgttcctatgttagtttcctgagaatgatggtttccagcttcatccatgtccctgcaaaggacatgaactcatccttttttatggctgcatagtattccatggtatatatgtgccacattttctttatccagtctatcatgaatgggcatttgggtcggtttcaagtctttgttattgtgaatagtgctgcaataaacatacgtgtgcatgtgtctttataatagaatgattcatactcctttgggtatgtacccagtaatgggattgctgggtcaaatggtatttccagttctagatccttgaagaatagcctcactgtcttccacaatggttgaactaatttacactcccaccaacagtgtaaaagcattcctatttctccacatcctctccagcatctgttgtttcctgactttttagtgatcaccattataactggtgtgagatggtatctcattgtggttttgacttgcatttctctaatgaccagtgatgatgagctttttttcatatatttgttggccatataaatgtcttcttttgagaagtgtctgttcatatcctttgcccactttttgatggggttgtttgtttgttttcttgtaaatttgtttaaattctttgtagattctggatattagccctttgtcagatggatagattacaaaaattttcttccattctgtaggttgcctgttcactctgatgatagatttttttttttttctgtgcaaaagctctttagtttaattagatcccatttgtcaattttggcttttgttgctattgcttttggtgttttagtcatgaagtctttgcttatgcctatgtcctgaatggtattgcctaggttttcttctagggttttcatggttttaggtcttacatttaagtctttaatccatcttgagttaatttttgtatgaggtgtaaggaagtggtccagtttcagttttctgcatatgggtagccagttttcccaacaccatgtattgaatatggaatcctttccccattgcttatttttgtcaggtctgtcaaagatcagatagttgtagatgtgtggcattatttctgaggcctctgttctgttccatttgtctatatctctgttttagtaccagtaccatgctgttttggttactgtagccttgtagtatagtttgaagtcaggcagcatgatacctccagctttgttctttttgcttagaattgtcttggctatacgggctcttttttggttccatttgaaatttaaagtagttttttcaaattctgtgaagaaagtcaatggtagcttgatggggttagcattgaatctataaattactttgggcagtatggccattttcactatattgacgcttcttatccatgagcatggaatgtttttccatctgtttgtgtcctctcttgtttgcctgagcagtggtttgtagttctccttgaagaggtccttcacatccctagtaagttgtattcctaggtattttattctctttgtagcaattgtgaatgggagttcactcgtgatttggctctctgtctattattggtgtataggaatgcttgtaatttttgcacatagattttgtatcctgagactttgctgaagttgcttatcagcttaaggagattttgggctgagacaatgagtttttctaaatatacagtcatgtcatctgcaaacagagacaacttgacttcctctctttctatctgaatacctttatctctttctcttgcctgattgccttggccagaactttcaatactatgttgaataggagtgagaaaggacaaccttttcttgtgccagttttcaaagggaatgcttccagcttttgcccattcagtatgatattggctgtgggtttgtcataaatagctcttattattttgagatacattccatcaatacctagtttattgagagtttttaacatgaaggggtgttgaattttatcgaaggccttttctgcatctattgagatattcatgtggtttttgtcattggttctgtttatgtgatggattacacttattgatttgagtatgtggaaccagccttgtatcccagggatgaagctgacttcatcatggtagataagctttttgatgtgctgctggattcggtttgccagtattttattgaagattttcatatcgatgttcatcagggaaattggcctgaaattttctttgtatgttgtgtctttgccaggttttggtatcaggatgacgttggcctcataaaatgagttatggaggattccctctttttctattgtttagaatagtttcagaaggaatggtaccatttcctctttgtacctctgatagaattcggctgtgaatccagctggtcctggggttttattggttggtaggctattaattacagcctcaatttcagaacttgttattgatttattcagggatttgacttcttcctggtttagtcttacgaaggtgtatgtgtctaggaatttatccatttcttctagattttctagtttatttgcacagaggtgtttatagtattctctgatggtagtttgtatttctgtgggaacagtggtgatatcccctttatcattttttattgtgtctatttgattcttctctcttttcttcttcattagtctggctagtagtctattttgttaatctttgcaaaaaatcagctcctggattcattaattttttgcagggtttttcatgtctctatctccttcagttctgctctgatcttagttatttcttgccttttgctagctttggaatttgtttgctcttgcttctctagttcttttaattgtgatattagggtgtcaattttatatctttcctgctttctccagtgggcacttagtgctataaatttccctctaaacactgctttagctgtgtcccagagattctggtatgttgtgtctttgttcttattggtttcaaagaacttatttatttctgccttcatttcgctatttacccagtagtcattcaggagcaggttgttcagctttcatgtagttttgcagttttgagtgagtttcttaatcctgaattctgatttgattgcacggtggtctgagagactgttacgatttccattcttttgcatttgttgaggagtattttacttccaattatgtggtcaattttagaataagcgtgatgtgctgagaagaatgtatattctgttgatttggggtggagagttctgtagatgtctgtagatgtctattagtcctgcttggtccagagctgagttcaagtcctgaatacccttgttaattttctgtctttttgatttgtctaatattgacagtggggtgttaaagtctcccacaattattgtgtgggagtctaagtctctttttaagactctaaggacttgctttatgaatctgggtcctcctgtattgggtgcatatatatttaggatagttagctctttttgttgcattgatccctttaccattaaataatgctcttctttgtctcttttgatctttgttcgtttaaagtctgttttatcagagaccaggattgcaaccccactctttttttgctttccatttccttggtaaatattcctccatccctttattttgagcctatgtgtgtctttgcacatgagatgggtctcctgaatacagcaccccaatgggtcttgactctttatccagtttgccagtctgtgtcttctaattggggcatttagctcatttacatttaaggttaatattgttatgtgtgaatttgatcctgtcattatgatgctagctgggttttttgcccattgtttgatgcagtttcttcatagtgtcgatggtctttacaatttagtatgtttttgcagtggctggtaccggtttttcctttccatatttagtgcttccttcaggagctctggtaaggcaggcctggtggtgacaaaatctctcagcatttgcttatctgtaaaggaatttatttctccttcacttatgaagctcagtttggctggatataaaattctggattgaaaactcttttctttaagaatgttgaatattggcccccactctctcctggcttgtagggtttctgcagaaaggtccactgttagtctgataggcttccctttctgggtaacctgacatttctctctggctgcccttaacattttttccttcatttcgaccttggtgaatctgacaattatgtgtcttggggttgctcttctcgaggagtatctttgtggtgttctctgtatttcctgaatttgaatgttggcctgtcttgctaggttggggacattctcctggataatatcctgaagaatgtttcccaacttggttccattctccctgtcactttcaggtacaccaatcgaacatagttttggtcttttcacatagtcccatatttcttagaggctttgtttgttccttttcattattttttctctaatcttgtcttcacgctttatttcattaagttggtcttccatctctgatgtcctttcttctgcttgatcgatttgactattgtgcttcacaaagttcttgtgccgtttttcagctccgtcagatcatttatgttcttctgtaaactggttattctagttagcaattcctctaagctttttttcaaggttcttagcttccttgcattgggttagaacatgcccctttagtttggagcagtttgttattacccaccttctgaagcctacttctgtcaattcatcaaactcattctctgtccagttttgttcccttgctggtgaggagttgtgatcctttggaggagaagaggcattctggtttttggaattttcagcctttttgcactggtttttcctcatctttgtggatttatctacctttttttttttattattatcctttaagttttagggtacatgtgcacattgtgcaggttagttacatatgtatacatgtgccatgctggtgcgctgcacccactaacttgtcatctagcattaggtatatctcccaatgctatccctccccactccccaaccccaccacagttcccagagtgtgatattccccttcctgtgtccatgtgatctcattgttcaattcccacctatgagtgagaatatgcggtgtttggttttttgttcttgcaatagtttactgagaatgatgatttccaatttcatccatgtccctacaaaggacaatgaactcatcttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcatttgaacaggcatcctacaaaatgggagaaaatttttgcaacctactcatctgacaagggctaatatccagaatctacaatgaactcaaacaaatttacaagaaaaaaacaaacaaccccatcaaaaagtgggcgaaggacatgaacagacacttctcaaaagaagacgtttatgcagccaaaaaacacatggatttatctacctttgatctttgatgttggtgacctttggatgggtttttgtgtggatgtcctttttgttgatgttcatgctattcctttctgtttgttagttttccttctaacagtcaggaccctctgctgcaggtctgctggagtttgctggggatccactccagaccgtgtttgcctggtatcaccaacagaggctgcaaaacagcaaagattgctgcctgttccttcctctggatgctttgtcccagaggggcacctgccagatgccagccagagctctcctgtatgaggtgtctgtcaatccctgctgggaggtgtctcccagccaggagtcacaggggtctgggacccacttgaggaggcagtctgtcccttagcagagcttgagcactgtgctgggagatccactgttctcttcagagccagcaggcaggaacctttaagtctgctgaagctgcgcccacagccaccccttcccccaggtgctctgtcccagggagatgggagttttatctacaagcccctgacggggctactgcctttctttcagagatgccctacccatagaggaggaatctagagaggcagtgtggctacagtggctttgccaagctgcagtcagctctgcccagtttgaacttcctggcagctttgtttacactgtgagggggaaaccacctactcaagcctcagtaatggcggatgcccctcccaccaccaagcttgagcatcccaggtcaacttcagactgctgtgctggcagcaagaatttcaagccattggatcttagcttgctgggctccatggcagtgggatccactaagctagaccacttggctccctggcttcagccccatctccaggggagtgaacagttctgtctctctggtgttccaggtgccactggggtatgaaaaaaaaaaaaaactcctgcagctagctcggtgcctgcccaaaatggctgcccagttttgtgtttgaaatctaaggccctggtgatttaggcacccgagggaatctcctggtctgtgggttgtgaagaccgtgggaaaagcatagtatctgggccgggatgcaccgtccctcatggcacagtccctcacagcttctattggctaggggagggagttccccaaccccttgcacttcccaggtgaggcgacgccccaccctgctttgactagccctccatgggctgcacccactgtctaacctgtcccaatgagatgagccgggtacctcagttgggaatgcagaaatcagctgccttctgcgttgagctcgctgggagctgtagaccagagctattcccattcggccatcttgccaaccactgcatgggctttatatcttttgcatttcaagggtttgtttaggtagaaccttctgatttttttttttttttttttttttgagacagagtttcactcttgtcgcccaggctggagtgcaacggtgcgatctcggctcactgcagcccctacctccagggttcaaatgattctttcctgcctcagacttccgagtagctgggactacaggcgtgtgccaccacgcccaagtagtttttgtatttttagtagagacagggtttcaccatgttggtcaggctggtctcgaactcctgacctcaggtgatctgcctgcctcagcctcccaaagtgctgggattacaggtgtgagccactgcacccggctgtcttctgatctttttaaacaggatgttctcatgatacgatttctatccatctgttcttaccctagattctcaaggctgaataaagaactggtcaggtggaattgctgctttcacgtaatcttgaacttctctgctttgcttttggaatgaaatgccgtggctccaaactgtccctggtcagggtcctccctcacagcattactccaaccatcttctctgtcccagcttattctatttctcaactcccaggcttaacctgcctagacctcttcctcatccttgatcatcctctgtgtgtggggggtcccaggcttttgctgagtttacctccaccacctggtgtgcctgctctttctggcctcacctggtaacatctccattcttccaggccacttcaaatgccccttcgtttggagcctttcctgaagcccaataggacatgagctctgcaatgtttgtaatgaaggagtaatgaagccagatgttgcctcacgtggttccctgcttttcctacaatgcagtttgagtcttttttagaaacagcgatcacctctgcaaacaaccagcaaccccactggtgcagtgggcatttataatgttgagtaacatagtttagccaaaaatacatacaataaagaagaactggcctcataccaacatatttcatgatgattcagagattattaagtggtgccaatttcaaaagcctatctgagcacacaatttcattgcagggttgtccaatcttttggcttcgctgggccacatcggaagaagaagaattgtcttgagccacctgtaaaatacacaaacactaatgatagctgatgagctaaaaaaaaaaaaaaaaaaaaaaaaatcgcaaaaaaatctcatgttttaagaaagtttacaaatttgtattgggccatattcaagccatcctgggtcacatgtggcctgtgggctgtggattggacaagcttgctctagagccatagacaaggtttgttggtggtgtaggacgacaagaaaaggtgacctgggccccatcacacgcagggccaagaggagcagctccactctgcaggccccacccccgccactcatgcaaatgaagctgtcctcaggcctagcaacttgccctctgccctcttcagcctcaatactatgctggcctctgtgctgtcctggccaatggagatggggacaaggggctccccagggcagctggaagtcagctcctgctagatcactactccctcccacccagctgatggggagaatctctggtggagccatccattttctggctctgtcttacagcccaaccagtgacattgccatcttctcccattttccaagctcctcccagccccctccccaggcgtcccctctgtcaggtagtgagggtctccttgggaggcaagcaaccagtaaggacagtcagggccacttctgggttggagggaggcagaccctgatccagagggagtcctgctcatgggtcctccaatgctgcatgtgattccccactctttccacagtgctcatgctgtgacccccacctggaacccccctaccttaatttcatcccaactcctacccatcctccaaggctggctgaggtctcacctaccctaggggcttcttgaccatttcccagccgcagagcatctgtctcctcgtactctcggctctggctttcatttatttagtctagagctaaagcacatgggctatagtcaggctgccgggacccaggctgtgtgaccctggacaacttacccacagtgtcctcagttttcgtatttgtaaaatgggaatactcattgtgcctaccttgtagggttattgtgaaaattaaatgaactgggccataggtccagctacatactaagaacttcatacatcttatcttttctctggatagcctgtatttttcaggtcagtttattgttatttaactttacatagtttacatattgtcttcttaatgagattagaggtcctctgagtgctataagtaagctgttgatggtgcctctttgtagtcttcacagcacctagccagtaacctacacacagtaggtgcttaatacttattgtttaaattcaatatagtgctagcagtgtcatgtggtctgcaaaatagatcataccaaaatgtaagtcatggatcagtataactcccaaaggcttctagtttcaggtagactttgctgcaacacaaaccagcctaaaacatggtggtctaaaaacagcaatgacgatttattatttctcatgattctgtgggttgactcgggagttctgttcatttgcaacatttagctggagggtcagtggggctggagggcccaagatgacctcactcatgtctagcccttggttctggctggtggctgggctccatggttcttcttcatgtgactgctcatgctccaatagactagactaggcttcttaatagcatggtggtgactcaggattttaaaagtgttacaatcaaaggtatattagcatccatgtctaggttctggaacttgctgtgtcacttttgtcatactctattgattaaagcaagtcacaaagctggccccagttcaaagaggtagtgaaatagatatcaccatttgaaggtaacacacccttggtaagaagtttggttagcttgtgagatgacaatcttcataaactttctatgtcatgctttacagttgaacagttgaacaaagttgctcacaagcatttgctatttgagcctcataacaactcaaaattcctctgaggcaggaaggagaggtatactatctttaaaatgtagagtagaaggctaaatttacacatgttcctcagactcatacagtcaattaatagaattgcactcatgcagcaatttcctttttttgctttgaaatatttcagtcctacaacaagtatagaaaaataatactcacacatgtatcttccacctcgcttaagaaataggatgttagcaattcactgaagcttcctgaacatcagtcaccaatcacatagcctccatttcactaactgctttctctaggataatagccatcttggatttggtgtctatcatgtccatgcataaagttacgcattttccacatgttttgttgttgttgagttgttttttgtttgtttgtttgtttttgtttgttttttgtttgttttaagacagagtcttgctctatcacccaggctggagtacagtggcaaaatatcggcttactgcagcctccacctcccaggttcaagtgatttttgtgcctcagcctcctgaatagcagggattacagatttgcaccaccatgctcggctaatttttgtatttttagtagagacaaagtttcagcttgttggctaggctggtctcgatctcctaacctcaagtgatctgcctgccttggcatcccaaagtgctaggattacaggcatgagccaccgtgcctggccttctttccacatatgtttttatccgtcagttacaactaccatatttcattgtttctaaggcacatttgttttttcacattttcatctctctgaagtcaggatgctctcatcattggtgacatcttccaaaagcagtcagccaggtggccgctgtatcacagccatcatggccgtacattctctggcatcacagggacaagaaacaaacttgcagaattggtgtcaacatgtgggaaaagattctggagacaatggcagggtactcttcttaccctgaggaaccaaatggctatgaggagggggtaggggaagaaggggtggcaaatcagaaatgttttagcaagattccagagcaggaacaaaaagtaggttagctgcacctaactgcaaaaatagcttgagagtacaatgccaatgactttgttcttttatagattcttttcaaaaatgctgtatcaccaatactcaatttgcatggaagttttattgtgccaaaaaacacagacaccaggaaagaattctaagaagtcagatgttaaatgtggaaaaatttatagaataccttaattgattatgttacttatattttcctcttttatgcatgtataagagtaatatatggtttaaaaaaactgtcaaatcagtgtggaattgtaagggacaagaaaacattttgtcagagtttaattctcagcattttttctgtcttaatggtgcacaaactaatagtctatctcataaactttatttttatttatttatttttttggagacagagtttcactcttgtcacccaggctggagtgcaacggtgccatcttggctcactgcaacctccacttcccttgttcaagcgatcctcctgcctcatcttcccaagtagctgggattacaggcacatgtcactgcacccagctattttttgtatttttagtagagacggggttttcccgtgtaggccaggctggtcttgaaatcctgacctcaggtgagccgcctacgttggcctcccaaagtgctggaattacaggtgtgagccagcccgcccagctatcttataagctttaggtaaatactgttaaattgtatctataattctgtaaaccacacttgtttgcctgacattatgtttttgaggtttttcaatttgctaaatctaggcctgcttcattcatcttaactactgtataacatcccattgtataaatataccatgttttatgtatcctttttatccattcccccatttatgggcatttagattgcttcaattttttttaatttcaaagaacgtagttatgggtatcttgtacagagctccttgtgaatagaatttctgaatcacaaataatacacatctttgacttaatagacattctcaaatcattctacaatgtgtcaaatttgcaatctgattattcctgtatgagaggtcctgatttcaagggcctcttcgttgaacttccatcctcctctctcctcttcattgaacttccatcctcctctctagttccctctaactcactcctttatatagcccaagtgaccactaaaatacacagcagatcaaatcacatcttagctttaaatctttccatggatttccactgtgatttccaacaagaccgcaatgactcactgggccctgaatttgctccagagcctcaactcttgctgtcactacatctgaccagacccaccctcaacattacaaccaatgcttcagaatcctcttagctccttttccataagagtcctttctctcaccctctgtatacaccattttctctccttggaatgctctttctattaaaacctctcctgtcccacctaagcccaaatttccctaattaactctattcaccatactatgtctaaacgtagtcacctcttttccctgggagccttctttggctcccactccccccacacccaccatcatcactggagtaagtacctttcccatatcctctgtagcatatttgacaggcactcccccatcacagcatcatcacacagttctaaaatcacctctttgctggttttactcccctactagactttgaagtccccaaattgaaaaggaggggaacagtgtctatcttgttcactgctgtattctcacccgatatgcagtttatacggcactcataaatactgtgtttgttggataaacaagtacatgaagcaagtcagcacttgaatctagatcatttgatctgaattctcatttcatccaagacaacttctcttcctaaaatagaaattactacacaagccatcatgaggaggaaatgccagagataaaatttggaattggggtgtcaaactataaaaattcctctaggtttgacggcaacttcaagccttataagtggtctcttgggtctaggcatgccatttatagcatgaggagggagagaaggaaggagtccactgggatggtcctgtttgcagccacctgtaatgcacagcttggtaatggaaagcacacctggagatgtttgagaagaaatcagccattcccaacataggatagaaacaaaatggaaaaggttaaagttaacatggagagattaaaaatcatttggaattatttcataaggatgtcctgtagttttttgacatatatgtattttaagacaagaaatgaatttgccaggtcctgacagctctctcttacatcaagaaaaatgaaaatatattttgtttctaaaatgcctacatcaactatgggtcttcagctgaatcatagtatactggatttaggaagccaacaacttccttctgagttaaacatcagagactggcatcccctaagtcagtggttcctaaactctagcatacatctgaatcaccaagagacttacaaaaacacaaattgctgccgccacacacctctgagagtttcttattcactcggtctgggtaaggcaggaaatatgcatttctaaaaagttcctagaatcattaaaaaaagatgaagtattaatacatgctacaacatggatgaacctccaaaacactatgctaagtgaaagaagccacatacataaagtcatagattgtgtgactcaatttatatgaaacacctagaacaggcaaatctgtagagatgaaaagtagattcatggtttccagaggccaaggtgagggggaaatggggactgactacttaatgtgtataggctttccttttggagtaatgaaaacattttgcaactagatagaggtgatggttgcataacactgaggatgtactaaacatgagtggattgttcactttgattgtatgttatgtgaattttacctcaacaacaaaaagtttctaggtaatgctgatatggtccagagaccacacttggagaagcattgactttagttacaagcacagagaagagacggaagtaagccaacttccaaaatggatggaagcctccacgtgtaatccagcaagcctgtctacagctgagaactcagaaaggctgaaataggctgttgcactggaaatcttcactctcaatttgggctcggaccaatagctggtagccacttccacattccaaattgaagtcctgaaccacccaagcaaaggacggggctgaatccagttgtactcatctcagctgaccaatcacctctggcttataaagaggactttaaggaatgagggaaagttggcaaatggacagataatttctttggatataggcgctggcattctgtgaggctgccctcatgccttggggaaggggtgagaattcttcccttttcacttcacatgtgcccatctacccatctctggatactgtttgcaggcctagggccattaatctttttaaagaacttgagaaggtgaagaccatttcatccccactgcaacatgtaaaaagagagatcacctggagccagaacaacaaagctttactctcagttctgcctctcactaattcactggcttgaccaattatttactttctctgagcctcagtttcctcatctggaaaatgggaataagagtgacttcttcatagggcttttgtgagaactaaacaagataacctttgaaagcactataatatgctttatgtatcatggttattatttgccacaattagaatgttgctctaccactgtacccactgatccagtgtgcctaaaaggctccaagggatgctcctcctcctgagaggtgcagccccctatcttttttcctataactactcatgaacgatggtatctacatgtgtcacaatgtaatatggatctgggtattattggaggaaaacctattctgcatagaagacaagaaaaacaaataggaagtatggataagtaggttgacacctgcaagacaagttagagcacaaagaagaggtaaatgctgaacatagaaaggagagaatggaatgactgagaggaacctattgtaaatgacacagtcaatatccatgaggcctcaaatcaacccaattgatgatggccattctggccttatatgtggtctgcccaagaagcgcatatgaaggccatagtgcttctcatcaggctgaagggtgagctacagctgccttcaggagtgcttattcctgtgtttcagcaaagggacaaatgtgtgtgttgctgactgtagacatctttcatatgcctctctcccttgcttacatatccactctgtacatacatacacaggacatggtggggaggctgatgcagcagagagagagaacaaatgaacattgctagcacagggtgcagacagtgggatcttccatccactgagatctttctctaagtgtattagcctactccacatgtctccttgcttctcactatgtgttttaaatggaatcaataaaccagctcattcaagtgttttactttgttctgggagactttctgttccctgtctttaagagagcttgcctggtgtgttttgtgaggctgccattacatcagggtagtttcccacatggcacactcctcatgcctttgcacacatggcctgtgccctctgcctggaatgccctttgttgggctcacaccatttactcttcgaaaccacaattgaatatcagtttttctgcaaagccttccctcatcctgtcccaactgtcaccccaccgtaaatgtctgccccttaatattttgtctccattgtaagacttatcacactggaccatacatgtgtgtcttctcatttttccctccttctgtatgccataatcagcttgagggaaggaaccaggtacaactcctgatgcacagtaggtgcatgcaagtatctatgccaaaagtgtctgcaaaaaggactgatgtatgacaactgatgcttataggacctcctactgagagagatggtaaaatcatttagagccaaaatttttcagtctgcttctagaagttaagccagaaaatatggatacattttattttcggaaactttccatggcaataaaacaccactgcaaagttagaagacatatgacaaacagggacattttgaaaattatatcacaaaaggttaatgttcctaatatgtaaagaagtactaaaaatagataagaaaaaaccaataatcctatagaaaagtagcgggcggggagggagtaacaagtagacagaccagataagaattgtcagtggtttgtaaacttattacaagatgttcaactttactcagaattaggaaaatgcaaattaaaactctttggggataatattttttacccaccagatgaacaagaatattaatgtttagcaaaatgctttatggcaaggttatggggaaactggcattctcatacattgctggaggaaatgccaaacattagaaacattacaggagggatcttgtagcatcttgtgcacactccttcaccctttgacctagtaaacacacttctagaaatctatcccaaagttacactgcaaaaacacaaaggcaaaaaaggtgtatgtggaaactattgttcattgcagttctattcataatggcaaaagaatggaaagacccaaatgcccaagtataaaaaattgtttgatgaagctagacaaatatactcaatacagtgctatacagttgtgaaaaagaataacaaatctctctgtgtaatctatgggatcatctccaagatatatcccttatatctggaatcccctcagagcaccttcttttgaaacaggcaagaataatcaaatctctcatacaacaaagtccaaataatactttcccctcagggagtggggcagagttctctatcccttaagtgtgggctgcagatggtgactttcttccaaagtgtacaatatggaaagaacagaaaaaagggaacattagcatggaaagatctgacagaatcgtacctcatccatgtgaccaaggtcaacatcaacagtgatcagtcatgttgatagtatgtgtccctgataagatgtggtgagaatggcattttccctctgtggccttcctcccaaaacccatattcccaatctatcaggaaaacatttgataagccccagtggagggacattatacaaaatacccgactagtacttctcaaaactgtgaaggtcaggccgggcacggtggctcacgcctgtaatcccagcactttgggaggccgaggcaggcagatcacctgaggtcaggagtttgagaccagcctgaccaacatggagaaaccccatctcttctaaaaatacaaaattatccgggcagggtggcgacctgtaatcccagctactcgggaggctgaggcaggagaatcgcttgaacccgggaggcggaggttgcggtgaactgagatcatgccatggccctccagcctgggcaacaagagcaaaactccatcagaacaaaaacaaaaacaaatgtcaaggtcatcaaaaccaaagaaagtctggaaactgtcacagttagaggagcctgaggagacaaggatgaccaaatgtaatgtggtatcatgggtgggatcttggaacagaaacagtgcattaggtaaacactaaggagccctgaatacagtaaggacttcaattagtaacagtgtataaatattggttcattagttgtgacaaatgtaccatactaataatgtaagatattaataaaagtggaaacttcatgaagtgtgtatggaaactctatctgttatctttgaaatgctctctaaatttaaaactatcctgaaacaaaaattggattctaaaaagtgtcacttttcaaacttggctatagctttaaaacaagcaaatacatacatagaaaaagggaacaatttaaattctattaacagtaagcttgttaaactatggcatactcatctgacacactgaaaaataaaaatgaggtaggtacaatgtgaaaggagttccataatatattaagggaaaaaaaatcaaggcacagaacattgtgcatagtaaaatccctcttgtataaataaataatttttaaaagataaaatatagatctatttttgtatgctgatatacacatgaaagattttccagaaagatactagaaaatatatttatatttttataaatataataaatatatgttacttctgagtttagaactggtgctacagggtggggagggcttttaacactttcatctaatgttgaactttgtgtgcgtgtattttaatttttaaaaatcatcatccttttggattacaactaatctagcttcaggattacatacagctaaaattgaagagaggatttgaaaggatctgcatctccatgctatactttttgagtgtttccaagaaacccagcctgatattaacctctgtcacattactccttttttttttttttttgagacagagtctcgctctgtcacccaggctggagtgcaatggttcaatcttggctcactgcagcctccgcctcccaggttcaagagaatctcctacctcagctcccccgagtagctgggactataggtgtgcaccacaatacctggctaatttttgtattcttttagtagagatgaggtttcaccatgttggccaggctggtcttgaactcctgacctcaggtgatccacctgcctcagcctcccaaagtgctgggattacaggtgtgagccaccgtgcccggccaacattacccatttttgatgattaatttatgtgtcaacttgactgggctaagggctgccaggatagctagctggtaaaatgttatttctgcatgtgtctgtgagggtgtttctggaacagattagcatttgaatcagcaaactgaatagagaagattatcttcaccactgtggttgggtatcatctagtccatggagggtccaaatagaacaaaaatgtgggaaaaaagcaaatttgctctcttcttgagctgagacatttatattctcccaccattggacatcagtgttcctggttctctggcctctggacacagactgggacttacaccaactgtaccccggttctcaggccttttgattcagactgattcagactaaagttacaccaccagcttttttggttgtctagcttgccgatgtcaaatcgtggaagtactcagcctccatagttatgttggccaactcttaccataaatacatatgtatacatatgtattctgttatatgtatatatgattctgtttctctggagaatcctaatataccattaaagcattaacattaattatcaattggatgccatcatcttagaaatctaagaggaatcttctgagaagttggatatgagagatctgcatactgatgagtgcatgcaaatgagcagtagggagactggcacatacggtggatgagcaaatgtttccaagggataggctgggttgaccgggggacacactagatcatgagttatttgataaggcagaggaggctacagatgcaggatgatgtgatttgaaggagacagaccacaagggaagggcctaatatttaccttaatagactattgagcagttttatctagcccagagattctcaactccggaggtacattagaatcacctggggaacctttttaaggctatgttcttcaacagcggaatagagaaacaaatcgtggcacatccatatggagtaacactcagcaataaaaatgaactatggacacgctgtatcaaccaaaccgatgaatctcaaatgcattatgttaagtgaaagaagcccgcactgaaaaactacatactacatgatttcattcccatgtcattctgcaaaagacaagactataggaaaagaaaacatatcaacagctgccaagagcttggggtgaaaggacagcttgactacaaaggggcataaaagaatttgggagagggcgtggacctgttctatgtggattgtaatagttacatgactgtacgcatatggcaaaatttacaaaactttaccctaaataagatgaattttattgcatgtaaattatactttaatacaaaaggccttcccccaaatattagaattcatttggtcttgggtggagcctagagattattttttaaaagctcctcagatggaaaatatctgcttcggtctaagatggagtatcagggaatggattttccgtcccacctgagtcaatcaaaaaaaaaaaaaaaaagaaaaagaaaaagaaaagcagagaaaatatatgaaacaatgggctttaagacactaaccatcaggcaaccaaggatggtgaaccctgcaatttggagggatggaatactgctctttatcttgattataggaattattccatgggtgtatatacatgttaaaacttagcaaattgtacattttatatgtgtagtttattgtacatcaattatgcatcattaaaggcattttctttaagttccccaggtgattccaaacataatagccagagttaagaaccatcagccccaacatataaccttacttggccctggaatccaacatcgtaagattctaatcatttgaactcaatgtaatgtgattgaagcatataaaatgttaaagtttattacaagtcatactttacttaaacagaactcattttaggaactaagttcacacttgcaggaatagtagtttttgacaatgattcttttgatagtgattgacatcactgctaaaaacaaaagacagacacagagagagaggctgggaccctaactggaaagatgtttaaatgttagaacaaaacacattaataccaacttctaggaaacttagaatatgcacaaaaagccttaaaattgttcataacatttaacccagaatttaaactaaggacataagaaaagagcacaagtgtgccacttcagcaatgctataatagcaggaacatgggaatctaaaacaacagcaaaaaagaagtggttacatgagttatagtatgtgagtaaaaagaatagtacaaggccatctaaaataatattgtataataatatctaatgatatcattagatacgatattagcccgaggctgcagcagcgcatccccgggcgcggcgcccaccaacactcacagtgcaagggcttggctccgagggggctgggagcccgggcgccctggagtgaggggggccaggagcgggctctggaggctgcagaggcgactctggagaggacggagcctcggcggggagcggatgttttgaagatgctttggctgccttggagatttggagatctgatgccacgatgaggactcacacacaggggtgctcccagtgtgtttttcatatatttgctttgcattgtgtcagcctacatcaccgacgagaacccagaagtcatgattcccttcaccaatgccagccacaacagccaccccatgctgtacttcagggcagaggtggcggagctgcagctcagggcggccagctggcaggagcacattgcagcccgcctcacggaggatgtgcacacgatgctgtgcagccccttggaatacctccctccctgggatcccaaggattacagtgcccgctagaacgaaatctatggaaacaacttgggtgtcttggcaatgttctgtgtgctgtatcctgaggacactgaagcccaagacatggccaaagtctacatggagaggatggcagtgcagcctatttggttggtgaaagatgctccttgggatgaggtcccgcttgctcactccctggttggttttgccactgcttatgacttcttgcacaactacctgagcaagacacaacagaagaagtttcttgaagtgattgccagtgcctcagggtatatgtatgaaaattcatacaggagaggacggggatttcaatacctgcacaatcatcagcccaccaactgcatggctttgctcacaggaagcctagtactgacgaatcaaggatatcttcaagaatcctgcttatggaccaaacaagttctgaccatcatggagaaatctctggtcttgctcagggagatgatggatggctccctctatgaaagagttgtgtatggaagctacaccactagatcactcttccaatacatgtttctcatccagaggcacttcatgttggccatccgtggcttaaacaacactttgcatttatgtatagaaccatcctgccagggtttcaaaggactgtggctattgaggactcaaattacaactgattttatggtccagaaagccaattagttttccttgataaatttatcatgcgtaacagcagtggtaactggctagctgaccaaatcagaaggaactgtgtggtggaaggtccaggaacactgtccaaagggcagcgccggtgcactctgcacacagaatttctctggtatgatgccagcttgaaatcagttcctcctccagactttggcacccctacgctgcattattttgaagactgggtgtcgtgacttgaagtgcactacctgctgaaatcaataaatctttcctctctttcaagtctggaaaaccggggggacatgcaatatgtgacattgtccacagaaacaaatacaaagattggatcaaaggatggagaaattttaggacagggcatgaacattatgatcaaaactcatttacttttgctcccagttgtgtgcctttcgttattgaggctctgtacaggccaaagtacaccttcttcaacaatgttttgatgttttccgcagctgtgtcgaagagctgcttttctccctggaagggtcaagtcacagaacactgttcatcaaaatggtctaaataccagcatgacctggcagctagctgtcaggggagagtggttgcagcagaggagaaaaatggggtggttttcatctgaggagaaggtgtgggagcttataacctccagctcaacctgaagaatgttcagaggaatctgatcctcctacatccacagctgcttctccttgtagaccaaatacacctgggagaggagagtcccctggagacagcagcgagcttcttccacaatgtggatgttccttttgaggagactgtggtagatggtgtccatggggctttcatcaggtagagaaatggtctctataaaaagtactggatggacaatactggctacggcaagaaagcaatatttgcatcagtgacatatcctgggagctatccctacaatgggacaaactatgtgaatgtcaccatgcacctctgaagtcccatcaccaggccagcttacctcttcatagggtcactatagatgttcagagcttcaccatccacagagactctcagcaactggatgtgttcatagccaccagagaacatgcctacgcaatgtacctgtggacaggtgaggccgcaggacagtctgcctttgcacaggtcattgctgatcatcacaaaattctgtttgaccagaattcagccatcaagagcagcattgtccctgaggtgaaggactatgctgctattgtggaacagaacctgcagcattttaagccagtgtttcagctggagaagcagatactctcctgagtccagaaccagctagctttaggaagactgctgaccggctgctgagattttcagataagagacaggctgaagaggccatcgacaggatttttgccgtaacacagcaacagcagcagcaaagcaagtcaaagaaaaaccgaagggcaggcgaatgctataaatctgtggatgctgtccctgatatttttgcacagattgaggtcaatgagaaaaagattagacagaaagctcagattcaggcacagaaagaactacccataaatgaagatgaagaaatgaaaaacctcttagattttgcagatataacatatgagaaacataaaaatggggcttgaggaaaggccgggttggacaggcatggatggtgacaactactcgtagcagggcctcatcactatctgcttcctataccagattgttcctcatcctgaacattgctattttctttgtcatgttggcaatacaactgactttttccagagggcccacaacctttttccagagggccaaagatgtctttatgcagttcttctaacagatagctgtattttattgtggttgtactcttcttgttcccaatcacagtgttagcactgaagctataagttgcctggtcattttgtgatcataaaagtccatgaaaaaaaaatttattaccccagtttatcagattttttccctcagattcattttaacaaattaagggaagatattttgacacaagaaagcaggaacatggagaaattggagcaggaaaggaatttatcaaggcaataggaatagcttggtggtcctatggtgtttccagaagtatttggcattgcaattgagcagtccaagtagtactacttttagaagaaacaaaaagtctgttttttaaagtaatgttttttcttatgagaaaaaggtttagatagaattgggttttattcatattaatttaatgctattagcaatttccatatactatattatggaaaagactgaagaacacaattctgagaaatattttaaaaattttaatggtatagtcatgttgaaagataaatgttggctgggtgcagtggctcacgcctgtaatctcagcactttgggaggctgaggcggagggatcacgaggtcaagagatggagaccatcctggccaacatggtgaaactctgtctctactaaaaatacaaaaattagctgggcatggtgacgcgtgcttgtaatcccagctactcgggaggctgaggcagaagactcgcttgaaccagggaggcagaggttgcagtgagccaagatcgcaccactgcactccagcctagcaacagagtgagaccctgtctcaaaaaaaaaaaaagctaaatgttgtaagtcctggtatgatggtgtcagcttccttggggaagtacttctttagttatgtagctaacgagatcttttactacagatctggatggctattcagataacatagcaaaaatgatagcagaagatcatcaaaaacttaaaatatattttattagaaaacatgtatctatgaatgagtatttccttgatgctagtctctgcacacatataatttgttacttgtatgcattcattggttgttcagtatgtaagacaattacaaataacttaatactgtattttccttgtatggaaaactgttgtagacccaatgactaaaactttcaaaataaaatattttctattatgaaaaaaaaagaatatctaatgacaagagaaattctgttagataagttgcttttggctataagtaacagaaaaatttaaacagcataaacaatatagctatttattttaccatctgtcaagatgtccagtttgggaatggttgcaacatcggttaattcagaagtttaacaaaggaatagcagtcctggttctgatcttgttcatcagctgatcttgttcatcaagcttgctcccccatcccccatgtttgcaaattggctgccattgtttcagatacattcagacaatacccagacttgaaaacggaagtttcttcctacaagtcatttttttttaaagagcaaagaaacttttcccagacattccctaaggacttccctgatgtctctttggccaaaataatgtcacatgcttactcccaagtccatcactgacaaggtgaaaggaatgattaagaatgacctagaccaattaagtttcattccctcaggctggagaaggttccagctttccctacagcacatggctgtcctatgtctcaacaaaatcagggttggctcacaaaccagaatggagagaattggctgttaactagactaccgtcaggtaacacaacagtaaatgcaacatatttccatttgtataaagaaaagtgaatatagataggtctataaagaataaaagcctatgcatattttaaaatattattcatgttgttgggattatagaaaatatttatttttcttgtttctgcttttctttttttcctaaatgttctgcaatgaatatgtaatatatttgaagtctatttgtgccctccccccaccaaaaatatatccaagaaaggttactttaaaataaaacatttatagtccttgccaggtctttttttttttttcttttaaagtaagtattaagagcagttatgtaaaatcaaactcagaggtttcattcagttgaggctagaatgtgtctgatgcagcctccaaagacatggagcctcctgcactcgcatgagtcccaggaccctgaggccccacggagatgtcagcaattttatcccaggggctactcttgctgcttagaagacgatgtcctgtgacttatcttcccaaactggaaggttggacagtacaaaccagattctaaaccagttctcagtgtcaaggccaagaagatatcagacctgtctagggaacagggttacactgagactttcggttccaccacaagcaggaagacagagctggaggaatgaaaacagaaggcacagcaaaaaagacaattaaagagcagcgaagtcactctatgcctctagacacatgtccaataacttggcataaaagcacatgcattttgtgaccaagttggactggaattctgtcctggtgtactctgcatgtcacctgtagacacttctcagcctgtacccgggattcaaaaagttgagggcgatcaagaatgaggaaagatatttctgcagccaaagcagggacagtccacattcactcagcaaatctctgaccctctgcatgaaaccccagtggccacctccagcccagtcctggcgacacagagcaggcagtgccctcaaggagatgagagacgcaacccaagtggaaaagactcgagctttagagcaacacagacctcagctccaatcggacgtcaccaattgctagttgtgcaaacttcggcaagccacttcaccaccctgtgcctcagtttcttcacgtgtaaaatgagaataaggctttttaagtattcatcgagttcgcttatgcaaagtgtgacgaacctcagctcagcataattgagtgaagaagctggaagggcagtaatggcctccaaatgcacctccaacagccacccaggaaatcccgcccttgctttcgcctcagactctgggcacaaaaattaatcaagagctctgaggccggaaatctggagctgtcagattcactcttctggattgaacttttaatggaggtggatcactggggcttgctcttgccagataaataaatggtactttaaaaattatacccagctaacaaaacctgctcacagccacaccactggtgctggggaagcgagctctgactccgaagaacaaatcacgcctgaggggcctgagtggagaaagtaaggttaaatcactggaaccacgtatccatctgcaacggactgtgtgggtggtgtgcatgaaaagaacagagaagaaggtaggagaagctgcaggaggcagaaactggaggggaggctctgtctttggagtagctgccactttgatatctctctttttttggaaatgctctctgctgctacttgtttgggagtttagcacagctagagaaatggctcatgaagcttgaggtgaggtggagatgaattccctctaatgaaaatccctgagccatcaaagtgcttcattagttccacacaagacctctaaggtgcgcaatggacatacggggctcttcagtgaaaagattattccccgtgtgctcatctggacactaaattctggtttaatcactattaaaactgtcctgagagaaaaaatggggcatgtgaaaatgagaacactcaaggtcatatttatccacattgtttagagtgaaaagtgtagctcatacaaagcttgcctggctactgaaaccacttcattgaaaaaaaaaaggccaataaatatgtccaagcctttgtacttccatttttgtaatctaaaatgttttggtttgttttagtattttatctaagaaaaagaatgtgtttggggccaggagcagtgcctcatgcctgcaattccagcactttgggaggccgaggcgggcagatcgcctgaggtcaggagttctagaccagcctggccagcatggtgaaaccctgtctctactaaaaatacaaaaattagccaggcatggtggcacatgcctgtaattccagctacttgggaggctgaggcaggggaattgctggaacctggaaggcggaggttgcagggagccaagattgtgccactgcactccagcctgggtgacagagcgatactctccgtctgaaaaaaaaaaaaaaaaaagcaaataaaaagaatgtgtttgtaaactttcaagatattttacaagtttgtgttttgatgatagtgaattagtgatatctaatatcatcacttgataatagtgatggtggtacaatagccagagagttcaaaccttctgcttgcgaattgggaaactgagacccagagagatgaaaggacttactcaggacacagaaattgccactggctgacctaggtctggagcccagggctttgtgtaaatatataaatatttatggatttaggtatgtacttattaatttttaaatagtaactaaccttcatctcacagtgagtacatgtccatattttaaagagtcaaacagcactatgtggtttataacagaaaacagtggtctcaaaccctaaatgcaggcaactgctttcaaatctgtcccatgcttcctctgacacatgcctccctttttttattattattattttttgagatggagtctcgctctgttgcccaggctggagtgcagtggtgcgatcccagctaatttttcatatttttagtagagacggggtttggccatgttggccaggctggtctcgaactcgggacctcaggggatccacctgcttcagcctcccaaagttctgggattacaggtgtgagctatcatgcatggctgcctctgagaagtgacagcgtgctggcagtcctcacagccctcgctcgctcttggtgccacctctgcctgggctcccactttggcagcacttgaggagcccttcagctcaccgctgcactgtgggagcccctttctgggctggccaaggccggagccggctccctcagcttgcagggaggtgtggagggaaaggcgcgagtgggaaccggggctgcccgcggcgcttgcgggccagctggagttccgggtgggcgtgggcttggcgggccccacactcggagcagcccgccggccctgccagccctgggcaatgaggggctcagcacccggaccagcggctgcggagggtgtactgggtcccccagcagtgccagcccaccggcgctgcgctggatttctcgccgggccttagctgccttcccgcggggcagggcttgggacctgcagcccgccaggcctgagcctcccaccccctccgtgggctcctgtgcggcccaagcctccccgatgagcgcggccccctgctccacggcgcccagtcccatcgaccacccaagggctgaggagtgcaggcgcacggcgcaggactggcaggcagctccacctgcagccctggtgccggatccactgggtgaagccagctgggctcctgagtctggtggggacatggagaacctttatgtctagctcagggattctaaatacaccaattggcactctgtatctagctcaaggtttgtaaacacaccaatcagcaccctgtgtctagctcagggtttgtgaatgcaccaatggacactctgtatctagctactctggtggggccttggagaacctttgtgtggacactctgtatctagctaatctggtggggacgtggagaacctttatgtccagctcagggattgtaaacgcaccaatcagcgccctgtcaaaacagaccactggctctaccaatcagcaggatgtgggtggggccagataagagaacaaaagcaggctgcccgagccggcagtggcaacccgctctggtccccttctacagtgtggaagctttgttctttcgctctttgcaataaatcttgctgctgatcacactttgggtccacactgcctttatgagctgtagccagctcataaagccagcttcaactcctgaagccagcaagaccacgaacccaccagaaggaagaaactccgaacacatccgaacatcagaaggaacaaactcctaacacgccgcctttaagaactgttaacactcaccgcgagggttggcggcttcattcttgaagtcagtgagaccaagcacccaccaattccggacacacctccatattttaaaataacctactgatagtagatttcttgttgttaccacttttaggcataatctattgatatcctaatttgaaaaacgaagagttatcctctcctgacttctcctcctctgttctacctatatttggcaattatttttaaatttctgattcaatcagtaattagtaaataaattattacaaccctgcacatcttctctgctgagtctattatgacttcatttttttctttttgaatttttttcttgtttatggagttagtaattgccttatgtatatattttttcttttgcttagtcgtgcactgtcatgaattctcaaactctccagtagaatgtactctccctctcagcactattttccgtatatgtctggttccctagcagttttacactgttcctgattatgtctccctttgagtccggttctcctgctgcagactagccagttacttacaaggctctgcccagacttcaagctgggaaaatccttcacaggaatcccctctgtcttaggttggattctcctgtttcctagaccacatgtattcttcttggacaaataattcattcattttggtgaagtactgccagagaaaagattcatagcatacaaatttttgtgaaaatgacggcattctaccctcatattcaattgatagtttggctaggtatagacttttctacctaattgatagtttagctgtgtctaaacttttccttcagaagtttgaaggctttgccccttggatagatatctagctgccaatgttgcatttgggaattttgatgtcattctgattcccatttttttaaatataatatgtttctagaatgttctctttatccctttggagaggaaaaatgtattgaatatttattatgtattagacctattcaaagctatgcacttatcttgacagtccttacaaaaaaaaaaaaagtgaaaattacttttcctctttttcaataatagaattgaaactcagggagggtatgtaatctgcctgatgcatggggcctgtcactgtaggttatgctgtagtgacaaccctaaaacctcagaaaacttgctcatgcatattatatgtttgacatgagttattagcggtctcagcttatcaaagtcactcagggacgctagttctggaggttctaacaacatgtgcatccatgctcaatgctgcagggaaaaggaaacacggcaagtcacttaatcatcgtcaaagtttctgcctgaaagtaacacaggccactcctttccatgtccaattgcctaaaccctgtgacatgggcacacataactttaaaggcagtggtagtatttccatgagggaattccttcctggcagttttctgtaaatgtatatgtttttccaaattccaagtcccagtgaaatttagtcgacaaggtgggaaaacagaaaacgagtattatgattcttccataagaattaaagcataggaattaacatagacatgttactcatgttgattcgaaaagcaagaccaaaaaatgctaatggggaaaatcaaaggttaaggtcaacatttctgggaaccaggataggaggagggactagagaagtgagaatcatctaatcagtcttgtttgtagcattgttatattgtaagtgtgtattcatggctttgcctgctgggtgactcattcttgcaaataaagtaaacatcagtaagtttgtatgtgtagtgtacttcatacaaatcctatgagtgatgttctaagaaaccagttttgaaaacaaatgtccttaaattggcagtttcaatgcatggttctatttagtgctgttaactttgctaagggatctgaatgtcatattatttgaatacaacccagtaatgttgactggtgtttttcagtttttgaatattccctctaggctacagttctttgtaaatattttaactgaagaaatgcaaggagcagatgatatgaatgttgtggaagactccgacaggaaatcagagactgtacaaaaacctgaattagcaaaagcaatatcaatttcaatggcaaaatcaaaaccagaactagcagacaagaaaagcaaatatttttattttcattattaaaaaaacaaataacttacatgaagtaataggtgttctaaaactcagcttgaagatgcttttgtatgcaatcctcacaattgaacaaatgtccatgcaaggcaggaaattggctaggcaaataattctttgtgggttctacattttcattttaataatgataacttatagaagtatttgtggtaatatatttcattttagtaataatttttacttgctatttatcttatgttattatctccatcttttaatattttctagtatcagatgtctatatgaagaagattatttttacatgttactgaaacatatattcttgttggaataaatcagttcacagtaataatacgccatccatttattattatgtcatttctaatagaaaacttctgatagcataaccctatcacagaaaaatgacttagtattcacaattatggccgctcattattatacaaatacatgtaaaaaaagattatgaaaaatgaataatttatgacttcagggttcctgagaactaaaaatcctgacttgttccccaatcccaaagacctatgcctcttggaaatttgaaaatactaagcagtgcaagatataatactaccaaatgcctgaaatgaccacagccataaatatttatttggtgaatagtactaagtacaacccaaatagtcgtgccagaatccaaatccaggtttcttattccagaactcatgttctgtcttctactcaaacttcctctattgtcactaattgtgtattagtatttatttgctcattagattattccaggattcattcatttatccaacaagtatttgctaaaccccatgtgtataggaatcacattggtctcacacagtgatgttcataattatttattgaatacctgactaccagacactaaaggtattatagagcatgaaacagtagtcctaaaagaatgaggcacaggacactttcgattgggaatagaaggtaaaatctagaaaacagtgggacaattgggatctagagtgtggtagatggtcgggcgcggtggctcatgcctgtaatcccagcactttgggaggccgaggtaggtggatcacctgcagtcaggagttccagaccagcctggccaacatagggaaaccctatctctactaaaaatacaaaaattagccatgtgtggtattaggcgcctgtaatcccagctactcaggaggctgaagcagaagaatggctagaacgtgagaggtggaggttgcagtgagccaagatcatgcctgggagatagagagagacactgtcaaaaaaaaaaaaaaaaaaagaaaagaaaagaaaagaaaagaaaagaaaaaagaaaaagaaaaagaaaagtgtggtagatggcttctgaagtcacacctagcaatgtaaatgtgaggaaggaaggaaggaagggagggagggagggagggagggagggagggagggagggaaggtcctaaaatgaaggaggtgggcttctaggagaaagatgagagcttgctgagacatacaacacactgagtaggaacatggtctttgacatctgatagtgctgcttttaattcctaattttttgggccaggcacggtaactcacgcctgtaattccagcactttgggaggctaaggtaggaggactgcttgagcctaggagttcaagagcagtctgagcaatacagtgagatttcattgctacaaaaaaaaaattaattttaaaaatccaaatcttgtgatcttaatcaagttgctgaagtgctctgtgcctcagttttctcatttgcaaaatgggaacaaaataattaattttaaagcttattgtatgagttaaatataaagaaaactcttaatatagtacctgggacacagtaaatactcagtaagaggtagctattaatcatactttatcgttctgcctagctctcaacattcttgaggatttttaaacatttataagaaatgtgccttacagatttttaaaagtttcttcaatggacgaagagttctggcctaaggagagaatatttaaaatgtagtctgactttttggagagaaaaagtagccaagatctcatatttctctgcatgtttgtcccaaaaccactaatatagcataaaaacagaggaatgtgcttgctctgagatttgggatgcacatgctagtcagaaagagtaaacaaataggccaggcgcagtggctcacgcctgtaatcccagcactttgggaggccaaggcgggtggatcgcctgaggtcaggagttcgagaccagcctggccaacattgtgaaaccccgtctctactaaaaatacaaaaattggccaggcatggtggtaggcgcttataatcccagctacttgggaggctgagtcaggagaatcacttgaacctggcaggcagaggttgcagtgagcccagattgcaccacttcactctagcctgggcaaaagagtgaaactctgtcatatccaatgtgtttgcaatatcttttctctcaagatataataaatgtgggctgggcgcagtggctcatgcctgtaatcccaacactttgggaggctggggcagatggatcgcctgaggtcgggagttcaagaccagcctggccagcatggtaaaaccccgtctctactaaaaatacaaaaattagctgggcgtggtggcagccacctgtaatcccagctactcgggagtctgaggcaggagaatcacttgaacccgagaggtggaggttgcagtgagctgagactgtgccattacaatccagcctaggcaacagagcaagactccatctcaaaaaaataaaagatagaataaatgtggtagccattcttattcaagcccgttgtgagatcatggtgcatcccatgtttgcttatctttttcaatggcttcacctgtcctgaagaacaaactgttcaaggtacttctcttccaactaagaagaggatccacagcttgggggcagctttatccagttagagtcctggaaatgaccaagtcaagattgcttccatgatttcccaagagatgattactttgtatgcctacaaaacacattccagacatatgtcagcttgtgcccagcttgatctgtctggccagaaacgaggcaagaaagaggtgccatcgtggaaatttccctccaactctgtgttgtagggaccttgtacaccatgttagagaatttagacttaccactttaaccaatggtccttaaagcaatggagagctaccaaagggcttaatgggggttaggtttgggaggacatgatcagatttatacttcagaaaggtcactctggctgaagtgagaagaatggattgcagcacagaaaaccttagaggcaggaggagaggcaggaggagaggcagaaggctattgcagaagaccgagtgagaggtgaaggtagcctagaccaggtggtggtgatagagatggagaaagggggacaaattcttggagatgtttggaaagtctcatcacacaggatttagttgttgattagatgtggagaagggggaagaggaaggagtaacagaatgctgctcagatttttggctggggcatctgagtaaatggcagtgaattcactgaaattggaatgctggtgtaagcacaggttggtaggagtcagcaagttcagtttaggacatgctcatttagagcaacccatggaacctccaagtggagatgcaggtcgtcagctctctgattctcagtgtagggctctctttgcttctccatagctgctttatcccccaggaacatctcagacttgaggatggaggggaggagatgctatcagggatctttagtcatagctggcatatatgggcccagatggtttggctgggggatcccttttggtgttaggggggataatgtgtgggggtggggagtgcagcgaggaaaccttgatatgaaaatattctcatttccaaaagcactgatccactataacaatattgtaattgattcaggcaagggccatggatggatgctaaaacaagtttgtttgtaaacaagctatttacccagtctaaaattatcctcctgaagattattaccacaaaggaaaaatgttttagagtgaagaaatctgggtgacaccaccagtacctccccatagattatttattctaaagagggagagattccccagaagtggagcagtcacacggatactactttaaccacatgatcaaagttaccttcaccaccaatggggcaaactgacatcaggtgccccctaatgtgacacactgagaaggacacagtgtgtgcataatttgaatctcacaccagacaaatcccagagatatgttacagaaaaataggcctgcactcttcaaaaatgctggtgtcttaaaagacaaaaattgggagccttttcattctcaaataaaagagactaaagaagcaactggcttcttagacaactggctgggtgcggtggctcaagtctgtaatccccacactttgggaggccgaggtgggcagatcacgagatcaggagatggagaccatcctggctaacacggtgaaaccccgtctctactaaaaatacaaaaaactagctgggcgtggtggtgggcgcctgtagctacttgggaggctgaggcaggagaatggcgtgaacccgggaggcggagcttgcagtgagccgagatagcacactgcactccagcctgggcaacagagcaagactccgtctcaaaaaaaaaaaaaaaaaaaaaaaaaagcatgacaactatgtagaaatacaaagtcctgggttgggaaaacatgttataaaccccaatattggaaagactggcaaaacttggatatgattgtattcagtaagagattcaaagctgtgttaaatttcctaaatttgatcattgcactatgtctttgtttttaggagacacttgccaatgtgtttaggtgggaaaggtcatgatatctgcaacttatctcaaatagttcctaacaataataataataataaatgtacatatagagaaagcaaatatagcaaaatgtcaataactggtgaatgtaggtgagagtatacaggggtttgacatattctttttgcaacttttctaggagttatatattttttttcaaaaggaaaagaagcacaagccgagggagttctaaacattgaagactctaaccagtgtttttttttaaggtcaaatattttaatattattttttctagccactaaattccatcttaatgaaatgtcaaaataggaaacaggtgaaggagtaatttcctgcactgccaggctcctaagaatgtacagtattagcttcaatttcaaacctgcagtgtttagaaaggaatttgttttcttttaaatccaggtaccaaagttgaaagccccgaatgctcacagagcagctggaacaagaattactgcctgcaggcgcttctgtccaccagccacgtgtcagtgagtggccctggacccagccaggttgtgtgtgcacctgcggttcttgccatggggagcaggagccatttggctgctcctcttcatagggcaccacctgcaatctttcactgcccaggtaagcagagcataggaagtcagggaatcagagcactgaatggatcttggaaagcacccagtccaactctccccaccttcccatctgtggcattaatcacctctataacgttgtaaccaactggtcaaccagcctctatttgaacatagccagtggctaaaacgtctaagcagctcatccatttttgaatagcttaaattgtttgaatatcctttctcttaagaataagtatcagtacaaaatgcctacttccgttttgtaggtatctggtaaatttttttcaataaaaaaagtcaagtcagattaactaaaattgtggaacaacttgaatatttgcagtcaataactaaagtcatatatttcagatccttcagcagggcatctctgtaaaataacatttggaaatcacagaaatttactcttaaagggcctttcttgttcattacattctgagatatacccattttatggccatatatttgaaaacagacaaaaatacaggaaatttatagggacacgtagtaggcatatgtatatgtatggatagcacgtttacatgtgcatagataggggacatgggaggatagatatcaagggtattcctagggagtgggagtgggtaaaggaaaagaggcttttactctccaccttagacattttgttattgtttgattttattttttataaagagtatgttgctatttctatcacttaaaaccattttctcaaaaatttacaaaacaacaatagagagaaatcacttacattgagctgaaatctgattgcccagagtttccattttctactgcactctggacaacttaagataagcccactccttcttgcacatagcagcgagtcagctgtctgatgccagtccttgaggcctccatatttctcttctccaagataaatgttcccatttccttcagctgtctctcagttggcaggaattcaagtcttcttgacttcttatcactgcccacctcccactgaagtagagcatatcaggtgggctcagagaaaaacccattcagaagttcaggtggcagttggtcatctattgaaaattagcgagtccatggttctttgtgttcttgcaccaacttggcctaactttttggggtctcaggtgctgtattaaaggtgctctatttcatgcatcagtgatggatgaaagcaggtctgcaggacacacatgcagttataatcagaacaccatggcgagctttcccaacacttataaaacctggctgatatatcaatgccaactcagcacaagaacagcaaggaaaatgtataaagggaatagtaggaaaatatgttcccctggcaatcagaagaattaacaatggtatagcgaagatatgcatgttatggcagcacatgaccaagataagagcacatagcaaagcggtcaagaggatcagctcttccacatatttgctgtgtgacttgggaaggtttcttaaccactctgtgccacagtttcattatctgtaaaatggggataatagtggtccctacttgatacagctaacacaaggtttaaatgagctgttcctttaaaagtgtctctggcacataagatacgctacataagtgtctaacaaacaaaaaacaaatgaggtgactttgatttcatggtttctgactggaatggtcagaggaaataatgtgaacaagaggtgtgcaaatggacctgcttggcaaatttgaggactaaactgtgctctgtttaggaaacataacaaagaatacagttctatcggctgaagcattccacctgttgcaaacacagaggaaactgtcctttcatagattagtgctttggacacctgcctgcctgccatttcttccttgtcaaaaaaggttaaaatagaccaacctcattagtaccaggaacatatgaatatgttaaacggttggtacaatgactcctattcaaaagtacaatgactgagagggaaacaactaccactcctagttattgccattccttcatttacatggggccccatggagtttatttagggcatacaattgaagtacatttctctataactttctcctgcaatggatcagcaaattttatttttttttctttttgagacagagtcttgctctgtcacccaggctggagtgcagtggcgtgatctcggctcactgcaagctccacctcctgggttcatgtcattctcctgcctcagcctcctgagtagctgggactataggcacccgccaccatgcccggctaatttttttgtatttttagtagagacggggtttcaccgtgttagccaggatggtctcgaactcctgacctcataatccgcctgtcttggcctcccaaattgctgggattacaggcatgagccaccacacccggcccctggatcagcaacttttgtacatgaggcagactggatgttcggcagagccagagttcatactatgctgaacatgtcagtaaaatacaaattatctttgaactgggctttttctaattccaagttcttctcccactttctttagctttacctgtgttctaattcaaatccctgagagtgtaatgaccttcacccagactatgggtcactaagaatgttcagtgtaggatgttgatcttgatgtattgaaaatggcactggttctgctaattgttggtgggggactcctctggaaaaacatcttgcattactgagcacatttcttcatcaatctttatgaaatctaccatttctcctatacagtcattctgagtatcaaatggtattggtaaaaacactttttggacaccaaacctggaattgcaaactcgaatgtctgtggtggccagagaggtaacataaacatgtgattagcggcaagtgtaacatgatagagagtggtggtgactgttgacaaagtgggaagtgtatgtccagcctaaagacattcaaattcaagggttgaaaaaagtgatactggtgaaacaatattgcctaatgtcagattagttcatggacgagatttgacctacaaaacacctgcttgcaactctcggaaataaagagcaatatggtatggtagtggggaagaaaatagattttggagttaaactggcctatgttgaaactggtggtatgacctcaagtaagttaatgaaggtctttaagactcaattttatgtatctatgtctccaggattgttatgaatattttagaacaatgtaaacttattaccaataattattaattgaagaagttcaagtctttctatgtaaatatcctgctcactttatctagagtgctcacagcaacagttttcccccagtttattcttgttcaaagtgttgaggtttccaagtgcatgctgaagttagaaagataaaagcatgaagatacagtgggtgaacctagaggaaggctgccaagactgcgctggctttgtctgcatgttatcccatgctctgagatctgacccttggcctcccagtccagcagtaacttcattataacactcagaaatgaggagacacacagtaatgaactcctgtgaagttcacatgcaaatgggacatgaagccgaatgtctatgtgtttttttctttagggtgggtattgatctccaggtggaactatttatatccttaaaccaaggcaactcactctcaatattggagtgtccaagaaactgcagacatctcacttggcctcccttgtgctacatctggttgattatagtttttacttgttttaaattttttaaaaatatatgtgatacttttgtgaaggaaaaaaataaaaacaagaaaaaaaagaactgctttatttctgaatttagaaccagacattaattcctggttcagactgtcatgaccacaaggaaatgagaaatatttgctcatgatttctttcagatgcttcaaaatatttagaagttttaggactttctttggccaaagtctggcagaggtcatatattttctctgttcctgagtctggggtggtaaagggaggataaagaacagcaggaatctattccaactagggttggcagatttagcaaatgaaatttgaatttcagataaaaacgaatacgtttttaggataggtatgcccccattcgaattggcaatatctgcaatttatgggatataagttacactaacaagctactgttggttatctgaaattcaaatttcacttaacatcctgtatttttatttggtaaccctaattacaacccacaaggcaaaagccctcatcaatggcttccaaaagtgtatatggagagagcgctctctctttcattagtgttgggggtgttgtggaggttgaggaggtatattttctttggagactgatttctggtaggtaaggcctgagccttgagcactaatagctgttagatctctatggtcttccagccaactatcatagcatctggtgatggggaccaaagaggagggagctgaagaaacccttccctctatgtgcttttagaacagagatgagttgcttttagagataaaatatagcatattaggacaatcaaagagaaagtgtcaggatatagaataaattatctggaaaatcagaattatgtgtgtaaccattacttataaatggaaatgattttggagacaatctcctctcttcctatcattttacaaatgagaagacagagactcaaagcagtttcctttctggaatgtgatggaagggatgtgtctgtgtgtgtgcatgtgtgtgcgtaagcctagcagtagtagtagcagtagtagcagaaggagatggtgaaggagaaaaaggaggagggagaagagacagaggaggaggaaaaaaggggggaggaggaaagaaactgaggcaaaaagacttgaagtacaaatacctctccactacacctgtcctgctacatgattgtgggtttctacaactgtttttcctgtaactttttaaaaacttacataaataatacacattccttagaaaaattcaggattacatacaaacaaacaaacaaacagaaacctcttccatgaatccaacatacagatattactattgttaacattttagtgtataaagaaagtactttggtatgaaagacccagcattcattctgccttcttcagggagccacacccacattttgctctggggatagccactcaatcaatggaatatcatttctagtggggctaccaacccaggtgtcaggtcctttgctggcaaagcagtaggcaggtgaccaagctgtgatttcagtctctagctaagtgaccctcgaagactgacaatgctggagtttcttcctcctgagaggggaacactaatgagatcactcattggcacatatcattcagacacctggagcagctctgggtcctgggcctcctgagaactaattcttcaccttttccttcaattctaatacgggaaattgattgtattcttggcctcaactagtggcctccataccatgccctgtgcaagagacagaggcccatcaagaactgaaatctagttctccaccccttgaatctgggatgcattgcaatttgctttagccagtagaatgcaggaacagtgaagtgtgtcagctcagagcctcaacttctagagggcttgtgtgcttccagtctctcttggagccacaagaacaaaactggtgtcagctgctggaggataacaaaccacttggaggagagcacaggagtctcagccaactctcagaagtagaaccacctcatgcacacacagctgacctcagatacatgaagaagacgaccttatatcacgagctaaatacatgttctaagcctcgaagtttgaagtggtttgttatgcagcaatacctaactcatacttgtatcaacttccacatctttccaataaattccttttttgtgaatttctacagctacaaagaactctattagacactttccaactagtctctcattcttgtaacagaatgtgatcatatcacacatgctcttttgtaatctactttatttcactttgcaactgattttgagcatctttcccaaacgatcaaatgtacacagttgaagaaggaaaatctcccaaatgccacttctgagcctctgcccaaaccaagtttcatcatgacattatggccaccagccaaaatgccatttgtaggcaggcctagcatgatctgttctgtccagaaggaagtgcctttagcttgtttctccatgagattattggacagcactgtgacttttcacagcttgatgaccaagaaaaggacacagtcatgcctgagaggtgcttgagaacattaaccttcccaggcactgtttacctctttggagaaagaaagcaataattgcattcagaatgttctattattttcaaacatataaaacatatggacagcgaagacagaaaaagagatagacattccccataatgattttatcttctgacccaaaactgagtgattggagctctccagtccttttattcctggtcatcctatttccattatcctttttttttttccaccaaaaggcagctttaatttgagatattatttgtttggcagagtagggcaaggggagggtgcaatgccagccccataactctagtctctagtctccacgctaatgaaaatacattaatattttccaaggaaattagtgtttgtaaaatggatcccctgcaactgtgcacacatttctattggaaggaattttctgaatgcatgatctgctttgatcccttccaataggcacacaactgtaggtctattctcaccttgcttgcttttcctttggatttgatttttttgttgataacaataattcctatggcatttatctcatttaatcctcatcaaaactgcatgaggtagatattgttattattctccttggaataaattgaggcttagagaaggcaagtaaatggtgtgaagtcttgtagctaataaatgacagagctgcgatcccacccttgtttgtcaaactcccaaatcaggatgttttaccgtgatgttttcatgtcccaattcttactgaattttaaatacaataaagacataaaaaataaatcaccaaagtacaggttacttttttttaaagtaggaaacaataagtggccttaatgagtttccttccaatcctaaaagagtatgatgttgaaatccctgtctcttttctccctaggcagcgtcttcagacttccaaataagcctgaagaggacaggagagcgagcaatgtctccctgaatgggactacaggggacgctggtaaccgcacctcattcagcaacttgagaaacatcagcaataatactacaagcaatcgcttaggtacttgactgtgagcaggaatatgagacaagtggaacacactggctctcattttttaaagatgatttcaccttaagaggtaaatacttacggaaaacaataaagcacctacaagaagaattatgatacaggtcagcactgtccaacagaactttctgtcatcatgcaaatgtattgtatctgtgctgtccaagatgtgacatatccaatatattacccacctatggctatggagcacatgaaatgtagctagtatgatggaggaactcatttttaaattttaattatctttattagcttagttaactttaattaactgaaattaaaattaaaatagccaaatgtggccagtggctaccatatgggatggcacagctatagatggccatagaagtatggtgaagtggtcagggaagtcctcatcaagaaagtacattttgagaagcttttgaagtggggtacagagggaagaaaatgcaactggattgagaaagatgggaggaaatgaacaaaacacaaggtttgttctagtagaaggcctggggttacagattcaaatgcctacagaaagaatcataaggtgggccagtaggccgggcacggtggctcatgcctgtaatcccagcactttgggaggccaaggcggccggatcacttgagatcaggagttcaagaccagcctggccaaaaggatgaagctccatctctactaaaaatacaaatactagccaggtgtggtggcgcctataatcccagtactcaggaggctgaggtgggaggatcacttgaacctaggagccagaagttgcagtgagccaagatcatggctttgcactccagcctgggtgacagagaggattggtgggggttatggggaccatggagattagagaccctacccccatgtaaagtgtcaatcactagtcagctccagccagttattgccatacagaaatgtaggctcaatgttgactatcttcttattttttggaggaagtcagaaactccaattttatgttaagtcacctaattttaagtcttggccacagtgtgtgctaaacattcttagcagatgctgttggtgctccactcatatccactcagcactcccctctgcaggtgaggctgcctagtgtgactgccttcaactctgcctgaagacactgtgcacacacttgacctgcattcagcacatgtaggaatgctaaaacattaatgcccttggaagcagctctcaaacaatgagaggaaagtatataaatatgatagatagtcttacctttcagttaggatagctctgagatatgtcctgtattgcctcccagagtttccttgtgtgactgagctccagctgccacagtacaaactggtagataatgtgccattcattggaatccatcccttttccttctcactctcccacttgcctgtatactgatgtttcctgggatcacctcccaataaactacttggacaccaatccatatctcagaacctgatcctgggaggaacccaaacaaagacactgttgcagcatacaaactcaaattccagtggcgaacacaatgatgtttcaatctcactcacatcacagtccaatgagggtcattgtggagactgttccaccatccagggagccaggctcctttcatcatgtggctctgcatcttctatgacaccttccttctctgcattcagttgcagatggggacagatagagaacgtggagggctgggaggaggatttttaccatcaaggcctggaaacagtgaccagcacttctgttcatatccattggcagaactcgtcatatggttcctcctacttgctggggacgcagggaaacgtagtgcagctgtgcaccaactgtagaaggaaataggtttgctgaacacatagcagtttcagctgctgcaacttatttatttattgagacagagtctcactgtgtcacccaggctggagtgcagtggcgtgatctcagttcactgcaacctctgcctccggggttcaaatgattctcctgtctcagcctcctgagtagctgggattacaggcatgtgccaccacacccggctaatttttgtattttttttagtagagatggggttttcaccatgttggccaggctggtcttgaactcctggcctcaagtgatctgcctgccttggcctaccaaagtgctgggattacaggcacgagccactgcgcctggcctgcaacttatttagattttgtaaaaatactgtccgggccaaagaagctatgcctgtggaccaaagtcagcttgtggaacaccagtttggaaactgtggcccagatattattccctagagttaagggagaaaaattttgctagcaagccacccaacaagttcttaacttgcacagaaataagtgtgccacattttattcaatgtccaaacactgtactgagtgctccacgcacagtgctgcagtgagcagcctctggagatgtgtgtgaaacatgcagatattgcatgactatatgaaattaatctatatgaaatttgaaatgactttatgaaaattgaatcaattctccactgactgagtttataatttcacagggaaaatgatcatttcatttctgatagttcttacatgaacagtgggtccctaatcagatagctgtgacttccttcatcctctgtcaagtgattgtctctcagtaggtcatgtcaatgtagccccacttccacctcatcttcagctcttcagcctctcccccgattccctacgctccagccccactgcttgtttctcaaacttgccaaactttttacacctccagaattttgcaaatgctgttccttattccagaaatgcattcctgctctcctctcttctctttgcttcattctttacccaactgggtccctggtatctgccaagtcttggcataaatattcttccctcatagaagctttgactgaccacccaaaacaaaggggcttttctccacctaccattattcccgctccttctatctatcatgattcagaaccatatctgcatgtttcacacacatctccagaggctgctcactgcagcactgtgcgtggagcactcagtacagtgtttggacattgtcagagctcaaagatatctgttgaatacataaatgaataccaaaaaaactccactgctttaaagaagtttgtgtggataccttttataattaaaataacatctccccatctgtcttgaaagtttagttaaacttgattaggatttaatgaagagaaatatttatatattgaatgctacctgaggcaaagaaataaaataaaattcctctctttatctcagaaatccctgaacttagtctcttctaaaactaacctagataaaactcagtgtgatcatttatgtcaacaggggtggagagacgaaagctctttgaaaaagtgaaactgatattaaaatgcaaaattttaattcctaaaagcatcattgacctaaataatctaacaagttgctcagggagaaaaaaataggaatcagctttgatttttccccaccccttccaatctctctgccatccttatgagctgtacttccaaacacagctcagcttcacctcttgcctcttccccttttgcccaagattgtgtcaatccaagctgctgaatgcgtaatgaagctgtctgtctaagaagcacagttacttgtttagttagaaatgtaatttttgttttggggttttatttgggagggattttttgccaagtggtagaatttgaaagtgttttccctataggaggcagattcggaagtctggcctacgactcttttggaagctgaaactaattaaaatattcatttttcgcctctgtagctaagacccggcaggggagatagcatttgttttatgaaggtgtaactatatccactaacctcttgtgtgccacattcggcatctgccccaaggctgccacacctgctcaaacacctgcccagtatgtgagtatttggtagaacagtttttaatggcttacctaagggcacctagggtcacccacctttacctgaggacaatagagtcttgttccacatatttattacctatacactcacctctgagtgaagtactttcctggtttcaccttcagtgagatctgaaaagctatgcaaaagacaaatagaaaaagagaaagagaaagagaagttaaaaaatagttgtgtgtcattaaaaaaaaaaaaaaaaatcactgaccgggcatggtagctcacacctgcaatgccagcactttgagaggctgaggcaggcagatcacaaggtcaagagattgagaccagcttggcaaacatggtgaaactccatctctactaaaaatacaaaaattggctgggcgcggtggcgcatgcctgtaatcccagctactcaggaggctgaggtaggagagtcgcttgaacccaggaggcaaaggttgtagtggactgagatcacgctactgcactccagcctggtgacagagtgagactctgtctcaaaaaaaaaatcacagaggttgagaaagatacgagaatatgttaagtgtcctccgtgcttccagagtgtctacagaatcctcaaagaagtgtaaagccataaaccaagacagagccaatttcagcattcactgtttttgaatggcaaaaactaataatgatgcttcttctgaatactcagtatgtccaaggacaggctagatgttttacttacattatcacattacttctccctactctctaccataggagacagtatgaatatttatgaatattttgttatatttatttaatattcattaaatatttatgaatgctttgcaaatgaggaaactggagctccaagaagtccagtgacttgggaagtagtaatgcatgggctaagagcagacttggaggtcacatcatctgtgctggggtcccagctctgctattgaccagcagtgtgactttagacaaattacttaatctcactaagcctctgttttgtcacaaaagggcagtggtaataggtaatgacccaccttacttgtgaagatgcaatgacttaacacacacccaatgcctggcacatcatctaacacatcacctagcacacaagacatgctgaaccaaggtttgctatcatcctcctcaaagatcacacacagctagagggttgagagcaaggctgccaaccctggttgttttattctgctcataaagcttctgtatcttccacttgcaaaaactaaattcagagaaaaataattggaaatagaaaagggtggtcaaagagaacaccagaaccagaaggaggcgaagaccagttccttctgtatctggaacttgccctatatgggtcctttgcctcctataccaggctctggaggaaaatctgtttggtgagctaagaagtatttttttttctaatcaagagaagtctctataagccttctagaattctcatccttgatggtgaaagaaattacaatgtgcatattctattgttacaggccaactccccattttctttcccccaagactgccttttcccacaccttattcctcattctcccacctctccacttcttgacattggcctggttcttcaagggccacctgaaatcccaccacctccccagtgaaggtttcccctttctctggaggctgaaacatttatttttagtttaaacatttaattggttttcctgtttcatagggactaataccccccaaatagatgatgtacttcctttgtgtactccacagggattgatactaagtttcaaacccagaaagttctaaatagatatgcactttgtataaattattgttgagaactggactgattgtagcatttgtgaaactcccacctggtaatagggatgcaactgaaaactcggcagagttttaagccttggtccccaccctcaaggtgctttcatccgtaaagagaacaaagcccgaccaggtgtggtggctcacgcctgtaatcccagcactttgggaggctgaggtgggtggattatctgaggtcaggagtttgagactagcctgaccaacatggtgaaaccccgtctctactaaaaatacaaaattagctgggcgtggtggcgcatgactgtaatcccagctactcggggggctgaggcaggagaattgcttgaacctgggaggcggaggttgcagtgagccaagatcgctctattgcactccagcctgggcgacagagtgaaacaccgtctcaaccaaaaaaagagagagagagagagagaggaagaaaaaaaaaaaaaagcccacagcctgttataacagggaggcactgaggcagaaaagttagcattatgggttacttaatttccctttttttttcttaacagtaaaatgggtataacagtcatacctacttcatggagactttgtcaggtttaaatcagatagtgcagagcctagcatatcctaagagttcaaaaaatatagctacaggtaggttcagaaattagaaaagcaattgttcaaataccgggggaacaacaaacatcttataattaaaaggctcaactgggtatatttccagagacagctgagctgctatcaagttattttaaaggtattttatgctaagtacatagttcacagtagagatagacacgtctactcatgctaatttctatgcagtggggcaggggagaggaattaagagttaaagcaatggaaaggagtgtgcttctgggcctgagaaatcccaggtgggaggtgactctggaagtcaaggccatcattgctctctcctacctgaatcaaaggaatgagtaaattggagacaaattgatagagttccaagtaatgaacccgaaagagtttcattgctttatattccattacgaggagagtgtagggttgagtatgctgacctgcagtgaaactgtgttttattttttccaacagaggccccatttcaacacaggcaacatttccttttttctgaggctgctttggggaaagcagaagggaaaacaagcaggcagattggacgttactgagctgaaatcatctgggctcagaagcatcttgtgagatagcagacggactctatgagcccttgtgtccaactttggcacagggggcttagggggtcccactctttgggaaatgactttggtccacactaatgtgctctattaaaggagctccaggaatcctttgaataggattctagcagtttctagcagttgctggtcctatcggaagtatcgtaacactaaaatgcagctcccctagccactgcatttagggtaagagtaccacatgtagcaaccaggggcatcttgttcaaagcctcctgttccaaatttaacttgtgtttttggtgaacttggttgtgggtggagttgacacctgccaagaaggtcccaggttgatcctattaataggcatgactgtagctaaggaagttacagtgctaagttgcacttggttgaactatagctttgaatgtgatgatcctcctcgcctgaatgaaaagaaaagagaaccacctgcaattagattctacagaagcatgtgctgaaatacatacaggaaactttgcaggctcaacaatgacaagctgaaagtattaggaagatgataaggtacacatcctaataatagtatagtgaacatttcctgcctccttactctgtgccaggtagtatactcaagaccatagctgtattatgtcacagtccttgcatcactctgtgtggtatttactaaggtcttcctttcatagttgaggtacctgaagcactgaggggtcagatgcctgcctaggtcacacaaccagaaagtgcagaggcaggacgtgaacacagaccaggttccaatgtctccactctttctatcaaactgccactcttagtctctaatgtaagcttcattgaaccaacacacaaagcacctgctgggtgtggggcaatgtataaaatccctgggggcacagaaaagaagtataaacttgattgtgcttgcaatatatttccaaaaaaccaatgaactatttgtgtggtaagtaattggattagaataagggtcatctcccaaagaaaatagaaatccttcccagggtggagaccacatctgttttcctatccagagagctttgctcaaaggcctatacctcccaggctctggacaaacatctcttgatgctgacgggagggacatggtgtcatagaacaaatcaggtcttacggctgaaggtcctgagtactggtcccagcactaccccaaatttgtccagtgcctttggcaagttaacttacctctctaggggtcaatttccatgtctacagaaaagaaataataaaaataaaagttaatgtatgccctagcctacctcacaaagtttagtggcgatgaaatgcagtaactatacaaacatgctatggctgggtgtggtggctcatgtctgtaatcccagcattttgggagaccacggcgggtggatcacttgagatcaggagttcaagaccagcctggtcaacagggtgaaaccccatctctagtaaaaatacaaaaaaaaaaaaaatagtcaggtgtggggtgcacgcctataattccacctactcaggaggctgaggcaggagaattgcttgaacgcgggaggcggaggttgcagtgagccaagattgcatcactgcactgcagcctgggtgacagggtgagactccatcttaaaacaaaacaaaacaaaaacccaaaatgtgctatgcaacactataaggaatttctttatgagctttattccttgagagtgctgcagaaaatcaccggagtggatatccctgagagctaagcgcttgggtatgacttcatgaatgagggggacaactgaagctatagagtcttgtggattctagaatccttaaactggccaattctcattttatgtttgaaagcctggagtgggatgtgaaggatgtgatacagagttgtctccagctttgggttccaggatctccttgtttggtgaaaggagccttgacatttttccttcctgtaaactttgccatcttccttctctgcttggcaattcatgcctaacaagtgacatttcctaggggcaagatagcataactgtcaagaatagggaattcctattattaatttttttggtttacttgtaaccacccagtgggttcaccttgcctgctgcctagacaaagccaatttatcaaggcaggggaattgcaatacagaaagagtaattcacgcacagatggctgtgcggtagatgggagttttattattactcaaatcggtctccctgagcattctgggatcagagtttttaaggacaacttggtgggtagggggaggcctgtgagccaggagtgctgattggtcagagatgaaagcaagggagtcaaagctgtcttcttgtactgagtcagttcctgggtgggggccacaagatcagatgagccagtttatcgatctgggtggtgccagatgatccattaagtgcaggggctgcaaaatatctcaagcactaatcttaggagaagtttagggagggtcagaattttatagcctccagctgcatgacttctaaatcataatttttaaccttgtggctaatttctcagtcctacaaaggcagtctagtccccaggcaaaaaggaggtttgttttgggaaagggctgtcatcatctttgttttaaactataaactgtttctcccaaagttagttcggcctatgcccaggaatgaacaaggacagcttggaggttagaagcgagatggagttggttaggtcagatctctttcaccgtctcagttacaattttgcaatggctgttcaatcattctaaatctcagtttcctcagcagaaaataaagagatgataatagtaccaaccttataggattactgtaaattctataaggtaattatagaattctataaggtaattatagagaggtaattcctataaggagcttagcccaatggctggaaaatatatgtaggccattgttaatatgcatatatagttataattacggtgtagttctgtttttcttctaccaaccctatcttcaaatatacttgctgtcagttaaagttcaatatcttataaagagattttaaggcttgggaaagattagtgaaatcaagaaactgggagttgctaaaaagttagttataaggcaagaagccagaaacatcaccctccctggattcaggctgttccccaataatctaaagtgagaaacataaatagggcaaagataatctacttcataagattatgaataaatgacatgcaaggattttttttattctatagctcctgtcacagcattgagaaagcaaacttttcatgaggcagtcactgtcatttgctctttattgccttaaatttccaggccgtggaaccccaaagtcaacccccaagcatccccagaagaaaagtacactttgaataattacagtcctttaactttcctgattcaaccttcaaaggccacgaattgcttctaacgaagaagctgaagtgaaagaagaaggaacgtcaacaaaaatgtctgtttgtgttatctctttactttcacggtttataggtttgggggaaagtttttattttcggtggaatagaagaagggaagaagagagactaaaaagcatttcttagatttccagaagcagtaatggaaaatcccgaccctagagtcttgctttcttcctagaaatagaatgctcctgaagttcccaggagagcccttggcagacagatgtcaatcattccatcccttgttttgctgggtggagtcactggagcttaaagaaggggaagtaaactcaagcacacatcctggtgacctctagccacgggtcaaatttcactgatgtcaattaaaaatgaccaaagacccgcccctgtgaaaaccctgtgggcagccattttgtctcagggaaactgcccagatctgatgtaaagtatttccggacgtctcttcgttgtatatggcatttccctgaaataagcaactctctgaaaaatatcatagcgcagatcaaaatgaagtactctgtggtgaagtagaagtacacagtcaacaaagaaacttgccctcaggctgcacagtaaaacgttggaaatcccagagcagcaacttggaaatcccacctgctacatatttgcctgagtactttaaggttctatggacaattgtctctctgcgtagattaaccttaaataaacttgttgcgttttgaggtggtatttcttgtttcatttctcttgcttttctcccctattttataataagtttcattcacactgtgatactttaagaagagataaccttctactaagggatgttgctgtgataacctccaagccacaaacacaggttttaatcttacctcagggaagtcctgcctcccttgcagactagtttatgtctgagtggatttgcctatcagcgtcttttctgatgaggcatgtagcccagcacggcagcaaagaatcctgcagtaggcagataaagctttctaaaaatgttttaattttactttaaattgacaaataataattgtatatacttatgtggtacaatgtgatgtttcaatacatgcatacattgtggaatgatcaaatcaggctaattaaccatacacattaccttacatactcatttttttgtgatgagaacatttaaaatctagtctttcagcaattttgaaatatacaatccattattgttctagtcactacactgtgcaatagatcaccagaacttatgcctcagataaagctttgaatcctgtgaatcctgttaccacagaatagcaagtgacctcagaccagttacttaacccctctaaagctcaatttcctcatctctactattgagactataatagcatctacttcacagggatgttggaaggattacgtgctctcaagaaggcttagtaaatcctaactcctactacattattttattgaggtctcatcgaattagatacccgagagagagaaaatgaaagggaagtgcttaacatttgtgacaaccttaacgtgatctgcacatttcctaaaaattatacacttgtatgacttcatttcccccaagatagtatattagtactttggaaagtgtgagatgaaaaattgttatcctgaactgcaatatcctactttctgacttcaaatccttatctctcctgcacttctcactataccatcgcttagacctcattagggtcacctcacggcctgtgcttatcctcccacctttcccatatcctcccacctttccagaaactttccatgtatcagttaccccttctctcctctcagctgggtccttcccacaagtaatgaagccctaggtcactctaggcctttccatattacaaaataatatggaaagggccatgttttccctcttgccacttctgtatctctctcttttccttcagagccagtcttttaacaaattatgtactcactgctgccattttttcaaatctgcctcactctttagcacattacaatctggtttctagcccaaatattccaccaagtcgccctcacaaagatctctagtggtctccatgttgctaaatccaaaaaactttttcagtctttatctcattgaccctcttgctgacaatgggcacaatccctcttgcttggactttgttgcctctgatactacatcttggttttccttccaagtctctgactgctcctgttttgtctccatttctgcctctttctcctctaccttccattaaatattgaagttccccaagtctcagtcctagaccctcttctcactttgtatactccactctatcctgacaatcattatcaatcatgatttcagttatgtgataccagcttacatctccagcccagaccacacctccatgttccagacccagaagcccgattatttgtttaccacatctccatttggaaggcattcctcttcaatttgcttaagaccaagttcatgatcttcctcagcaaaactgctccttttcctttgttctctgtctcaatgattgataccattatccatccagcatatatcattcttgatgccctcttctccctcactcaccatacttaattcatcactaggacctatctctttcatttcttaaatgtctctcaaaacaatcttgattccaatatttccatagtcatcaccataggatagtcactgtagcatcaatctaagctgccatcatctctttattctcctgagttttctctccattcactctgctttcccagccccaattcctttctccacattgcagccagtcccaccatgtccttccttaaaacttgccaataacttcctatggatcacaggaaaatgatcaaaatttttaacactgtgttgcaaagacagcctttccacaatatctgttttctccttctacctcccaaaaatcttctgttattgggacagcaatatatctcagacacaaataaacaaaaagataattcctaacttcctttacagagaggaataaataacctgtgcggtataagcagaagttgttaaacagagtacccaggaaagtccttttatccttgccctttgggttcttcatgtttgaaatatggttgtgatgactggcactccagcctccatcttgagaccttgaaggaggctagaaccagaaatggtaaggcagaaagataaaagaggcatgggtcccgatgacttgggaaaccatgctacaagacttgattttctacttctgggctgcttctacgccagagaacaaaatctttacatattatattcaccagttggatttctggcactgggagttgcagtcagtttctaattgatacacacaagatttgcaaggccctacatagtcttgtctctgctgtacctcccgagctgcttcttgccccattgtcacctgtatgctcttcaatacagccacattggcctgattttaattcgaatgcaccttgctgcatttctttttatgttatttatttatttatttgagatggaatcttgttctgtggcccaggtgggagtgcagtggtgcgatctcggcccacagcaacctccacctcccgggttcaagcaattctcctgcctcagcctcccaagtagctgggattacaggcacccatcactacacccagctaatttttgtatgtttagtccagacagggtttcaccatgttgatcagactggtctcaaactcctgaactcaagtgatccacccgcctcaccatcccacagtgctgggattacaggcttgagccagcacacctggccccatgctgcatttctgcacagggcctttatacactcttttctcagtctataaattttcctctccaacccctcatcctccagcctgacctaacttacctctactcatctttcagatttcagttagagcaggactttcttagggaagtcctcctgagcctccctcttttcctcttcactcccgtttccaccaatctagaataggttcctttgttctgtgctgtcatggaactatattcttttgcttcagaatattttccttaggtttagaaattagatatttattgatgtcattatttgataaatatctgcctcctttattagatttaagctttatgaaagcaagggccatgtctgtttttgttcaacattctattcccagcacttcgcacagtccttggtatatatcctatgcccactaaataatagtcaaatgggctgggcacagtggctcacacctgtaatcccagcactttgggaggccaaggtgggcagatcacctgaggtcaggagttcgagaccagcctggccaacatggtgaaacccccgtctctactgaaaaaacaaaaattagccgagcatggtggtgcacgtctgtagtcccagctactcaggaggctgaggtgggagaatcacttgaacccaggaggtgcaggttgcagtgagctgagatcacgccattgcactccagcctgagcgacaaagcaagactatctcaaaaaaaaaaaaaagaaaagcaaaaaagaaaaaatagtcaaatgagtgaatagggacctcaagtcccttttttcataacctatatcaggccctttcattctctcttgcctcacccactctcctaccaaaactccataactttacactaatgtttgcataacgttttatggcttaaaaacaactttatataaattatcccattttcatatctacaacaactatataaggtatgtaaatagtgacaaatctttttcaaacaaggatttcaacataaaatcagtcccttgtaatctgtttaagtagtcaccagagtttttgacctcattctctctcatttaaatcttgagcctcactagcaaattacagttttgagaattatccaactgatccatagccatccaaaatacatattccaacaagcaataaggaaagaccagctaggaaagaaattcaacatcaccattgctttgcccctcagatattgtattctgtattcaatttgattctcctgaccttaatcccttagcaaagtggttctgaaatttaagcatgcatcagaatcacctggaagtcttgttaaagcacagattgctggtctctgattcaggaggcctagagtttctgattcagaaggtctgggatagggtcaaaggatttgcatttctaacaagatcccaggtgatgtcaatgctgttggttcaggcacactttgagaacctctgttttattggctcctcaagaaaagagaatctgtttctttaagaacctagcagtggataaatttgctgtttggcatttttaacagcagcctgcagagcatgtcaacaagggtataatttccagcttaccaagggcaacacagtagagttgtgactatcctgagagccactgagccactgcatattaccctatgggtaatgaggaagagaagtcatctaaccttagtgggtaagccctggttgttgtgtggcctgcccagacctctgaacctgcccatctctcaagactatggatgatagcagcagctgtgtgtgctgatgggtagcctgcatttcagtttctgtctcagcagctcaaatagctcagcccaaaaagcactagtcctcgaaatacaaagagcatgaagaaagcaggatggcatctccagctccactttatccctactgatgatttggaaggtgagatgatttcttctgtgatcgtagccatccaccctcctgtgaaaccctttccaatcataaaatctgcgtatctcccagctgtgtcccaccaagatgcttgtgttgttttaccttttcatcctcattttcttcctaaaatggcttggggaaattgttttattcctaaaatatgattgtgcctgttttcataattgattttgaaatctgttttggatgtaaggttaagggccaaaataaagactggtaaggtttaactatcatttcatccattcaacaaatctttaggatagataatagagagacacaaagaaagaaaaatgtcctcattcttttttttttttttttttttttaaacagagttttgctcttgttgcccaggctggagtgcaatggcacaatctcgactcaccacaacttctgcctcccagattcaagcagttctcttgcctcagcctcctgaatagctgggattacaggtgcctgccaccatgcctggctaattttgtatttttagtagaaacagggtttttccatgttggtcaggctggtctcaaactcccaatctcagatgatctgtccccttcggcctcccaaagtgctgggattacaggcatgagccaccgcgcccagctgaaaaatgtcctcatcattcttgttaaggaaattttctgaagcctcactctcctcacctaaaaactgaaggtaattataataacccctatcttttgcagttactgttgtagttaaagaaggtaaaactattaagtttttagcagagtatccagtgcattgtaaatactcgatacaagctggttgttactaaattaggtagaaagatgataatactggtgtttcaatagataggcaaaaagtattgttttatcacagttttgaataaggaagttcttacagaggaaagtgtaaaattttattacatttcccattgccaacattactatccaaatatttacttacattaatcacaggcctctgcttaaggtgaattgcgtattgcctataagctagtataaggtgtatttttacagtaattctatctaccacatgtatgatgaccactgctactaagtaataataactacaatattcctccagcccttgccatgtactatgctctattcctaaatgctttacaagtatgatctcatttaaccctcaagaccactctaggaaataaacactacttttcatggtccttttacatatgaggaaacagatacccagagagtttaaatgacaaggaaaacttcatgaaggccaggcacggtgactcacgcctgtaatcccagcactttgggaggccgaggcaggtggattacctgaggtcagaagttcaagagcagcctggccaacatatagtgaaatcctgtctctactgaaaaatacaaaaattagctgggtgtggtgatgcacacctgtagtcccagctacttgggaagctgaggcaggagaattgcttgaacctgggaggcagaggttgcagtgagctgagatctcaccattgcactccagcctgggcaacagagcaagactctgtctctcaaaggaggagaaaaagaaaacttcatgcagctcttactacaaacatgtgggtatacttttcagatatgtgcatgtgaatctgtcgggggaaaattatcaggcatgtaagtgtttctaggtcttacaccaaagaggatgctggccccactgtcccatttcttctcctttccccatctaaggaaggtcccagtttgccagatggtctaccatgttggacttttatgctgcaaaattattaagaaagatggagggatgagaactgaagctaccatgataatccctcttgcctctgatggttgctattatggagtgagaagtgtatccccattgtagtaggattcttatctacaaaatgggagctacactatttgaatttcatgtgaggccctcagtacactttatctgtgttgatcccattatgccacagctttctctttacctcactgtctccatttgtgaaatatgattaagaatgtggcgtaccccacaggactgttgtgaggaatgactcatggttatgaaggagtttgtacaatgcaacattctatttagggcttcagtatgttttttatggttttcaaggactaattttcaaagcaatatgacaaagtagatagaaaccttttcagaaatgttggagaaagtgattactaatgttagtcaatagtcatcatttcatcacctaaaaatagatgcaactttgacctttggtcatgcagcaaatataatatttaagaacctgaagaaaaggagagaaacttgggttagggctgtgggaggggtttggggagtgatgaaaaaagaaatatgggggttgatgcaatgtatattgaaagtgagtgaaagataaaggaggaactctgagaggtacgtattcgtatgtgttctcaataaatatcttcagttcttcaatgactttttggatacctaattgggtttctttgatagacagactgctttgaaactggaccatatagatggacaacttttaaacattacaggtgcatatttaaaacactataactttatcaaaattcttccaatcatatatgcttatttgcaatataatatgctggtgacaacaaaatttgtaaaacttcattctgtgatgtttcttacattactcaggggtcagaacacctagaaattataatttcctttacacaaggccatggactattgatatatctaattctctcagagaataatcttaacaaagttgtgaggttggagagagattagtggatttgaaaacaggaaactatcttgaagagatggaaacactcagggtcatagacaggtttacttctggaaacaaagacctattacaaaaactctgtgcacatctctgcatcttcacagaaaagtgtacatacaatatccttaacaaatcaagtttatgaatttttctgttactataagtttcctactaattcattcatttttaaacagaccacaagcaattgtgggtacacaaatattaagacaacattatggggacatttttttataactgagaaaattgttattcattagctaaaagttttctaaaaattggggataagctgccactatattatattagtggtagaacattgtggttctgatcattgaaactggcctgctgtgataacaaaatcagaatcactgtactaaaaacaaaggtagttacaaagagatcaatttgggagctgtgtctgctaaagtgggctatcgatgtgccattaatcatataaatgttttgagagggtccatctgattgtggaatgtaattaaccaacattttcactctgaagaatccctttaattattttccccacaggaatcagcatgtttttgatgctatcaactgtcaatcagaatgtctgagccacttgctaaaccaatatttttctcatgaaaagcttagtgttttgactagcccatatagactacaatgagtttagattaagtttttggaaaagatgaaaacatagactggatttctgcatctggtgatacgccaaattacatggcctaaaaacccttttggtacagagcacatagaaatttcagatacaaaaacatccttttagatggatagtgcttgcaaagaagtaaataaaaataagcaaggaaaatttcaatggccaaaaatgaagagggaattgacaactagagttataagtaaatcagttgacctcatggaaacttggtgggggagggtctcagtcatttacagtcttgtgtttcaacaacctgaaacccctgcaaaacaaagagttgaaaatgaaatcaccgcacgcaaccaagacactggaaagggtgtaaatttttccatccgcacagggcaacaatatggaaacttcttggtttcaatctaggtattggtgtgggggaaatatctcctctaagaatttgtgaccacaggaatgtcctcacataggtttgggtgttaagtttacacagttcatatgacttaagaagtcccaagctgagaaataaaaatcaaagtggttctggtgggtcataccccgtcctgacaggtaggtcgctggagagacacagcaggatgagatcaccggggtttccaatggtcaaactatctgttagagaccataaataaactttcaaaatgagtaagacttaaaggaaaaaatgaaaatatgtgaaaagaacaactatgaaaactgaacaggctgaattggaaattaactaaaaggacttctaaaaatttaaatgtaatctataaaattaaaaacctgggaaaatggtaagtacaagtaaaatgcaactgaaaaaaacatgaaccaactggaatatagatcctagacactacttagaatgtagcactgagaaataaagagattaaaaatattaaaatgaggataaaaaacagtgtttaaagaatgaaaaggtctaacatacatttaataggactttcagaaggacagaatagagagtaggaagatgcagtattcaaagcaggacacttagacacatcatagtataagtgcagaataccaaaggcaaagataaagaaaccagagaaactctgtcactgaaaatactgagaaacaataactacactttatctcaataagtgccacttttttaaatgcaaaatatcactttgcactgaaataagatatacaaggctaattccagatctgttcagaaaatatctaaaatgaatctgggatattttgtcatatgagcagcaaggaactatcaaagacgatgaagtcatatcaaaatgacgtggaagccatcctgaaaaactcccgttggccaaagatgggacaatttgaacacaaataagaataataactgacatgggttaaaatagatcaaatgcgtaaaacccatgacttcatactgatactgcacagagcctgtgtgatcacagtggaggatgccagggtacgatgatagacatatagagcaactatattgttttgagatctggtataaaaaaagaaaaataatgcataatttatcctaacattactgtatgaactgcaactcagagtaaacaaaaatatttgcgaaataacttatacaagtgtttagctaatagctgaagaaggaatgatagaatgtcatcattttacatgccttaggaaataatggacctagacaatggtcatccatagctgctaatgtgacaaaaagagagacaatcagacattatatacttccttatatcaacacacatcaccagctgtggaggagtcttgcaaaacacaaaacaaaatgaaatataaactgaaggctctagattaactattggcttacaggaaataaaaaggcaagggaaaagagttaatatcacagggatacaaccagcaaaatccagattgtggggaatttaaaagaatgaatcagattcttcaacaaaaagttttaaggaaaaaaatgtggaagaggaatttatagatcgaaagaaatttagaagaactatgaactaattgcaatgaatagattgtatttggttcctaattcaaagtgttaaaaacatacaatacaatcagatgtaaacacaagatatttaacaatattaaggtattattattaactgcagatacgtcctttttttggagggcagcaatctagtctgcagacactgtatcccctctggcacttcctgctgcagccaataaaggccgttcctaccatagtttattttatttttttaaaatgttatttatttatttaaagacagagtcttgctctctctcccaggatggagtacagtggcgcaatcttggctcactgcaatctccatctcccagattcaagcgattctcctgcctcaacctcttgagtagctgggactcctgggtaatttttgtatttttagtagagacagggtttcaccatgttggccaggctggtctcaaattcctgacctcaggtgatccacccaccctagcctcccaaagtactaagattaccgttgtgagccaccatgcccagccccacagtttaaaaaaaaaaaaaataggtatattgatgtatgctggttatgttgaaatgcacatgtgtacacacaaggaattcttaaaatatctcgagcataatttgttgtcttgtttaagacattagaatgattaaaaataatgtaaaaatattacattaggaatatcatgataggaaaataccatttaaagaatattaaagtaatcatatacatagggcacaagttgtaagacttaaagggggaaattcagacttagaaaaatagtgatattgcttctttaagttattctaggttgatatgttaacagccagatatttcagttgttttcttcatctttccttaaatgctcatgtcttgtaaagaactttatccttttagaattgtaggggtttttatggtcatcagaaagcacatcctcataatatgctattgttaagaaataaaattttaaaaaatctttcaaacacagatctgtaattaattcaggagtcaaagaagaaattataatggaagttataattatttaaaattaaataattaataaaatttaaaactcattggaacagtaatataagtaaaagcagctgaaaggaacatcaagtaatctaaagaaagaaaaaaaagggactacataatacaaaacagcacaaattagtaaaattaaaatcagaaatttgttggagtgtaagagagccaaataaataacttccttgttgtctcttaaattctgaatccactgtaacatcaacagagtcgcagatctgaagaccaaattatcacttttattaatgataaattatgttagagggtgtgactaagagtaagagccaaacagatctactaatactaataccctgcccaccctctagtttgtagaacttggaactacataccagagagatgcagacacacacacccaggattgttatcttgcactggactggagggtgaaaagaaatctaattctccatgcttagaatttttgatggtttacatcaacccaaccaagaagtgaggaccaatggctgtcacctgacaacagacactcaagttaaccttcatgcagagagtaagaaatggggaaagaaatctggattatttagggaaatcaattcacacataaatcataggagtggaaaataagtttttcttcctgttaaacacaatagagaaagtcaaccaaatcaaatattttgtttagtaaaacggatacatttgggggaaaatttttaagaattaaaaagacagtacaaatagatgaaacagggaagataaactaagataaagcagatatcaaaataataaaatcatatggactttatacaaataaatttgagcatttatacaaagtgaacaatttccaaggaaaatacaattttgcataacggagtcaggaagaaatggaaaaccaaaggaatctataatcattgaagacactgaatctataattatataaaactctattctaccaccccaaaaaggaagaagaaagaggagaaaatggaggggaaagtgaagaactaccaccaggtcgaaattattttaatagcgagttctaccaaatattggaacaggcaaatccaagcttacataaatgcttccagataatgcaggccacccaaattgttctcaaagatgattttactttcttctctgaggaagaacaatgctgtttcctctcaatttcttgaatttgctttggtaacttttactttcttttcatacaacattcaaagggaggagaacgggctggaaaaatattattccttatctaattgaagaatggtcaatatgaaatcagagatacacacacacagcctccattttaaagggagtgtcaatattgatctttaaaaaattaaaagggaaacactacacatctgctagaatggccaaattccagaacactgacaacaccaaatgctggtgaggatgtggagcaacaggaacctccattcactgctggtagggatgcaaaatggtacagctatgttggaagacagtttggcagtttcttacaaaactaaacacacgattaagttgtgctccttggaattttcccaaaagagttgaagacttacatcttacacaaaaacctgcacatagatgtctatagcagcttcacttatcattgccaaaacttagaagcagccaagacgtccttcgggaggtgaatggactaataaactatgatacatacagacaatgtaatatttctgggagctgaaaagaaatgagccatcaagccatgaagagacatgtagaaatctttcctgcatgttactgagtgaaagaagccagtctacaaaggatacatactgtatgaatccaactatgtgacattctgtaaaaggtaaaactatgtaaatagtaaaagatcagtggttgacagaggttgaggggagggaaggatgaataaacagagcccaggatttttagggcagtgaaattactctgtatgatactatgatggtagaaatgcatcattataaatttgttcaaactcacagaatatacaatgccaaaagtggctccctaatgtaaactatggacgttgggtgataatgatgtatcaatgtaggttcaccagttgtaataaatataacactctggtaggggatgttgataaggggaaggctactcatggggatggggagggagtatgtggaaattctcagtactttccattcaattttgctgtgaatctacaagtactctaaaagttagcctattaaataattttttttaaaaggagacaatatatccataattaaggtcaattcatttatgtatctgtttaaggccaggttcattcataggcgacatgggaggaaaagtttatgttacctattcaactaaaaaaaaagtcaaggagtcttattctaagttcactgccataaattatatatgtatatataatttatatatatattatatatgtatatataatttatatatatataatatatttattataatatataatatatattataatatatattatatattataatatgtataatattatatatattatatataatattatatataatatatataatatatataatattatatataatatatataatatatataatattatatataatatatataatattatatatatataattaaaaaggaaagactacacatttgctagaatggccaaattaaagaaaagtgacaacaccaaaagaaatatatatatgcatatatttttttttttgagagtctcactctgttgctcagaatggagagcagtggctgatcacagctcactgcagcctcaatcgcctgggctcaggtgatcctcctacctgagccccctgagtagctggggctacaggcgtgcaccaccatgcctggtgtctaaatatgaaattcagagcctagcatcccagttaaaagccacctatctccaatgacagagggaagggaatttgggaatgcttagagctgtctccctactccccacctgaccctccacacaaccctctcaggcctgcttgctgcaatagaagaaagaacattaaggaggagaaaaaaagacatggctgatgcaatcccaagcagcccactacagttttacctttccagccaggaggaaattagtaaagagagacacacaccagtccatgcactgccctggaacccattcagggttccgaccagccctggaatttcacccactcattgttgggaaagctgatcaaagcaggttagcacaatctctccttggagtagaatgaaatgggcgagagaagaagcaaatgagaagctattcttttcttaaaggtcaaaacttgcctactatgtcgtttttacattaatataaattaatttctcacagaaagttggcaacatatacatgccctaggaaaggataagaagaagtgatccatcccgggaaagatggggaaaaccatggtggtttcgctatgttagcctcttcaaagtccgaaagctagtaggtggcagagatttctattaagtttctttagacttaaagaaactctttttaccatccagtgtattggaaaatggcatccaagaaagacttgaatgcatctgtgctacctaagatattatcacactaagaactacttgaaataaatctctgtttggggctgacctaattcttaccgagtatcttctcttgagaatcaccaaaagagaacacaccactttatttgacgttaaaataaacatgtcagaaaatggaccaaagacctaaatgtaaaacccaaaactataaaactaccagaagaaaacatgggagaaacatttcaggacatttatctgggaaaagattttatgggttgggcgctgtggctcacacctgtaatcccagcactttgggaggtcaagatgggtggatcacgaggtcaagaaatcaagaccatcctggtcaacatggtgaaaccctgtctttactaaaaatacaaaaattagctgggcatggtggtgtgtgcctgtagttccagctgctcgggaggctgagggaggagaatcacttgaacccgggaggtggaggttgcagggagctgagatcgcaccattacactccagcctgggcaacagagtaagactccatctcaaaaaaaaaaaaaaaaaaaaaaaaaggttttatgagtaagatctcaaaagcacgggcaacaaaagcaaaaataaaccagtaggattatgtcaaactacaaaacttctgcacaatcaacagagtgaaaagacaacctacagaataagacaaaatattaggaaactacttatcttataggggatttgtattcagaatatacaagcaattcagatatctcaatagaaaaaatatgatttaaaaatgggcaagtgatctaaacagacatttctcaaaagaagatgtacaaatggccaacaaatatatgaacaaatgctcaacatcactaatcatcagggaaattcaaatcaaaactgcaatgagatatcatcttatcccagttaggatggctgttatcaaaaagaaaaaaaataacaaatgctggcaaggatgtggagaaaagaggactcttctacactgttgatgagaatgtagactagtacagccattatcatgaacagtgtggaggttcctcaaaaaactacaaatagaactaccataccatccagcaatcccactactggacatttatccaaagagaaggaaatcagtagatcaaagagccatttgcagccccatgttcactgcagcactaatcaatagccaagatatggaatcaacctaggtgtccagcaccagatgaatggataaagaaaatgtggtgtatatacacaatggaatactattcagccataaaaaataatgaaatcttgttattcatggcaacctggatggaactgaaggacattgtgttaagtgaaataagccaggaacagaaagttaaacaccacatgttctcactcataagtggaagctaaaaaaaaaagttgatctcacaaaagtaaaaagtagaacagagcatgccagagacttggaagcataggggaagggagagacagagacagactttttaaaggatgtaaaattacagttagataggaggaatacgttttagtgttctatagtgctataggatgactatagttaacagtaatatatcatttcatttttaaaaatttttttatttttattttgagacagagtattactctgtcacccaggctggggtgcattggtgtgatcttggctcactgcaacctctgtctcctgggctcaagcgattctcatgcctcagcctcccaagcagctgagattacaggcatgtgccaccatgcccagctaacctttttgtagtttttggtagaggcaggggttcaccacgttggccaggctggtctcgaactcctgttctcaggcaatcgcccacctcggtttcccaaagtgctgggattacaggcatgaaccactgtgcctgaccaataacatatcatttcaaataactagaagaaggacatcaaatgttcccaagacaaaaaaaaaaagataaatgtttgagatgatggatatattaattcgcctgctctgatcactatacattatatgtatcaaaatatcactataccccataaacatgtgcaattataaaaataaaattaaattttaaaaattaaaaataaacatgttgagaaatttcttgaaagagctgttttctaatccttcaggcatattttctcttaaaacagaggattcaaagagaagaaatgtattattatacattgcaatttagcactgcatatttcaaatcccttttaatgatacaagttgttctgtgttgccagctgaaacctcaaagagatttcaaatggctacattgccttctaaagaagctgatgagtgttctgggtgtctaggaatggtttttttgagcctctaaacgaggcaagccaccacattaccaacaaaaaatgtcactagctgatacatcatgtgatgctagcagtatgtagggatacaataaaatggcacatcttgtcacttattttcaacaggaagaaggactgacatggagtttattgttggaaggggcccactgtgccgtcctattgtcaactgagaaatctgtttcccagaatgccctctctgtaatgattctgtgttaacatcagccaagagtgacattgcccaagatttgggaggtgaaagtaaagctgttgccattatactttaaagatcattgtttgttagaggtgatgagagaccacctgacaaggtcattgttagaagtctaatccccttggagacaagttagaaccttctattctgacaaaagccgttttaaagatagcctattagaaatcacactggggtgagaatcagaagcctatcctactactacaattaataacatagcacatttattgtttgctatgtactactgtgccccatgcttgacattaaatatctcctttagagaaatatttgcaaccactctgtgagtaggtactgtcattatcctcattttacctcattttacagatcaggaaactgaggcactgagaagtcaagcaacttgctcattttgattatatagtttgtgaaaggaagggccaggatattaaacttcactgaaactctaaaatttctagctgtgtgattgtggtcctatcacttccacacaagaagtctcattttcctcatctgtcaaataagaggcttgtactgcatggcctctaaagtcccttcctggctagctgttctattattcaatgtcccttttatcagggagtgatattctccccagcaagtatttgatgcgcccatttaaaagtccttcatcaaaaatctcctcttaactagcagcccggggaactcattccggctaatttaatcttgcattcccatctggacagtgagcacctctggaaagggccaccacattcatctttgtatcttttcatacagttccaaaatgcaatggaggtcagtgagaatgtgtgattctatatatgagtgcttgtttgttttagacaattttcctaggaaagtacccacagtgaatatctgaatttcattataaccttggcatgttttgctcttccacattccagtatgcaacataatccatagattcacaccattccctgccatgaagtacctgttgtttttagaagtcagatgcttctaatattcctgattttcattttgatacaaaggagttacgaagctgtgccgagaaaaaggaatacaagatcagctgacgttccacaccaccgatggaaatagtaacaaggcatacaacgtgggaaataatgtggagtctttcaaattcagcaggtttcacaacccaccctttacatgggctccaggatgacaagtgccccagtgaatgcttttccacatacatcttagtaaagaccatcaaaagccctttgctttcagctggcaagtctcagccgtgcaccttcactgcctgcctcaagactctatgaactctccagtcctctgtcaaaatccagtctggattttgtattgcatcttcaatccacagaatatgacgctggccctctacattatggcatcatgctccttggacctgcaaagtaggaaatagccattaccctagacagcacgtcaagacacattcatgccagagagtgggatacatctggcaaaaactcaagggcctgccacctaggtgaaattcttaggaatctagtcgtctaggccatgtcaagataatctttccaaagtgaaggacaagttgctgcattgggtcttcctaccactaagaatgggcataatggctagtgggcctctttgaattttggaggccacatatatcttatttgggagtgctctaacccattcatcaaataattgaaaggttttcagttctgatggatgtccaggctgccattaaagctgctctgccacttgggccatatgacccagtaaatctattagtgcttaaagagtctgtggccaatatggatgctgtctggagcctttggaaatgctcctttaggtgaatcatagtgcatatcttcaggatgttggagtagatatacaatcccctgtcagcaactattgtccttttgggaaacggtttctggcttgcaattgagccctagtatagactgaccatttgatcatgggccaccaaatggacatgggacttgagttgcccatcattcattgagtgctatctgacccactgcatcacaacactgagcatgcaaaacagcacttcattgagtggaagagactcaggcctatcctgaaggcagaagtaagttgtctaaacaaatggttgagaatggcttctactcttgctactcacttcttctttacccacctgcacccacattctcatggtattttccctacaactgaatgactgaagaagaattatttaggtctggtttacagaccatcctgcccaatatgctagcattacttgaaagtgggcagctaggtgagcatgacaacttttctcaaagcccttaaggatagaggcaaagggaaatccttttagtggcagaatattgagcaatgtatctgtttgcttatccttttctggaagaattgataatcgggagtatgcctcatgataatcagtggtatgactcactgactcatgggaagtagttaaatggccagagacttggaaggaacacatttggaagattggtgacaaggagacctggaaaaggattatgtagatagatttctctgaataagtacaaagcaacctcaaccgaggaagatctcaataaccaggtgaacaaggcaccctattctatgtcaatcagccttctcctctaataactcctgtctgctcaatggggtcatcagtcatggaggcagggatggaggttacccatgggctcagcaacatggactgacattcagcaagcctgccaatagtggagaccaatactgagcccccatgcagcgccatcccctgggggtgcagcaattcacctgccaggaggttgattacactggaccccttccatcatggcaggagtagcagctatagatttaccttttctatccacaattctaccaaaaccagtactcctggacttacaaaatgcctcattcattgtcatagtaccctatacaggattgtctctgaccaaagaactcattttgcagcaaatcaagtgtggtgataggcttgggctcattgaattcactggtcttatcaggttcctgaagctgctggcctgacagaatggagggatggacttttaaggcacagttattgtgtcagctatgcggcaacacttttctgcagcaacacttttcagggccagggtaataactacccggatgtaagatatattctaaattatcaaccagaatatatggtcatgtttctcctatagtcagaattccccataaataggccctgaggttgtccccaactttttatagtataaataatgatccagcaaacatctttgaaaatatatcctttgccctttcttgtttacatgtgttttcccaccaccaatctgtaaagccctcaaggaattttagtctcccatctttgtatcgttggcacccagctcagtgcctgggacactacagcactggaagcacgcttgtgcatgaacggatgaatgaatgcatgctacatggctttagttacagtgttgccaacctcaaccagacacaaacccttcccaactgctggttctgctgaccaacatctgacctaggaagccacttcctacaatcacttcaagcccaggaaatacataaatgtccccaagatgctaatttttatcttaatatcaagtccatgctttttatgcctcctccatcattcatttgtttcttcaacaagcattttcttcccctgtgatggggatacataatggaaaagacctggcacttgtgctcagagaggttacagccaataaggggaactccagggaggccattacaatgcagagagacaaacactctgatgggataagatgcaggtcttgtgggtacataggaggcccttcaatgcagtcccagcaagagggaaagggacatggacttcttcaagaggctagttcctctaagttgtggaggaaggtagagggaattcccagcaaaagagaaagaggggagagaacaggcccattcatggagagtgagttcttctccaattgcctgtacccggtattaactctcttgactcttgtccctgattcctggtgactcagtggcatgtgccgtgatggttcagactcccagcctcaccccttatgatgttcttcatgctctctcgctgccccatcactctccctaagcttggactgcagcacgttcccttattcaaagtttgtgttagttacctggggctgctgtcacaaagtatcacaaactggtggcatcaacagcagaaatgtattgtcttcacagatctggaggttagaagcctgagatcaaggtgtcagatgactggttccttctgggggccgtgtgggaatctgttctcaggctgtcttctccctgtgttttcacactgtcttccctctatgcatgcctagctgtaggtccaaatttcctttttataaggacacatgcttagtggattaagacccaccctaaggacctcatcttaacttggtcatctgtaaagactctgcagttgattctccatatccatgggttctgcattcttggattcaactaactgcagatcgaaaatagttggaaaaaagaagaagagttgcatctctactgaacatgtacagactttcttcttcttattattccctaaacaatacagtgtaaaactatttgcatagcatttactttgtattcagtattatagtaatctagagatgatctaatgtatacgggaggatgcacgtacgttagaggcaaacactatgccattttatataagggacttgagcatccatggattttggtatccacagggatcctggaaccaatcccccgtggataccaagggatgactatatttctaaaaagtgttatactcacaggtcacaatttttggagagacataatttaatcctaaatagaagccaagattccagatcctaattgtttctactctgcttccacatcccgcagtgtgacaatcaggaaagccaccatcaaaaagtcctgatgctcatggttgggtgttgttgtttttgtaaattgcattttatcattaaggtccccatgttggtggtggtttattgcttaatgaaattgcctcctctgtgggctttaattataaggcagggaaatgaacaacagagaatacaatctgaggtggcagccaggccattttcatttaaactttttgcaggttcccactgtgtgctttattctcataaactacagaattaaacacatgagtccactgggctgggccttaccactcactgctgtcagaatgaacatctagagtaaataatgatagctccatcagacccacagatggggctatgttaagctatgtggctggtgcagtctcagcaaggatgcctgccacaggctgcctggaagaggactctcttaaatatctgcttgaagaattcggcctgagagtacaagcaagttgtccactgcgaaaactgaacaacaggctactatagctggaaggatgttagtaagcctattccaaaggctcttaacctggatgtgtggattagcttttaggaagccacagcaaacagtgttcatgtccccccacccccactcctccatctcctcggcccacccagaggttaccttcagcttcagtgagtaattccataaaccagccagccttcctggttgctgagggctttgtgtggctgcaggagcacacctgcccaaggtcagagcaggctgggatggcctgagagttaacactatgacctccagccaataaaagatgtgagttggtgaataagcacctagcttcttcacccctcggtgggacgattctgaggtatgttctgcacgttgttttggagggtccccagagccagcgggcctctgttgtccacagtggtacccgctgatgagcatacctttcaccggctttcctccctttcctgtctcaggcctcatcatgttccctgggattgcctcccagatgaatgacttgttcccaaatcctttacctcagggtcttctttttgagggaacccaaatcaaatcagggtatacaagcccctgaagctacatgggaaagtattcatgtctgtgccattttctgaaagagggcacacagctttcattagatcctcaaaagctcttagccaaaaccaaaaaaaagggggtaagaaccactgctcattattccacagtgagagcagctatttcttccaggtctaatctaatcactctcaacctggggggccaaaggaatggagtcaactttcaactagctgacaagtctgcatgacaagaggtggggggaagaggtatgcagagagaacagccctgtgtgtgggagtacagaacagcaagggcctttcccaaggccagcatggtctcaggctaatctgatgtttgtgcgtgcattgtattttatatcaaaggggaagggccagttcccaaaagacaaatatgtgattccacttatatgaagtgcctagagtagacaaattcatagtgacagaaagtagaatggtgtttgtcagggacttggaggagaaaggatgggaagttgttgtataccaggtgcgggttttagttttccaagatgaaaagagttctggaccggacgcggtggctcacatttgtaatcccagcactttgggaggccaaggcgggaagatcacttgaacctaggagtttgagaccagcctgggcaatatagagagaccccatctctacagatagtagtaatgattttaaaaattaaccagggatggtggcaggtgactgtggtcccagctgcttgggaggctgagttgggagaatctcttgagcccaggaggctgagcctgcagtgagccatgatcacaccactgcactccagcctgggagacagaggaagaccctgtctcaaaaaaaaaaaaaaaaaaagcaaataaaaagaaaagagttttggagatggatggtggagatggatggtggtgacagttgtacaggaaagtgaatgtacttaaaaccaacgaactacatacttcaaaatggttaagatggtaaatttaagttatgtgtattttaccacagttgttaaaaaaaaaatgtttaaaaaccactgatctcaataaacacaacaacaacaacaaaagctgttgtagcaggaactgtgaccctcctcattggtgctatctttttgcagggtctggtgctcactgtgtgtaatcgtgactgcggggacccgcctatcggagtaaatatgtaaaaggaggtgaagaggtgggcctgatccctggcccgaggagtgaattcaggcaaagcccttgatgtctttgtgcctaagtgtctctccagttgaggaaaacagtcgctgttgttaagcctcctgggtagatgccaaaagaatggccactcatgaggaagagggctgcattaggctgagaaagccgcaggaagtgactgagagggaagagagaaaggtcagtgtgtttgttgtgtgaagagttggaggtcagttctaagagacagaaaagcaataaaatctggagatggaaaatagctaggaaggaagtaagaaatgaaaagacccgtggcgcataccactggcaaagatgcttcctggcaacaggtttctcagactttgtccatgaactcctgcgggccttcggacagactcttggggatcctcaattctcaacaaaaattttctaatgttatttttttctgattaggataatcaaaaagtgatttaagtatgttctgcatatgacatttatgtatgtataattgttaagcaatttccacaaattagagattttgacttttactgacttttagtgtctgagcactattattatggatagctatgttccaatgtcaaattgtcaggaagaaggctgtgcccacctctctcctcatatcaaaatcctgtctggtgatgatttgccatcacaaaacctatttctatagtaatattttagtctctcatgttattcaataacttgagacttttagatttgccatcatttacactaacatactgtggtcaagcagtaacatacggctgcgactgttctagtggatgtgaagtgtaaatgaggtgctacagccaatgaatggccaaaggacatgggactcctctggatgagcaaagctttcacaggagtttaaatatcctaggtaaagtcaaagtgactgcgatagaaagaaaacttgactgaagatcaaattattcataaaattctatttctgatatgtacaggattctgtcaatattcttatcaactctttaataaaactagaaatttgtttttgacatctgcaaggaaaaaaagaacccagatatgctgatgccaccaataactaaattagacaaacacatttagtacacatttggtaattcagtaaagctaagaaattttaagagaatgtaacttttcagagtctataaagcagtgtaacattagaattgcttttttgttttgttttcttttttctttttttctttgtttattttaaaattgctttttaacttaggttaactataaggtataataaccctgaattagcaaacaaaagcttattgttattaatactgttttgtacaaaatattttgcaaataggcattattcacactgatattgttgaaataaaaaaacaagagcagggtaaatgtagatatggacttgttttctttttagtactaaagcctacatcgacaatttagttttagccaagcaataatttctgtaaaaataatttaatattgtaaatatgaaattgattgcttttcttgttttggtttgcatttatactccttgcccttttttctagtatgtaagagctacgagcacaatgagaatacacctaggcttacttgtacttaaataacattacaatataagtgcttaagagaaccctaggaggcctatgagaatttgttttctcagaagtgctttgcacatcactcaagctagacaaatactgttttagaaacacagaggaaggcaacatcaatgtagcctgggttgtcagtgtcaaaagaccattcttcatgggattcttgtttccatatatcttgtgagcggaggcatggactatctttgttcttggctaacttttcaaggatttttgtatagtaaacacattgagagagagaggtaatgtctttctaggaagcatcaagcattggagtttagagatagtaaaagggaagcgtgtttaccatccattataaaacatgaggctgtcctaagttctctctattcctctccttatagtgcagcttactgtgtgtgctggtgtcacttgaccctctccacattaccccaggggcatcaggacttgaagaactggcccaaaaatgctgctactctggctactaccattgctgtgagttaaaaactgtcctttgtctctgacccaggagttctatgccttctaccagcatccatgaaacttggctggctaaattgttagctttccagtagctattatgaaatctcaggccctttgtgattatttttttgtttgttggtttgggttttgtacatatttatggggtacatgtgacattgtgtcacatgcgtagaatgtgtacttctacttcaggatgtttaggagatccatcaccataaactttaccatttctatgtgttgagaacatttcaagttctcacttctagctacaatacattgttgttaactgtagtcaccttactctacaattgaatattactgcttattccttctgtataactgtatgtttgtacccattaatcaatctgtcttcatctacacatctaaatccttcccagtctcttgtcaccaccatttgattttccacctccatgagatccatattttaagctcccacatataagtgagtacatgcaatatttatttctgtgtctggcttatttaacttgatataatgacctacagttccatctatgttgctgtaaatgacatgatttcattctttttttggacaaatagtattccattgcataaataaaccacattttctttattcattcatccactgatggatacaagttgattccatatctttgctattgtgaataaacatgggagtgcatgtatccctttggtacactgatttcttttcctttgcataaatactcagtagtgggattgctgaatcatacggtagttctattttcagggtttttttttttttttttttttgagaaatctctatatggttctctgtaatggttgtactaatttacattcctatcaacaatgtatgagagttcttttttccacacaccctcaccagcatctgttattttggcccatggaggaagtggggtttgaggtgtgacctgggtataatttggctagatggatgtgcagtagtgcgggaagagcaatccagctaggtgaatgtcaccaagactcagagacaggaatgcactgtggtctgtggtagagtgatgagtaggtcagacagactagaatagagagtttgggctgagaagtcccagttagaaattaggccctaaattagaaaattaatttggggctaaattgtcctgtgcttaaatattagggtaaatgaaatcctatatataataaaaaacttttgaaggtttctagctctccttccctgaagtcattgatttatttgcttatttatttatttacttaagttcctaagcagggagatgatatattgaatattgaagtctgatgtcatagaagagtgaagtatggagtgataagagaacatcaacaagtttcttatcttgactctgccacttactagctgtgtgaccttggacaagttattttctctgaggccagtgtccttatctgtcataggaggaataatagagtcctcagcttagtgaggtgttgcaaaggttatagataatatctctaaaatgcttggtgtattgcctagtacacaggaagccaataaatggagaagatttttcagctagctatgtgcagcacagattgatggagaagaagtgagggcatgagtctcccctcttgtaaagtaatcacaactacatggggataaggtcatgaggagttgggctaagatagtcaaggtagtaagaaaaacaaccctaaatatataaaaaaaaaactactagaacttggaaactaattgagcattatgatagctaatgtttactgcgtgcctagtatgtgccacaagctattttaaacacttcaaaatattagctcagttctaaaaatgctctgaggaggtactattattgttgccatctcagagtctatcatctcaaacagacactcaacgagatagaataacttgcctgaagtcatataactaaggccaacaggaactcaaacccaggcagcacagtaccaaagcccatgtgctaatctaccagactatattgtcttgcccctcaggaggaggttagggagcaatcggtgaggattcacaggtctggagaccaaggagggcaggaggagcagaagtgtgctaagagaaaatgatgctgtgtgtcctgacatgttgagtctgagcttcgggaacatcgaagtggatgtggcctatagggagtttgaagttggggcctggagcttgcccgtgtgagaggatctgtttgaagacaaagatgtgagagtcacctactgcataggagatagttgagtagtttatcagcatcacccttttgagtggtcaaaggtgtggtgactctggtcagagactgcctggcatagctgactaggaattggagaagcgatcagtctggcactttccagactggggtttcagcaagtgttgttattgttgttataccagggcattctgtctttgcagaaagacactcaggcacctgctgccaccaacaattatttcccaagatctggaaggcaaagacatgggcttttccttttaaccttatcactgccctgtctgccatgcttgactcttcttcatttctctgtgacagacatcatgatataatagaaaaagttccagagttggagttatgcctgagttgaaatcacagctctgtaactcaccagctcagtcattttgtgtaagttaattaagtcatttaatcttaaatgtattttttaagctgtcaaatgggaataatacttttttcagaaggttgtagtgaaataactactaaaacctttagtaaatgttggttacttgcccccaacaattccatcttctttcccctggggtggtttaagcatggccacaaattatttgatctttcctcattaagagttgggggttatgttccctccccttgaatctaagcaggctcatgactacttcaaccagcagagtagggtggaagtgtctttttgtgacttctggagttagatcataaaaaggtgatgtagcttttgcctgtttgttgaactgcttgttcctggagccctgaaccttcatgtaagaagtctgaccatcctgaagccagacgccacagctgagcccagccttacgaccgtacccaccaaggcaccgggcatatagtacagctgaactggacctttaaaaccagcctgtctgccagctgaataccaccaagtcatctccattgacactacatgggactgaaggatcacccaatcaaaccctgtccaccaaatgtctaaccccaaaaatcatgagatacaataaaatggttgttacatttccgagtagttgataactcagcaatagtgaactagaacaatcacttttattccaatccctttaattcttcctcctccacctgcctgcttactggaaatagccagtcctgagtgtattctgatttgaatcctgttctaatatttcattgtgcaaaatgtgatttgagggtaatttcattttatctccttgagcctccttccttccttcttttttttctccctttcctccataagaattttcagagtgttttcattgtatcagatgctagattgggcatggtcactttcctctatgtcagggattagcaaaattgtttaaaagaccagaaagtacataatttaggtgtgcagacaagtacccaaatgtgccgctgaagcatgaaagcagctatagatgtaaacaaataggtgtggctatatactaatagatgttcattcatccaaatgagttttgtattcatttacaaaaatcgggagtaggttagattgggcacccaggccatagcttgctgactcctgctctaagtgcccaacacctggttgggaacatatgtatgtgttcagatgtcttcccaggccatatctggtacgtggcaatgctattcagtagctagagaaagagcctccagccaccccaattcaaaaaggacctggaatttaagtcaagtcttggctgacagaggaatggatgttcatacttggagatggaggtgcagaggcatgtagtcccagagcgcaaacagggatgtcaaagcagcgcagggagctggagatgaggatgggctgagcagaaaagtgagagatcaggcagaaatgctagagagccttattttctaaaattgacagaatgcttcttctgctcactcatttttctctccaaggagttgaaggacaaatctgataaggtaaaaatggctgtgagctctgcagatgcctgccaggtattactgaagctatcatctttccttttcagaaaaatagctccttaaagtagatgtcttcggaacacaatgtaaaacctcttcccctccctctagcatagcaggaattcacaggagggaaccagaatagcatgtcatgttctaacagctcttccagcagtgagactaaatacacataaactcttctaaatttgtatctgctgcaaacatgaacaatgacatcttgtcattctgctacgaggttcatctggacaaattatatgcagcgaaggacacactccatcactttcctgactttttcaacttcaacatcagaccttcatgtcccgaaaatatctctggcttcccttttattcttctttaattgatagcactgtcatgaagtcagtgaatccagattgagagagaaatagaaaatttagaggagataaaatgcaagtttttctgattatctcggctttgactcttcaaatcagcacagtttatctcagttaaaggggtttatttgaaggctatccatggcaaaaaagaaggaaaaacatcttttcagaagctgcaaagccagagaatctcacgaagaactaatgaagtggagggtagagcagtggctttaaacctgcagccaaagttctggaatctcaaaagcaagtgagctatggtcctgactcggttcctccatccacctgcttcctctcctgacccttctccctgcttcttttgatgggtcagtttgtcttattgttttcttactgtcttcttccttcatgtcttttggtttctactcccactgccaactcttcactctctctttctagctctctcattcaaacttcatatgagaaaggatatgagcacaatagtcaatcctatcagagtagaacatactggtgggaggaatggtgcaggactggctaacctataggccatagcgtaggagcagcactcatcctcggttccatcagctgaggctgggggtgcaggtcaggagacacaaagcctgatggcttacacggctttcctcatggactcttcttcacaccacagcccaatatacccatgccccactgtcaagccatgggcaccaacagccaatgctctgggacctacctctcttgccccccttctgatcctgagcccaccagttacctgactgaatcctctctttatttattttttatttattttttgagacaaagtttcactcccgtagcccaggctggagtgtagcggcatgatcttggctcactacaacctctgcctcctgagttcaagcgattctcttgcctcagcctcccaagtagctgagactacaggtgcacaccaccacgcccagctgatttttgtatttttagtagagatggagtttcaacatgttggccaggctggcctcgaactcctgacctcaagtgatccacccacctcagcctcccaaagttctgggattacaggtgtgagccaccacacccatacagaattccttctttatcatgattctatttctgaacacttgtatatttgaagagacaaagctgagacagccagaaaaacctgcattgtatctcagctaaattttctatttctttctcagtctggatcgctgtcttcatgacagtgctatcaattaaaggagaataagagggaatctttatcatgattctattcctaactacttgtatatctgtctctccagcttctgactcttcaataccctccaaaggctttgactcaggtgtactctgccaactctctccgttgcacattgcctctgaagtaaaccctgacccagtgaatccaatgggagagaagagcacaggctgagctgttgtcaaagaaaggcccccaaagtacagagacttaagtaaacatgagcttgtatctctctcaagtaatagtgcagagggaagtatatcgtgaacatggcttctgtctctgggtccaacgtggctgctcccagctaatgccttttgtcagccaaaagaaagaggggaaataaaaaaggggagcacacactcttgcaaaagggaaaacccagcaattgctcgtgttacttctgctctcatctgacaaaaatgtcctggtggccgggtgcagtggctcatgcctgtaattccagcattttgggaggttgagacaggaggatgccttgaagccaggagttcaagacaagcctgggcaacaaagtgagacccccatctctacaaaaaaaaaaaaaaaaaaaaaattgccaggtctggtggtgcacacctgtaaccctagcttctcaaaaggctgaagtaggaggatcacttgtgcccaggaggttgaggctgcagtgagctgagattgtgccactgcactctagcctgggaaacagagcaaaaccctgtctcaaatttgtcctggtcacatgccccacctagcctctaaaaaggctgagaaatgtagacagacatgggcagacatgcctttctaaaacttggagtggggtgggtggttagatcattcaattaacgaaagagaatagatcctatggaacgattagggggctctgccacaggacaacttatggctgaagtccatgggctgatccagatttgatgggactaaagtttctgcaactcctggggtcctctttaagatacagaatgcaaactgaaaaccacaaaattacaaatacaaggcctttgaaggggctcatgctagcgaggggccaggaaacttaagctttattagcttcgtgataatagcacctctgcttggatttgctaatcaatgtccgaatcacgttcttctcactcccacaaaaggtagtttagaccattttatagggtggattttgtaaactttcaaggtcagtgccaaatgtggcagcaacattttgctaaatgatagtaaaacaaaacaaaacaagtcttaaatttcctcttcctgatgttttcactgtagttcttaaccatgcaatgctgtttgctggtgggctgtccccagcaagggctgcaaaatgctgcctctaatggtgtaactgcgttatagtcatacaacctgctgctgtgatttctccttgggtgcagcctacttcccagcccctgattggtggacagacccccttatttatgggcaatttttctgtacggacaagatagcacaagaagcccgtctggcagctgctcatggaaactcttgctgtgtcttcattttcatatcagtaagcacgctgtaggagacgaagagcagactgaggactatggcattatcctatgcacagtcaatcaagaccaggctaattagatttttcaggtgcttggactctgtgggaccacatattacacaaatacatagataaacattcccatccacgaggaccaaagaattgttgaagatggctgcaaaataagtctctagcaaaggcttcattcaattatctggcttatgcattctttccctctcttttaggaaacataatgaaacctcaatacaattgaagtgcttggacttgtgtattattaatgagtttcacccggtatagcagtgttccccccaaaatgaaaatctgaaaacatacatacctgaggttagataaaatcaaatatataaatactagtacattttggaaaatatttaagaatagtttgctgcgagggataatgattgctatgcatatctatgttcatgccatccctcaactacatttaatctctctaactttgtttttatttttatttatttacttattttgagatggagtctcactctttcacccaggctagagtgcaatggcatgatctcagctcgctacaacagccacctcctgagttcaagcaattcttctgcctcagcctcctaagcagctgggattacaggtgcccgcccccacacctggctagtttttgtatttttagtagagacgggggtttcaccatgttggccaggctggtctcgaacttctgacctcaggtgatccacccacctcagcctcccaaagtgctgggattactggtgtgagccactgcacccagccatgactttatattagaaacaaaattatgttcttcattcattaaagctagagcctactctggctactgagaagccattggtctgatgatgagcatatggctcacacataggcaatcctgcttccaatggccttagcatacccctgaaggctacaccgatatctgtgtatctaggagcattatggtttcatgattctttcactttgaagatggacacctgggtacttcatcagcatgtcatcttatgccttgcatggattttcctcagggacctgtccttagtcctttcctcctcctctttcacttaacattcatgtgttgatttcctgtactttatctccaactcagagttcttttttttcctctctgaattttgaatagattctatgggataactccactagcataccagtgctacaatctcaatagtttccaaatacgaagtcattctcttacccctctggcctttgtctctcatattccatatctatatgaatggctctgtcattctaccagtctgggaaccaaacttaacccttcccgcttttttatctttatctttatgttcaattagtcactttgctgtttaattcttccccactaacttttctcacatcccctaatgttcattctccactgtagagatctctagctagaattccattatctctcacctagatagatgactgaacagctctcttgtctccctgcttctcactcccagagtgattttttaaaagacatgttactgccttgtctaaaatccttcacaactggggagtttatcctcatcttttaggataaagccaaaggttcttagcatggcaaaaaatgcccttcatcttctgtctcttgtttacctatttggcaaaatcaagctacgtcatagctcagaaaagtcaataatctttttgttttctggaaatgtaggtgcctgtctcttcttcacttggaaggcactatcactatcaccacctccaagacatttgctgtcgccctaccacactgggtttggtgtttttctctgtgctctcataatccttgagtcttcctgttccatggtttctgtcacaatgcgtgttcttatttgagtcccctgcacttacactaaacccctgaacacacttgctcatatcagaaatagacactagccttctttgtgttgaccacatcttagcatgatacttattcataaaaggcactcaagaaatgcctgttaaatgagtggattttgcagaagagaatcatggacagatgctccttgacttatgacaggtttatgtctcaataaacatatcataaattgaaaatactgtaagtgaaaacacacatgacttatgacattttcaatttgcaatgtatttctctggacataacctcataagttgagcagtgtattatttaatgggtattgctttcacaccagcctaaaatcaaaaaattgtaagtagatccatcataagtcaggggttgtctatattagatagatgattggaattgatggctagaaatttcaagaaattatgcatataaaattcactgggaagattctgttctattgtttaaggtatcattctcatactctcaagtcctagtttcttatccctcaaacaataaatgctcagtgaatagttcaatgaactatgtagcacactgagaaggcatagaatgtaaaattgtctacagcactctctccaccctcaagaatctcacagcccaggttagagacatgaataataacaaataattatattacaatgagacaatagctaagtaatacagttaatatgggaaaccaaagaaggaatccttattttttagggaaagaaatgaggaagaggtcatatttgaatcttgaagactaggttggagtttactgggataagggatttgggtcccagctgaggagtacatgacacagaggaaaatcaattcccacatttggaatatgactaaagtcaaggacatgggggtgggagagctcagctgggacaaccctgaatggtaatgcaggttatgccaattagtttggactttgccttttaggagatgaggaatcattgaatggttttgaacaagtttaatccaatcttcattactgaggaagcttttgagtggctatatgaaagattttagaatgagaaacaagaggcagcagtaagaatgaggagactattgtattccaggctagagattactggaggcagcatatcctagtggttatgtatgtggactcctgcattcaaatcccagctgtgtttgttactggcttgggcaagttacccaacttctctgtgcctcaatgtcctcatctgaaaatggggattataataataattgatgagattggctgcatacgattaaatgaaaaggtacataaggtgcttagaacagtactcacctaaaaataaaaacatttactttttgtatcctatgagagtctgaaccgaagaaaaggatgtagcatggaggagacatgtccaagaaatatttagcaactaaaatggaaagcatttggagtacgatagaatatgggagtaattaagatggagaagtcctagatgatcccttctttctggcttgaatatctgggtgagtgatggtaccctccccaggaggaagagcagagattttttttgaaggtcaggggttattagtgtgtttgattttgtaaatactgaatccaaatcacttgcagcacattcaggaggatttatcaaataggctgttgggaatacagatctgtggttctgaggagagctcttccaggcagaagaaggaaatgtaggttccatctgtctccaggtgaggattgaagctatgaaagtgtggtttcataaactagatggtttaaggagacaatataaactgagaagggagttgagagcaggactctggggtacactgacaccaaacctgtagctggggtaaaaggccccagagaaggagactgagcaagatgaaacaggaacaagaaaagcatcacagcagaataaattaaagaacgggtgagaccacctgttgcttagcaagggcatgaagagtagatgcctgataatatactgtaccagagcagtgactcccaatttcaaattttatgaaaatgcttatttgctgcaggctgttttgttgagtccagtctcaaatctttctagctacagatttgtactaatttgcatggatagattgtatcctagaaacaaagcaaatctatgatattgtagctgcaatcatttaattttccattccagaaagcaggttgtagataatttggttttctagcaaatgcttattctttgttaaatcaagagctaaaacacctatgaagattaaatcttcaaaagtgcaattatacaaatgatggagaaggagccatgtgattctttggtttaactttttaatagttcagaaattccccagtgcaattcatttgagccaacacttagtctaatacacaggaaaaaatatgtatcaataggtgatactttctcacaaggaaatcagcgatcccatagaattctcataattagaaattatccttcttagggtttaatagaaggtggaatcagaaattctccacatagaaatgcatctaccaagaattctaagattttaagaaattgcaatttaatgttggaacatgcacagtgaacctgtgtgtataattttgactttcatttactcacaatacatatattgaaatactgctttcaccaggcactatcagagttcagggcaaactatagcatgcaagactgataactccatgcctttatggagctcagcctgctgcaaggacagcaactccagaaacaaatagaaaaacaaacaaagattgttttaatctgtaataaatgttgtgatggaaacaaggggctaagtaagagaattacagagaaagcttattttagtaaggatggttgaaatggagcctttcttaggaggtgacattctaattaaaacataagaaggaagtaaaccctggaaagaatgagtgaaaagattccaggaagtggtaacagcatatgtaaaaccctgtttggcaattcaagaaacagaccagtgtggataagatttagcccattgcagggactgagcagggtaataggaaaagggggtcgtagaggggagattgctgagaaatcatggtaaagatttgaatgtttccctaaatgcaatggggagggtttacacggggaggaatagggcttaatgttttaagaactttatcattcactgggtgcgatgctcatacctgtaatcccagcactttgggaggccaaggtgggcagatcacttgagctcaggaattcgagactagcctgggcaacatgctgaaaccccacctctacaaaaaatacaaaaattacccgagtgtggtggcatgcacctgtggtcccagctactcgacaggatgaggtgggaagatctgggagcttgggagatcaaggctgcagtgagctgtgatcacaccactgcactccagcctgggagacaggcaagactctgctcaaaagaagaaagaagagaaggaggaggaagaggagaagaaggaggagaaggagaaggagaagaaggaggaggaggaggaggaggagaagttgttatttcagaagttgtgtctaattgcttctcagaggagaatggattggaagtagggcaaaaatggaagaaaatagttcaattagggggctgttacaggagtccaggcaagagatcatgatggccaagactgagatgaaacagtgggaatatagagaagagaatggcttaaacagatattttggagatgcaattgataggacttgttgtggaatagatgtgtgggaatgatgaaagtgtagaatcaaggaatgaagagtgactcccagaattctgtcttaattaggatggttacttaattaatggaaggtgatgccatttatagagatgcaaagtgacaagagacacgatggggagcagattgctcaagctgtgtttgatctatctgtgtgacatcaaggggagatgctgagaagacggttggtggagtgagtctggagttcagagggaaagtaactctaggaatgaaaatccccaacttacatttttgggcaaacagagtccctggtggaaaactatttatttatttatttatttatttttaacttttgagatagggtctcactctgtaatccaggctgaagtgcagtggagtgattatggctcactgcagcctcaacctcctggaatccagcgatcctaccagctcagcctcctgagtagctgggactacaggtgcgtgccaccatgcttagttaatattgtttgctttttatagagttggggtcccgaactcctggcttcaagcaatttctcctgactcagcctcccaaagtgctgagattacaagcatgattcactgcacccagcatctggtgaaaaatttattccaaactatgctctttatgtgtcccatttgcagaagcagtttagctttataaagaaagtttcccctgcccaacttttagagccacatggaatcccttagtcatgttgacaatacctgtaaggatgaaaggggagtcagtccattatcagaaacaaatggcaattgtatgtggaatccaggcaatggaatcaagcatttatttttcccaacgtatcatcctatcagcttgcccagtgtgtatctagagtgggtattaggacaccctcttctctctgatcttcatctttcttctttttccctcctcatcacctttgtttattcctctccatgaacctggccccatcccagaggtccaaagtctctaagcgtcatgtagaggcttctattatgtatttctacactggtgctttgtcaacattagtgtgcacacaaatcacctgtggatttcattaaaatgcagactttgattcagtaggtctgggctggggcctgagactccgcatttctagtaaatttctaggtgatgctgaggctgctggtccagggaccacatctacaaatggtagccacgtctcagagcataattttcatggcttataccaatagaagtgtaattttaacttatttctttgtagaagtgaataaatggaccaggctaggaaagaaggaatcaatatgagagaagaaaatctcatcctgacacctgtatttgagcctcttttcttcacatttggtcctcaaaaaggcgttagaatgaaaaataatctttagaatctaaactccaaaagatcacacacctgattaataaaatgcttttcataacttgaaaggttatttgaatgtgtccatgtggaccagacctgggttaaatgttcacgctgtccagatcctgcaatgcatcatgggctgtaggggcaagattctttcctcgcatgcccccaactggtgacaggtggttatgaacctaattagcagctaagagcactaggcactgctttgaaacttctcataccttatattggtcagatatttactcttgttcttgactagtttgggtgggagattcagtccatcagaaagagagcttcctcatttctgaactgctaagttgggaaggctgcacctccatcaacccaagtaagagaggctcaccttcaaaagtgcattgatgggccagatgcagtggctcacacctgtagtcccagcactttgggaggccgaggtgggctggtctcttgaggctgggagttcaagaccagcctggccaacatggtgaaaccctgtctctactaaaaatacaaaaattagccatgcttggtggcacatgcctgtaatcccagctactacttgggaggctaaggcacgtgaatcacttgagcccagaaggcagaggttgcagtgagccaagatcacaccattgtactccagcctggccaacagagtgagactctgtcaaaaacaaaaaaagaaaaatgaaaaaaagtacattattggaatggctctaacagtcctataaacaaaattttgagaaaggaaatggattttacaagaatgcagttagggttctctgttacatttagtgacaaatattgttattgttttcagcatatagcttagatagtaggtgctagctgactggctggctgagtgagtgaataaacttggcatgagttgggaggcaggctggtatcatccaaggcagctgtactttagaggcagacaggctttgccacactgggattctcggaccctctgcttttgcatctgtaatgccagaacaatgatatctctctgggagggtggactgaagattggagataatgcatggaagcatctggctaactaattagcatggataatttgattgctttttgatggataattgatggataatttgattgatttttattatcatcatctcaggctccttacttggctccttgggctgtcatccatcccctaaatcgcccaattggggcttcatcctgccccctcctgtcgccatctggtcattcatctgctaggctgagtggtttcactcatcaccaccaatccctgccgacccttcaccccagcctgcaaagccacttccatccttcagaccctccaacttccctaccattcctccaagtaatccagattttgggatagttccttcctgtctagcactcttttgtcttctttctttgccttctcatctctcaactataggtgatatttgtgaggtagtaaaaatataaaaatcagctggatgtggtggcgcctataatcccatctactcgggaggctgaggtgggaggatcacttgaacctaggaggcagaggttgcagtcagtcaagaccgtgccactgcactgcagcctgggtgacagaatgagactctgtttgaaaacaacaacgacaacaacaacaaaaaagaaaacagaggaacaaatttgagaactcacggtgcctgatttcaagaattactataaagccacagaaatcaagacagtgtgatactgagaaaaatataacatatagattaataaaacagaacagagagcccagaaattgacccacacataggtggttacttgatttttgacaaagatacgaatgaggtagaaaaataagtctttcaataaatggtattggaacaactggacattcatatgctaaaaaaagagaacttcaacttatatcctgtattgtataatacaaaatagttaacagttaactaaaaatgcatcgtagactatcataggcctaaatgcaagaagtttcaaccataaaaattctagaagataccatagaaaaaaaatgtgcaaagatttaagcaaatacttaaatctttggcttaagcaaagttttcttagatatgtcactagaaatatgatttataaaagcacacactgataaatttagctttataaaaatttaaaatttctgctctgcaaaagacacttcagaaaatgaaaagacaagctacagactggtggaaaatatttgcaaatattttcctacataaatgacttgtgtccaacaaatgacttgtatccgtaatatataaagagcccacaaagctcaataagagaatccaatttttaaatggccaaaagatttgaacagacactttatcaaagaggatatatatggagaaaaatacataaaaagatgcttctcataattattcattaggaaaatgtaagttaaaactatgatgagatacaattttgtatccaccagatatataagtctgacaattccaatggtacagaagatgtggaaaccgaaactctcaagcactgttattgatagcagtataaattgaaacaatttctttagcatgcaatttggcactatctagttaggttgaagattcacataatccatgaccctgcaattctacttctagatagagaataattcttgcacatgtgcacaaagaatgaatacaagaatactaggtacagcattttgtggtaatggaggaacaatgtagaaaatgtccatgaacaggagaatagacaaattgtggtatattcatacaatgcatgctacacagcaagggttagcaaactatagcccatgggtcaaatccagcccattacctatatgtataaataaacttttattgaaacccagccacacttgtattcactgatgtattgtctgtataactgctttcgtgttacaacagcattgttcaatagttgcaagaaaccatatgacacacagagcctaaaatatttaatgcctggcctttaataagaaaagtttgctgacccctgatccatagcaaaacaaaaaaagtaaatcacagcccaggcaacatggtgagaccccatctctaaaaatcattaaaaaattttgccaggcatggtagtgggagcctgtagtcccagctatttgggaggctgaggcaggagaatcgcttgagcccaggaggtcaaggctgtaatgagctatgattatgccactgccctccaccctgataaagcaagattctgtctctaaaggaatgaatgaatgaataaaatgacaagtatattgcatcagtcagagcccaaccagagaaagagaactagtgagagatatatattaagaggtttattccaaggaactggcttgtgtgtgattgtggaggctggctaggcatgtctgaaatccataggggagactgtcaggaagggcaggctggaaccatcagtcctaagctgaagcttggttcacaggtgggatctcttcttctccagggaatccttggctatgcctttcaattgcctttctaatgcctttcaaccaattgaatgaagtccattcagattatctaggctaatcttctttacttaaatccaattgattacaggctttaatcacacctacaaaataccttcacagaaacacctagtgtttaactgattaactgatctagccacgctgacatgtaaaactagcaaatgtatccacatatatatccacaaagataaatctcatatatccacaaagataaatctcataaatgtaatgctgaacaacaattaaagttgcaaaatcatacataagataaggtaacacttatataaaggtttaaaatgggcaaaaaatttaacaaagtttatgaatatatggatatataaaaacatgtaaaggaatgataaagttactttatgttactgagtgccactgggaaggaaggaaaggagtgaaattgggagtagttttactgtatctataatattctgtttgtttgtttgtttgtttgtttttaaaggcaagagactccaaagtaaatcaggcatacaaaaatcttataaaacctggccctgatattgtaattgcttattgtattattgttaatacttgggtgcgtgtgtgcaatcttgcacaatcattattttttaaaaagcatcatgattaaccccctttgcacaagcctaaaaagtggtgtttatactgggtggtcaactttgattcagaactacactggataggaccagacagtagaggcttcttttttgttttctaaatgctaaacaacactttggtggatgctctgggttttctttcatggtccagtgtttcagggaatgaacctcacctcctgggagttgagcctggaaaatcacagcattcatcatgctccagcctgtgcccagtggagagcacagagcagggtgagtcattcttacttgagccccgaccttggctgaccttcgtagtgccaaggtctggagccaaatgaaactcctgacttaaggagctagagataaagaggcgggtggctggtcacatggtacgtggccgctgatggaatgtgacttgtcagaccccccccagggggctttcagtagggcctgcatttgtatttattataccaagagacataatgctgagagttcttcctgaagaacgtcagacttctgatttaagaagtggttgtatacagatccaaaggttgtaatctgcaacatgcctgcagaaatttatcaactgacatttttgtatggcatgccaacgtaagtctttttgcaaaaattaaactcttttaggattaaaaagaacacatgctatttgtaaaaatttggaatatgtgaaaagctagagagaagaaaacaaacctctgaagctcactacccaacattatcagtgattatcttttagcctttttttcccggtgtcatacttttttctgtagttaatgtaccctttcaacaatggttattgagcacccagcaagtaccaggctttattctcggtgctagagatatggaaatgtacaaaacagccaaggtccctgctcttggggagctaataagaaagaagggtagactaaccattgaaaatcagtatataaatatacaagatacatttagatacaaaatggtattatggaaaaaatgatacctaataataccgaagacttataatgtgctattctaagcctttcactcatgtgtatcaatacattgaataaaactgatgtctgtgtgtgtgtgtgtgtgtgtgtgtgtgtgtgtgtgtgtgtgtgtgtgtgtgtgttagagggaaggttaggctattacaggaaatctttcaatgcaatgatcaggaatgtcctattgaagaagacaacgtaggaacgaaggtttacttaaagggaaaaagatggccatggaagacccagattgagagccttcccagcaaagggaacagcaagtttaaataccttgagcataaaatagtttggcatgttcatgaaacagaaaaaagtatgtctgggacttcaaggaacaaaaggcagaaaggtctgcaatgaaaccaaagattgtcctttttgggttctccagggaactcttgagagcagcagaaaaaggcattttttttttccagtggtttcattctcttcttatcccacccactactttcacactctcatttctgtatgaggaaagggctgagcttttgttgcagctgctactcttggaacagttgagaccattaactcacatctcctgcacctgacatgccagcatcctacaggcagaatttaaagcttcggggtcctctttgctaaaatgctacccacacttaagtccacacaaagttgaaggcagctttgcaattgagttttaccaacaatcttaggacccacattattaattgctacacagcaaccactcctcactcagcacttcttcctcagctgagaggcttccctctactgtaaaggctaatgatgccaaatatttttttctcctcccttgcttccagatgaccaaactcagagttgtgtcttggcccttagatttgctacctaaagcccacagcgtggctgtctcagtttcctgactatcattccctacaatctggattttgcagcttgaatgttaatagggtaattcattgcagccctttgttctctctattgcctgtaaaatggtggtcataagcctcaatacacataatctttaaaacaactcaataaggcaggaccattcatgtccccactttacagactaataaactaaggcacaaaaaattatgtactagaggtcatgtagctggaaagtggaggagctagcgttggaatccaggcagaggcttctaaccactatgccgcacacagagaaattatttaaaagacattttaaaattgtttttaatgaacacacagtaattatacacatttatgcggtacagtgtgatattttgatacctgtatacaatgtgtaatgtagaaagacatttatgcaaccccctttggttgaatattgtccaggaacagattattggtttgtttgtaagtctagaaatcaattaactcaattagcaaacaatgatgaaccatctacagtgtgtgctgggctaaaccgtgggatacaaagttgggcaacatgacattgaagatgatgataactggtgtgctgagagcttactgtgcaacagcccctgacccaggtgctatggatataatggggagcatcatagtccaggtgaatttcatcacagacctcaatcttgtaggagagaatcaaccgtgaaccaagcgctataatgggaattgtttagagttgtgcggtccagtccgggcatcaccagccacatgggactatttaaaagcaattaaaattaaataatacttacacatcagtccctcggtcacattaaccacatttcaagtgcacatgtggctcgtggctacctataaatagcacagattatggaacaatattcttgctgaacgttctgttggatggcactggtttagagtgtttggaagcacagagagacatttctcatttaaacttggaggtgaggagaggtgtcaagaaagggatcctgaacaaagtaatgtttaagctgacacgtgaagaatgactagttttaatccttactagagttctgtgaaatattttgtatctctacttaatgaatgagaaaatggtctccaggaagttgagaaacttgcctgaagttgcaagaaaagggtgagagagaatatttgattcccaaatccatgcttgaaacactaacagtcactaaagcaaccatggacaaaagagatctcttttgaaagaaacaggtagcaacttcacaaataattgtttgaagactttgtgctgtattttaaagcactctgttaagtattaatgtaatatgaagtttccaaaaacaatttaaaaaacacagggcttctcaccacatggagtctgccatttcacggagagatagacaggtgtctatgaaatgttggcagaacaagtgaattctaagtgctataggaattacaggaggtggtaatgtcttcctgtgaagacttcctggaacagggaggaattaagaggggtcttaaaactgtgtagaatgggcatatcagagcattgcaggcaggaggaaagtttgttggaaggctcaggatgggggcctgcaagatcagtgctgagaatgggaataataccttagtcttacgttgggggtttgttcagatgagacaactcagtcttttctgcaggcatgggctttcaacacaaattcttcttgaacaatatttatgggtgtgtctataaatattggttcaggggcagggcagagacatcactatttccccttcagggaatttccctcagagagcattattgacatcacaacagaattcgtggcttcccagaggaaaagtcttcaggaactcacaagagagattttcggggcaacccttctttgctttcagcgtgtgtttaacagttcttcccctttctctcatacctttcttcaaacctgcaaatgaatcccagtgctagagagtacagaattacttgtgggaatttaaaatcaatacattgttatgcacttaagttcatgggaaaaataatctaattaacaaatatctgcactgacttgtgagctatgtgaatctgacaaattaatactatacatggcattttatatactcggtttgctgttcacatactatctgttgggttctacttttttgtcttaacattgtcttatgtacaattttcttggcacatcaatatagtccaaataagaccactttttaatgatagtttataacaaaatcagtcttcaattattggctagtagatttattgcctgatagcattttaaaaatatcagtgcaatgaatagttttgtacaatcattttttaattacatatttttgtttttagagcatattctctaaaatgggatgactagaacctaggtttaatcattgtatgcctcttgttagttgttctctaggaagattataccaatatttacctagtgtatctgtcctcccaaagccttgtcaacactggattttgaattattactttgctcttggtaatttaagggaccttacttcgactctctgtctcagttgctttatctgtggatgtggataatgagttttcagggttgaggattgaatgagatagtgcaggcaaagcatcggcacaaggcacggtatatagtaaataggccgctaatgtctattcttcccttgtaaggagtatgcaatgggaatttagagctgcttcacgttgggttttttgttgtttgtttgtttgtttgctgctgaggttaagcatttctttcaagtgattatgtatcactggaatacctggggtgtgtcttaaagccactctccctttccactcttctctatctcctctgtcccacagtatgccccagtcctgaactagactttaccatcctctattcaccacctggtccaagatccaaaataatcaccatgactagacttgagatacagtgctaataggagacagcagaacatccctacaaactcagagttctagaaccacacattctccatgtggaaaggaagtcccagtggttgtctgtccaactttccagtgatcatctgacagattcccatcagtagatgtgttctcttcttaaaatatgttaaataacacccctcaagtaaattctatgaagaatttaaggtgaggctagaatttggcctctttattcttggtacctaggcaacatggtcagtactcttacctaccatagtcaattctcagataatcgtgttatcacttagccaaattttgaaacatctttgagaaacattgaattaagttcttaatgtcataattaaaccgagtagagagcattcttctgttgataggactcaatattttatttaatgggacttctcccatgtagtttacagccacgaaacatttaaagtctaccttcttctagataagagctggtgtctgaaattgataaatcaagaaatagaagcttgagtatgttatttgaagttataaaagtagaaactattaccaaaataaattcagaaaaattggaaagcagaaagggaaagaggatgtgggagacagtcaaactgtgtcaactttcttttcttttcaaagttgagtgttaaacatacttttaaaaatgacagctcaattaagagattgaattatatattaaataatatataattatattatttaatgttaaaacggtaactactagaagaataaaaaaccagaatcttctaacagtggtcttcccacgaggctagaaccacaagttggagggtagataagaagaaaaaccttatgtttaattttagactcctctatatgctttgaaatttttgatacatgcacattatcttttccttttttaaaaggtgctttattgagaaataacttacatatcattccattcacctatttagagtatacaattcaatggttttcggtatattcacaaagttatgcattcgtcattaactttagaacatttttatcaccttccctacccccaatcctgtacccgttagcagtcactcctcattttcctattatgccccctctccccagccagaggcaacctctttctgtctctgcagatttgtctatactggatattttctataaatgtaattaaacaacatgtagccttttgtgtctggtttatttcagttagcataacattttcaaggttcatccacattgtagcatgtactgatacttcattcctttttattgctggataatatctcattgtatgaatatacaacattttctttatccacttatcagttaatggatatttaagttgtttccactttttggctattgtgaacaatgctgctatgaacatttgtgtacaagtttttgtgtagatgtatgttttcatttctcttggatagatatgtaggagtggaattgctgggttgtatcttaactctacatttaaactgttgaggaactgccagaattttttcaaaagtggttgcttctttttcaattctcaccagcaatggaggagagttccaatttttctgcctcttcaccaacacttattattatctctctttctgattctagccatcctagtagatataaagtgttgtatagtagatgtctttgtagttttaatttgcatttccctaatgactaataaagttgagtatattttcaaatgcttattggtcatttgtatatcttctttgagaaatgtctatttagatcctttgccctgtgaacattattttaatctagaaaaactgtaagatatttgacagcatggtaagcaaataacaaatgttggacctggcagtctctgggtgaagaaaatgaagagtgatttcttttttgtttttctaaattttcctaagttttaaaaacaaacataattttttgtcatcttcaaatatttacatttttcctcaatttctttatctttttctgatttgaaaaattagcacaagaaagttttgttaaagaagatacaatattaacctagaggcaacaatagctaacatttcggaagatttcttttcaggacttttctcaactttgcgtacttttttgaggttgtagtatatgtacatgttcaatttatgccttttattcttatcaggatatcacagacaaactcttgcatattaaataaacctcttatttaattttttcatctgaaagtctgtagaggaaatgccaccatatcgcttggcatgcagaatggtcacaaagaagggcttctttcatacattcattactccaaaattaagaaaaaactacacaaacatgcaacacctactgttcccaacctatgggcaacacaaacctaggacacagcagacttttaagaggtcatcgcctagtcctttgctgtagtctgatgttctctgcctgcttcacactggaaaagacagacagttttaagtagtatgaagatgctgggcaactctccaatactttctaacttgtatcttcacagaatagctttgccttttgggttaaattatttgtaatctccaaagcactgccaactcccatatttttccttaaaatatgtgctataaaaagctgtattcctcttgctttccccatcctgtttctctttccctcattacaattattattcctgaaatcacccatgccatcaggacaagctgactgcaggtagagggatgagttatgtttctcttcactttttttcctatcccaaaggctccaaagtttctggttgcaacaactttaaaagctgattgcacagattccattttctcctatggtaatgaaattaaatagtctctcatcctggcaagagctccagaagaatacttcttttacacttgctttaaatgttcaattttctgtaccaatataggctgctgactctttaagctcccatgtatgtccacaaacacttcaagacagcagtaccatccaaaaccacacacatacaacaggctgcttccaatgtgaaaatccgggggaaataccaggatatagcacagaagaagaatcctgactactaaagactctccctcataagcctccagtcatagctgtgcaagattaaatgtaagatgaatggctcgtgtttaattcagtgcatggggctgagaatatagtgctccccagtgtccaggctcttctcttcttcccaggcacagcgcttacatggagttttccagaccccttgcaagtaggtggggctgtgggatcaatttctggccagtggaatgtgagtggacgtgatgattgccactcctccacctggcattctaaatctttcattctgtcttgcagttcaggaaggatttcagaggccacttgttgaagataatggcgccatgagacaggaggagccagggtctctggctgattgcacaaaaccagccccaccaccaaatcacactgaatgttgacatgaacaagaaatgaatctttattatactaatccactgaggcttgcgggttgtatgtgaaatccgtttgcataccctgattaacacagctccttttgcttttctcccatcccagccaaatattttaggttgctgtgacagcttgctgacaacatcttataaggggtgtcagaacaggaagctccattttgctagcaaaacattcaaattcaaatattgtcaggaggagacagtcttgctagtaaggttccacctaaatggttccaagtcaggagagtcactaaatgttttgagaaataaaagtgaaaatcaatgtgtcttcccagtgtattcacatggcacagtgtcacagagggcttgagcgtctgagcgtggacttcactggttgactaacgttaacatgcatgtctgttcaacaagtgtttgtggtgtcatcagtgtcacacatgctaccttccttcacaaaacaaagctgagaaagtctgagtctttgccctggaagtttccctccacacagggtaggatctgcctcgtccactgtaagcaactgagccctccctgaaatggccccaggaaggtgtcagctatgtcttgggcagacagctactgcctctacttaggaagtttgagtgactttgttgaattcattacctttccttcttttgcagccatcccaggagctgaaataccatcatttcttggtattcttcctagaccagtcacccttttatttggactaatttgatgtcaaatgtttcataattgatgaggattttttaaaaatgttttgagtaggtagaaaacaaactactttgcatgttataacaaagaagggttgagcatgaaaaatctatgctcaatcatgaagacccctgggcatattctgctgatcacttcctgctctggggataaaatggcagcctagggtttgactcctggttccagagataatttctgtgaccttaggaaagttgtttcgatactcatggtataatgattgcaataattattttggtgtgtgttgaggaacactgctgactcacttctgcctctttcctctacctcaagctttaaaactggcctctccaaccaaaaagcggggcagggtgggggtgggtggcgcgacggttctctctcccttatcaaggccatgactttcaacttccttaaaacccaggttcagacttgatatagaaaatgtgtgtataaattttgcatgctttaagaatctttctgaaatgcagcttgattctctatgctatcccggcaattctctattttttgtcctttctctcctccattctgatattctcttgcttcttgttcactcctcgaatcaatcattatttggttcatgttgtttttgtaacttgtgggcaaagtgaaaactcaccttaaaaaaagtatgtatgtgggtcagtttgtaacgagaaaaaatgttaaagagaaaaggagtaactgaattcaaaagaaaatagattatacaggctggtggaaattagactggtattcttaatggtgtatatatatttttaatgttagaaacaatataacatcaatttttttaaaccttagaattctcccaccctggtatactatgcagccataaaaaaggatgagttcatgtcctttgtaggacatgaaaccatcctttgtaggaatgaaaccatcattctcagcaaactatctcaaggacagaaaaccaaacaccacatgttctcactcacaggtaggaactgaacaatgagaacacttggacacaggaaggggaacatcacacatgggggcctgtcgtggggtggggggaggggggaaggatagcattaggagatatacctaatgtaaatgacgagttaatgggtgcagcacaccaacatggcacatatatacatatgtaacaaacctgcatgttgtgcacatataccctagaacttaaagtataaacaaaaaacaaaaacttcacatgtgctctctagatcaagcttatctgttaccttcatacagctattgagtcggttactgaggatgaaaaataaataatattgacaaaaatattacaaaaaaaaagaattctcccaccctaacatgagaactttaaacattgttcttttccaggtatttatcgttcatgtgcattattttttacataattataatctccatatatataattttatgtttttgctatgaaattttaggcgcacattgcttagctcttcttcctgcttcctagatgggtcaccaggtattttggagaacttttccagggtcagacctgtatgcctgctaacactgggcctccagttttcttattgttcttagctgaatgtaaacatcaatgagttttgagaagagctagataataccaacctctgggcaaagaacagtaagttaaataggacatgtgtctggtagatttgcatatattctagcttttaaaaactcaagaaaaaagtactgagaggtattgtaaatcactcatgaaggcttaagatacaagtgcacctcttctaaagggttctgagtctttaatatgcaaactcctccaagccttggcactaaatgtattgcagaaggaacattcctttggcatgttaggcatgtaagggacttttcagagcatcttgtctaactctctcatggtgcagacaaggaatctgccaccaagaaagaatgcagatttcactgttgtggggacagagctggagtgacaaaccaggtcttacggctcctaattcaatgctctttccaatcctgagaggaaagaggaacaaggggatggataggattaagaaagaaagaaagaaaaaaggcagcaaaaaagaaagcaaagctggatgaaagagaagagggtacagggaattaagaagaaaaggaaggcgatgcatatgaggttgtcaagcctttgcttgaatgtaaggttcccagggtaaactggtcctctgaaattagtgtctcaagttatacaggggcatcagctaagcgtttagcctttcttgtctgcttagacatgaagtttctagaaagagagggcaatgtggcaggaggatggtccctagagatttgggaaggatgctggctctacttctctactcttcaatgtcaacgaatgcaatgcatgcctttcatctggattcctgtttttttctcattggaaaaaaaataaaggacagatgaacaggtggaactatccatagctcaccaatgttcctcaagttccctctgaatatttattggacttcagttgctcttgagacatcaccaaaaaaaaaaaaaaatgctaaatgtgcattagcaacttagagaaatgcaacctccggcatttcatagaaaggtccagaaagaatgtgtaactggttcaaagtggcgtagctaagaagaatatatcgatgatctgatgtggtgtcacaaagcacccaaacacgtagtggatgaagtagtcttcaaaaaatggctgctatcagctcttttattcctgaacataacacagtacccctcaagtcagaaggcagagtctatttcccctcctcttgaatctgactggccttgtgacttgctttgaccaatagactgaagcagaaataacattctagaacttccaaactcaacccttaagagaattggcagtttctattcctccctcttggaagcaagatgccatagaagaagtctaaccaccttgctgggaggaagcccaagccagctggatggacagagagaggtcatgtggaggagaactgaggtgcctgatatgtgaatgaggccttcttgaaccttccaattcagtccggctgccagtggccagttgaatgccgtcaaatgagtgacctaggccaggcacagtggctcatacctgtaataccagcactttaggggttgaggttggaaggttgcttgagctaggagtttgagaccatcctgggcaacacagtgagaccttatctccacacaaaaaaataaaaacaattagctaggcgttggggtgcatgcctgtggtcccagctacttgggaggcggaggtgggaggattgcttgagtccaggagatcaaggctgcagtaaactgtaatcatgccattgcactccagcctgttccagcctgtgtgacacagcaagaccctgtctcaaaagcaagcaaacaaacaacaacaacaacaaaaacaaacaaaaaaaccatgagtgaccttaggcaatactcagctaggcttagttgacccactgaatcatgaaaaatagtaaatgactgatgattttggcaactaagttttgggattgtttgttaagcagcaatcaatatctgaaacagtggctttaaacagcaaccatttattgtttctcatgaatctatgagttgggagggtggttctggtgatctggaccaagcctagccaatctcattcagacttgcttgtgcctccacagtcaagtgagggctgactggtcaaggatgcctcagctgttatgactcagctctgctctacagggtctttcatcttccagcaggcttattctggtgatgtcagaattccaagactggaaacagaaatgtgtaaacatttttccagcgttcatttacatcaagccggctactgtcttgttggtcaaagtaaatcatacggttgggcccagaataggagtggactacaaggttagagggaaagaccttggagaaaaaaggaggtcatttattggggggccactaatactatcaaatgtactactaggaacccatgcatgtttctcatagttagaggagtattcaatagcattattaaagttttggactgaggtcaggaatcaattgaaaaaattacatttaaaattaagcaaaataattagatgaatattttctgatttttaaataggtttccagaatttctggccaagtcactattgctcatgatattgatgttgttgtattatttccaatacaggatgactttcctaaatccctgttgatagagttggagatagaatcaggaagaaataccaggtctcatactacatggtcattcattccattaatcaattcacagtaataatgcaatcgtaaggctcttggtagagttccttagaatcctgcttcataaagttagctctctaaatagccagtgggcagtctggttggacacttctctctgaaaacctaaggctgtttgcttttgggctttacagaagtggctcaataccaggctcattaatgggaaaagggtcatgtgtatggatacatgtatttggacatttatacgtaatgcgtgatcacttttgatccaatgtttggctttacctgtcttcatctcccctgcattaccagaaactgactttgcactttcacttaccaccgcctccctgggaggcaaattcattttccactctggatttcatagctgaagtctgagaagcaggaaaaggagagactgggattaccattcccagattccaaactagcctgctagttacagcggtatgatgctgccccctatacagtgattcgtaccagtcagatgaacggttctttgatcggttcttctgtcctccaccactggtctatccaccccatcttgaactttgttaatacaatatttctgctagttattgttcagggattgagagtcagggaaactgtgttctggtccttgggttacttaatgtcttgagaccttagtttcctcatctgtaaagcgggagggctggactagatgtatgttcctcctgctctgagctgtgaagcgtctaggatgccaggagaaaaccagacccaagtcacagggttctaaacaaaccataccttaaatctctcagtaatggccagccacatctgcaagaagcaggctgggaaaacagctgaagaataacagatatttgttttatttgtcaattatggctcagtaaagctaaaaaaaaatagatacttctgttatcaagaaattattgcacttgattcaaggctgatattaaaccatagcagactcactcaaggtggggggtgagagaaacaaagagattacaaaactgaaaagaggtgttcatttgcagagaactaagggagtatccttcaaacagaaactggaagccagagatctctgaagataaggatcatgaaatgttgttattccccagacagaatgtatcccacgttttccaccggcgttgtttttggtaaagaagggtaagtggaaggaagtgatgaggctgaaaaataccatttgcttcaattcagccgcgaaggatccgctaccttttggttcctattaagtgaatttagctttagctttcatgatagcattttcccaaaggagtcctttagatctgacccctaccctcttcgcagctagactgacatcaggtgacgttgcaagtgcccccagcccactaagcgctatcagtaggaattggccctcagccccgtcacagcgctttcccatgacatcccccagcttctctctcctaggacctcctcgccagcctacccctacctgttgggtaggtcttacttgctgggaacacctgctgtccttagaatgggagcaaccaacgccttggaatcctggcctgtcccttcctcgtgaagggggcgcctgcgctcaagtgccggcttcgccgcctcaggcagagtctagcaggcgggcgaccaggcgtagctgagttctgtggcctggggaaaggggacgccctatccccacagccctgtttcgcagggcttcaagacgctgagaacggccgggaacccctggagtcttggaggcacccgccaattccaggggcccaccccaaccccgctctcagtctgggccagcggcggcgggacaggcgcccggtccccacacaccggctgagacgcccagcccactgcggctgaagctccggccgctgttgcggcaggtgctgcaaaccggtctgccttcgctgcagggcttgcggggatggggcaagtgggtggagagaaaaggggaagagcctgggcggccggcaggcggggcctgcagcctccccagccgcggcagccgccgcgcagccggctctctctgcgcctcgctccgactccggcgcgcaccaagcgggaacccgcgcccgagcccggcgggcgccgctgctgctcctctcggtccccggttcccggtccccgaacgcgccgcggcgaggctgcgcccggcagtggagccgctcggagctgctgggctttggcggccgctcgctgctccgtctggccggaggaccggcggggaaggaaggggaaagcggggacacacacactcgccgcggcgcgcgcgcactgcacactcgtagccgcgcgcccccgccaaggcgcgtccggagcgagtttggccccgcggctccagccccggcacctgcccgccctcagcgttgcccccggccccggccccgcccgccgccccctccgccctcccgcccctcccgcccctcccgcccctcgcctgcactgctctcccttcgctgtggggaagcgacaacgtcccgataacttgcagactgtggcgcaactggtcttggtagcggaggcacccgaatgctgcccgggtgaggtaagtttcctgtgcgtccccggccccttcccactagacccttctgaggggcttgcgcttaggggctctgcatctctgctgaaacccgtcggtctctctacccttccactttgcctgtctgcgttgtgctgggggtgacgtggagagggcgcccgtggccaccgaagcggaccttcgttccgcgggggccacagctgcgcgctcccaacggacacccacccgctcgtcacccggatccccggggccgcagtgacactcggagatcactctgggttcacttaaataggagtactctccccttttccggggaacctgcagagtttggcagcggaaggaaaggtctcccaccaccctcccccggtacgaaacagcggtgaacttgttaggcgccctggtatctcaagaggggcttgcgagttggtgttctgctcatttctggcgctggtgccggattgaacaggtgcggtatggttccagtctaaatgcagcaacagacttctgcgtttcccaggctttctcccccagcctggtcaacgtgacgcttcaacatctggggcaggggctgggagtgtaggggcactggggagggagaatgcccgggtttgatttactatgccggtgccaggagtcgccagaacagaagaaaacaaatgtctgcttatctggcatctatgcagatgagcgtgttgtcatttcttatcccccccaacccccagctctcttgtctggtgcccagcgtggctgagtagaaacctattccggagaagttatttgggtagattgattaattctttcatcgaatctactgaaatcagggctccgaacaaggcaatcctagttactctgatgcttttttaaagggagcgtgttacagatcagaaataacacccactatcatcactacctctctgtgacattctcagatgcaggaggccctagctttaaggggaatgatccttaagggaccggtaggacctcagaatgtgttaatctcgtgcaaggaagaagcggtctctgtgtcagtacttctgagtctcggtttggggaaccccttttgtccctctaatgaagcacattcagccagagacttctcccctgttctgcgaagagactgaagcgttctgcagctgttggagtggagaaaggcgaaaggattggtttcattaggactctaatgtgatgaagtaaggatgggtttcattaggactctaatgtgatgaagtagggtagtgttcatggaagctttgctagagcattcccagctgaaaggagacgctgggaaaaaaccttaatcggccaagtgtaaaccagtgggaggttgagtgagtttcatgtgtgatctctgagcggagggaaacggtggttctgatatggtcctgtgggcagagacttatgaggactgatgagaaagctggtgagtttgagactgatgtatgatgacatcttacctgagaaggaaaactgtgaagcactaaatgatagaaccacattacatttttgtccacgttaagactagagagatttaataataacaccttacatttgcatcagtgtcttgcaatttgtaaattcttttgagtgttctcacctaattccaaacatttctgagggaggcagggcaaagactttttaccatgtaaacacagaaggaacatgaggctcacagattcagagatttatcaaggtaacaagtgctggtattagaatcacagttaggttttctgtcataaccaggtgcctgctctgtacttatataaggtggttttttaaatggcagagttcttctgcatttattgtggtctgcatagtctcactgtaaattactgtttacattttacagatgaggaaactgaggtttagacaagcagtgggagttttccatggatttacatctcatttagtggcatttgcaagactagaacttggatcttctgatgtccagtccattgctttgtgtattctgccatcatttcagttctgatagcaatgaggacacatcatggaaactgcaatacacaaaggactgttaagcatgcccccagtgacctgggttctagttctgggactacatttggccgtatgacctgggccatcatatcacttccaagtctcaagtgtctcacatataaaacaaaacgtttgtatgaaattatgttttttctttccaactttagcattttgtgatgtttaccaatgtgtttgtaatccaatgttatcattttctctagaggaaggagacctttgtaccccacatcacctaagagacctagctaattactctttcacctttagtttatcccttcccccctttactacatgccacttcatcaaaggaatgaaacttaacaagtgcgttttagcttaacatctacagtatattgtttagtttactgtttgacttgaaaatattctgaggggttaaagtactgtaaggtacatgtcagggcttacttgaatattctaattgtaagctcataactttttttttttagctttatggtttgcataaagtaagtgctcagtaaatagctgttgaattaatgaagggggtgaatgaagtcattcataaggaaaacatatgctgtaaaacatagaaagcatcttaccatgtaaattcccaacacataagataatttgcctacaggcatgtgcctcctgaagctggcgggtacagagcccattgttgctctcttttctgaaggcatcatatagggaagagcttttctttctccctagacagtagactcatgtcatctatgttatgctcttttgtttgccgcccccccgcccctttagttgttagtattacagctgctgaaagatacattcctagaaattgacttgtcccattttatgaaagggtatgtcttgacatggggaaaccaaccattctgtttttaaaacagggtattgaataaatttcaggagatgctaatactgtctcgtggtttcagagggggaacctagttaacaaaaccaacctagtttctgttccttttaacaatcttctctttctactcctcctctttatatacagacaagtagtgtttttatgtttggaagaatgataagaaagaatatagtgatcttaaatattattaatggatctgcaatttacattggggattgatgtatgtttccttctgataaagaatttaaatattaattagtttagaagtaccgtttatgggtaagaaaactaaaacttaggtgaattgacttacttatggtcacaaagatgatagcaggaggaccaagatcaatgtggaattcttaagaaggttcatatttgagtttgtcccaggagttctatggtgaaggtacagttttgacttttagaaatcatagagattaacagaaaacttctgtttactatcattattagagagttagtacatttgaaaatggtttagcatttatatgtttaagttttcttgcccaagcagatgccattaaaaataacatgtttttttctctttactttttttttgttttttgagtcaaggtctcattctgtttcccaggctggagtgcagtggcccaactccagcctcaacctccccaggctcaggtaatcctcccacctcaacttcctgagtagctgcaacaacaggcacgcactaccatgcctggctaatttttgtatttttggcagagacagggttgcaccatgttgcctaggctggtctgtaactcgtggattcaagcaatccacaggcatcggcttcccacagtgctgggattacaggtgtgagaccctgtgctcggccaaaatgtttgtttttatctattcactatgattcttctggcttatgtgcatcaccagactcagaaataatactttgctccaatcagtgctgggagagaggaaactgttcaaatagaaaccaaagacctgtaatcccatgggaggccgaggtgggcgaatcacttgagcccaggagtttgagaccagcctgggcaacatagcaagaccccatctatgcaaaaataaaaaattagctgggtatggtggcacgtgcctgtggtcccagctacttgggaggctgaagtgagaggatcactggagcctaggagttcaaggttgcagtgagctatgatcgcaccactgtactctagcctgggtgacacagcaaggccttgtctcagaaaagaaaggaaaagaaacacaaatgtatgctggtattctcaacttctcttcctgatatataaagccagaagccaaaggtagccttgtcatgcagctggtaaagtcataaatatgtatacattcaatttgcatttgcattttgcttgtacttctgttagatggtgagtcagaacatttaatatcctggaaatttttttttccccctatggccagagccttcagtagattctgtaaaacatcaagtcctaaatgtatttgttgctgaaacatgttctctttgtatcaagtgcattaatgggagttggaaggaatccttcatttttttttagaagctggccagttagaactgtacattatgtagctctactgttcatttgtggtcttatcaatagagcaggatgtgttactttttgctgagtgccagagaactggggtgggaggaaacctaggcttctgttttattttttttctttttaaaaatcaactttaaacttaatttatgatgaaatttttggggtactgtgtcgtaaacaatcagctgctattgacagagaattgtattcagtcaggttccttttcatatataagattaggtcagggaaaacaggcttgcttttgtacattctattctcaattgtatttacttctgtatcgcttcatcagaggtatataaaggagataatcacacaggaaaacacaggaatcctgcccaaactagattactcttggaaagatttgaaacagagtgattgggacaaggttgcatgttcagtaagctgacagtgccttggtattatcattttaagttaaaacaaactagcactggaataaacaacatgaagtgtgtgttcttgtaggaagtcttctgtattgtttatgggactcaataaacaatgaatatgtaacatgtttgggtaatttacatgatggatgcacagtaagttcttgagactcattttctctaatgtttttagaaaatcaattgtgaaattgcaatgaaatataaagcattgagggtttggtattgctcctggttttaaaatgggtgtgtatgtctttcagtggaagttcaggcaaggattggaattgtaagtactaggggtccagagattataattatcttgaattggaactaaagttcagacaggactgcagaaagttcattcagtttgtaagagaaaaggtgatatttaagccttcaccattcagtcatgctgagcaaggggtttgtgggggaggataaaattagagcgagccataaaaatgtgctttccttgcttcgtagacagacttaagacatgcagtggattcgacatgtttcatagtgggcttttaatttaatatacactttttttctttcttttttaaaccatgcccatcattgtgctctctggatcacttgatcatatgtttggtaataaagtaaggaaacaaaacagcaacaacaattaaaaagcaatgcaacgacctccttgagggagtagtaagcacatcataggtgttcagcaaatatttgacaatggaaaaggttaagcatcatgttttatttatatttgtattcttggaacttggcactgtgtctggcaggtggtgaggatttaatgagtgtttactgaacaatttatatatccaaatgaatatcactcttcaaaatcttgggatgttccataattattctaatgattctattatttttcgaaccattttagaaatattaggcagtctgatagatgctaatgttgatagtttatagtagtcctttttttaaatcataaattatatttattcactagactacaacttttttaaccaaaatgcctaggaataattttgcattatttatcttctttaggagaaaaataaatactaaatatattctgtttttatttgaaagtattcagtaagcgtagttctcaaatgcccagagtggcttaatagtgagtttggttcagggtacagagacaagaatggactttaagcttctctaagttaatcagcttaaatatcacctcctcctggcgacttttctgttcttccaacctaaaggagaccttctccatatgttttgttcacttgtcacagggatactgatacagttttgacgtttgtcccttccaaatctcaggttgaaatgtgattccccatgctagaggtggggcctgatgggaagaatttgagtcatatggatggatccctcatgaatggcttagtacactccccatggtaatgagtgagctcttgctctatgagtttacatgagatctggttgtttcaaagcgtgtggcatctcctacccctcccttgctccctcttttacatggactcccccttcaccttccgccatgactgtaagcttcctggggccctctctcaccagaagcagatgctggcactgtgccttatgtacggcttgcagaactgtgagccaaaataaaacctcttttctttatgaattatgcagccttaggtattcctttatggcaatgcaaaaacagattaacacggatacttattcatttatgtatttcacttgtttccctgtgtccaaactcacattcaacccaagattataaactctttgagggcagaggccatggttcataacactgtttttctagtgtttggcacatggtaggtcctcagtaaatatttaaatgaatacatgaataagccccatccatcctgtcaagatgaagtgggccatcatttaggttactcaagctgaatcagactgagaggacagtgcttacgtgttagctatggcagctcctttacaatgatgaccgaaccctttaggatgagaaaaccacttgtttagatgataaattctggcatgattattaagaaaacactgtctctatttaaagactgatttcttccatttacttagaaatgaatagtagtgaacaaagaagaggaaattatcaagcacaaaacaaaacgttgctacactgttaaaatgggctctaaatgtacctaaatcataaacatattcattcctaattaagacactttggtgttcatatacaaggcaattcctatgatgcctcacataaaggtggtatttgagctggtatttatttgaacatcagctacatcaacagtcccaataccatggaagaagccagggcagtgactctgaaagtgcagtccttagaccaacagagtcatcactacctgagaatttgttagaaatgcagatgaggccaggcgcggtggctcacaactataatcccagcaccttgggagcccgaagcaggtggatcacctgaggtcaggggtttgagaccagcctggccaacatggtgaaaccacatctctaccaaaaatacaaaaattagctgggcatggtggcaggtgcctgtaatcccagctacttgggaggctgaggcaggagaatcgcttgaacccgggatgcagaggttgcaatgagccaagatcgcaccattgcactccagcctgggtgacaagagtgaaactccgactcaaaagaaaagaaaagaaagaaaagaaatgcagatgaactctatggatggaggacaggccttcgggtgattctgctgcatacccaatattgccagtacatagtaaatctgttgctccaagtataagcctcctgaagtgttcagtattcccaggtaaacccaggatgtgttgagggagtgctatctgcctgctccttcagaaatatgaggggagaaatgaaaaattctccctctgccagtcttggcttttctcagaactgtgcggatcacaggagagcaaagtattgtgaatagattgggtatctaggactttagatacaatataaaaaagcttttggtagtcacagagcctgccaagtgatgggtattatggggtatacagaaagtgttaatataaacatggtcctggctgtcaaggaggctgactgtgctgagagcttactctgttccaggcactcctcaagtgctgtttcttttcatcaccatgtgcttccaagctgcagcatttcttcactgaagagaaggaaagggaaacctagtcaggttagtagtaacttgtaccagagcacagaaccagtaagggatggcacaaaggttctagccctggcttttctgactatgaagcccatactctttttctctgtttcatggtgtagcacctcaaagtacagttttgaaataagagttttaaaaaggagaacataagcgaatctaaaatttatatctccaaactaagtctttctctgaactctagtttgcataattgacattgcgcttggatatcccaaaggcacctcaaattctacatgttcaaaaccagaatcatgatctgttttctccacatctgatactcctgcaaggttcccagctctgtggtgggcaccgctagtcaccaagtagcacgatcagaaacttgggagccatccttggctccaccctctgcacacaccacatctaatccatcaccaatgtctattgattttgcttcctgaatatctttcccattccatctgcttctcatcatttgtgcggattctatcctagcccaacttcttgtctctctgcaggactgagccagaacctctctggtatcctgagtccactctgggtctcctagaatccattacccatattgtaaccagggcacttgtgatggttggagggcacctgaggctctgctggccagatctctgcttcctgtaccctgccaaaccctcacggaagcacacaaattctgaccccagggctctccacctcagtggccttttgagctcttggacagcctctgaggacttgtttttccaagtagctttctaccctgatgtttttgctctcctggagtccagtcagaggcaggttcataactacagtcaactacttttaaaggaacaggatggaaactccagtgtagctctagggacttgcccaaccctaccgcaaataccaagttcttaagagttctccggcagttcccaaggtgcactccactcactccaacaaagaaccaaagactgctctacttccacagttgcttatactctgcccctgagttcccccaggaccctgcaatatcacatttgtggccaccatagcagagaaattcaccacctgtggtctaggaataaaatctaagcctctcccaaaaggcacctgtctctgactgttgactgtggcttatcctggcagctttgaggaaaaggcctgggttgctttgcataactggcaggatagataaagaaacatgactcaaaatcattctctctgtatttcctcataacaggaaccagttgacatgggtgcaggaaaaacttcctgaccaaggagtggggcctggggctgggggtgctggacagagagaagcacagggatctgccccagactcttcaatggcctccctttgtgcctggagtgaagatgtgggtcattgacatggttccagagccctgcacggtcctggtcctgctgccactccagtctcagatccaccactctgccccttgctgtttctgagccacacttgcaactgccagcttcacaccctctgtgcagcactctcgttgccccctttggaatgttctcagcatcggtcgaccacgcttcaggtcaattctaaggttacttttgaaaggaggccttggccacccatccccagtctaggacaggaccagtggttccctctccaggagggcttcaacagtatgattatttgactagtttcctcgcccccaccagctgctaatcatcagggcccattgcatccccatagtgtcggcacatgtagaattgtcttgagtgaataagtaaatgaataccaatacttctaccttaaaaaaatccttttcgtaaattcccactaaagaaaggaaatgcacagagatcatgaatgaaccacttcatattgccgatcctgtccatgaacttgatcttcaactttcattaccactgcctaatttcacctgtcatgagccgcatttctataatggtagctgcaggtattatccccaaggaaggttgccccaaaggcatgatataaaatatttctggaagaatacctgagatactagtgtctttgtttgcctctggggaggtgaattggctagctgaggggcatggatgggaggggaattttcatcccatatttatttgtacctctgaatttggacccatatgtgtggattacttattttaaaaattagaattgtaaaagtaaaaggaaggaaagcagagcaagagatgtgaaggaatgggaatgattatttagaggaaagaatatggacatgcagttgaaagggggttgtcctgaaaagaattcctgtcttcaaggatacagccagttacatctgacttgctctgcacatctatggagaactatatggcttcaacttaaaagggatgccataacatataacttgacttaaataggtttgtctgatctctcccatcacagaatataacatttattctaaatataaaagctaatagaacctaattatttaagagggaagcagttgttaaggaagaagttagttggaggctaaagcattctccttgaagacatagaagtgcccaagaaacatgaaaaaatgcttatcatcactaatcaccagagaagtgcaaatcaaaaccacaatgagataccatctcataccagtcagaatggctatgattagaaagtcaaaaaataacataggctggcaaggttcagagaaaagggagcgcttatgcacgattgcttggtttgcaaatttgttcagccactgtggaaaacagtgagaaatcttggagatttctcaaagaactgaaaatagaattatcattcaacccagcaatcccattactggatatatacccaaaggaaaataaattgttttatcagaaagacacctgcactcacacgttcattgcagcgctattcataatagcaaagacaaggaatcaacctaggtgaccatcaatgatggattggatgaagaaaatgtggtatatatacaccatggaatattatgcagccataagaaagaacaaaatcatgttctgtagcataatggatgcacctggaggccgttatcctaagcaaattaacacagaagcaaccaaataccgcgtgttctcacttataagtgtgagctaaccattgggtacacatggacataaaattgggaacagtagatactgggagctccaaaggggacagggaaggagggaggtaagggttgaaaaactacctgtcaggtactgtgttcactacttgggtgatgggttcaattgaagcccaatcctcaacatcatgcaatatatccaggtaacaaacctgcatgtgtaacccctgaatctaaaatctgaaaaaaagattctcttttatgatccaggtatttttagaatagaataagagactggacggtagcatcctataaaaactggttaatataagttggcataacccaagcttgcatttaatctttgcacatagcttttccagttagtcaaatttgaactgtaaataagagaaaaataccaacttgtcttaggtggttcaggctgtcataacaaagtgtcaaaaactgggtggttcataaacaaaaacagtttatttctcatagttctggaggctaagagtccaagatcaggtgccagcatgatcaggttctggagagggctctcttccagcttacagatggcaaacttcttctagtaccctcatgtgacagaaagagggagaaagagctttctgggatctcctttataagagcccgaatcccaccctatgacctaatcacctcctaataccatcatcttggggttaggattttgatatgaattttgagggggatacattcagtaccttggatagtcctttgtagcccagtcagtgtgctataagaaacacatcctgtgttgaaacctagtatatacgtagagatataaataatacatataacagaaataaaggtttcatgaaacagtacttagccataccacatgaaatgtcctctgttattttctgttgtgttccctcccaactccaacttccaccatacactggtcatgagccactgaattgactttactccctactgaagggcagagacctgcaatttatttagaaagcatgagtgcaatctgccatccccctggcactgcctatgatgtgtgtcagcctagaggtgtgcatttactgaggagctgacaggactccacatatagtgctctgtccactcctatgaaaccacagaaagttgtgagtttaaaaccccctaaagactccccttgcaaagttttatcaagaaggcatagtaaaacttggagagtagacatatgatagaactttgagttggacaaaagtgactcagatggctgccttgtctgtcataaaacatatgtaagcttcaatcatcaaacatggcctttaacctgggaaatgtctgtattttttcctatagtgctcaccctaaagttcacactaatttattttagtaagaacctaaatactgtaaggaaaacaatctctgactttaaaaatatgtgaagaataaagaataatttgacggtgtagtttttttcttcctgaaattccttcagacattaagcctgctcattttcattggccactgaagcacaaaattgaaggggctcaaaatagggaacccttggctatgcagaacctttgggcaggctgttttacttctagaaaacatttcctgattgcttgctcctttaactgccagcaattattatggccaagttttgtatagaaaattttcccagcattgtctcatctgtccctgattctttaaaagattatacagaacagagtgtgtcttttatgctactgtaaagtgatagatttagtattcattcaggaatgcaaggctctttgcccctaaaccaaatggccctactttgctgtcttctaaaatcttgtctgctttttcttgataattttttttttggccctacttctgtggctctcagcagtgagccccttcactcattgttggctattgaaagtccattgtgattttgggaaccagataaccatactgtctgaaatgtgtttgccagatagagtcatattatccattgaaactgaaattttaaaaaaggatcaaaagtagtatttgagggaggtcttcaagagttctactggtaaagcaagcaagctttagttctttcttgttcgcttcattcattagccaatagcatgttttcttctgccctgtttttgggttgttcagataaagtgataccttttcaggctgtgataggcatgctttcttttttctttctttttgtaacatattgataatgtgtttactatattatggtctaaagcaggatttcatagactttttcatttaagttaaacatagtggcaattgatgagtattttggtaacagctttatttgcaatgctttatgcctttaaaggttatagattactgcatttctcttttccttggagaaactgcatagcaaagttccccagattttcctgatttccatcttccattggaaaacaagttcaatatccacaataaaacaaggaagctgaatactgaaaaattaacttatttttaaggagtgatgtgaaccagactgttctgaggtttacgactgcattgtatgggaacaaaaagaagcaacggtgtcattgctgtggcaagctgtatttaaatgatgcccttttatttttttcaagatgtgttgttcagactcagttgtgaagattatggaaactgaaacaaatgggaaatcagtctctcctgctaagggttaagagagaaacacgacttttgtttacatttgtttataggaaacagaatggaaattcagcttttaagatgtctgtacagttgggcttcattatttagtttagcagtttctcagaaactccctctcctacatgacaatttataatgcaaacatgatgcatcatttcattttgtgtaaactttatagaaggaatagtcttttccacatatgtcaaaagacttctggaagcattttagaactgaatgctaagtatcctacacatgtgcctggaagctttagaaatgatcagcagcagcactttctgaccttacatttttgtttgtttcttcatttgtccgcctccttactgaaaggtaaagtttcacaagagcaggaactttgttctgtttactacactgtctccagcacctagaacagtgtccagcacaaagacagcctgtattattatcattgttgaatgaactcattcttaagctataaaaacaaattcttaagctgtaaccgtttttcccttgacttctgagctcccccttcctttacaaaatttcagtagcctagcatctagccttgccactgcttcaagttccttccccgaggagcagccttgtttgttgccagattacagtctttcttctgtctcttgctttttgcacctttaaaagtctagaccaatttaataaccccacgccccatggtctctttgctactcagctgattttttgatcccaactcttacctctttgaacaaactctatacttgcagctgtgcagtcaccttttaaaaattcagtccacctcccttcccaaatactgtttttatcaaacacaccctcattttttttttaacccacctttgaaattttagcactctttttactttggtcatctctgtctctgtgcagctaccaattttttaaaaatgttctcttctattctcacttctgtctccagatacgtctcttacctgggctggtgtagaaacttcccaaataacttccatacctccctatctacccgctttaagcaattgtaatactgtctcttacctgggctggtgtagaaacttcccaaataacttccatacctccctatctacccgctttaagcaattgtaatacctgctgctagagaatgattttgtcactgccgtggcaggaaatccttagatcctttaccgtgtctgaaatctgaaatgctttggtttgggtacattctggccctagttgactgttgatcattgtcatcatcattgttgtcattgtcatagctgtataacagtgatagcagctaccatttcttaaactcttactttataccaggcataacacgtatgaagcatgacatcatgaagcttgttagtgcattttggagctgtataatgtgataatgggtagggtggctgtgggtggaataagatagggctggagaggtgtatcgggccagaccatcgacatcttgtcagctgtgctaaggagtttgaacatttcttctacaggcaatgaggcaacaactagaagagtttgatggagaagtgatgaggtcatattttgtttcataatggcaacatgagcaatagtttaggggatgaattagaagggtaagagactggagatagggagactaatcacagaagagatgaaaaggacctgaagtaatgtagtgtggatagggaagagtgagtagatttgatattcaagagggagaatttctaggacttgatgaccacctggatatgagttttggggaatggtagtagtagatgattctctggcttttggcttgagtgactggagagattggggaatgatgctcaactgagagagaataccaggtagaggcatcgtacatatggtagcagaggcaggagggctgtgatgatgagtcctattttggacatgcatttgagatacctgggggctatccaggtaggatgtggctgtaagatcaatccatgatggagacactggctgtgttgtggtcatatcatctgggctgtgggagagcatgagatcgaatgagattgagatacaggacatgaaggtggagagtctaaagagaagctgtgtgtaagtgtggaagaggccatgatgaagacacagtattatgagctcttgccagcaattaaaaccatgagactaaatgaaatgttcctgaaattgtgtaagaagaagacagaagatcacttgttgatcttcacttgcaatttcatttccctgtagcgtggctcattccgttgttttcttttctctgtttaaggaaatggcatcagattttcatgatagcatgtacagcctactgtttcggaagacctctctgagcccactgatccccactctgcctccctagaagtgatttctcaggcacacattctctttggtcctcttgctcctgtgactctttgggaactttccctagaggcttctgtttcatttgttctctgcttatctctccaagcagattcgagtcctgacagcagggatcatatctttgcctgctttgtctcccccaaccaaaacctaacagctctttctttattttttatttttattttttgagatggagtctccctctgtcacccaggctggagtgcagtggtgcgattttggctcactgcaacttcacctcccgggttcaagcgattttctggcctcagccttctgagtagctgggattacaggtgcctgcctccgcgccaggctaatttttgtatttttagtagagtcggggtttcatcatgctggccatggttggccaggctggtctcgaactcctgacctcaagtgttccgcccgcctcggcctcccagagtgctgggattacaggtgtgagccaccgcacccggcccttaacagctctttctatactctagctgctcctgctactttttttttccctttttcctctttggaggctcatttgctgaccatattgttgttatttttatttcatttattataattattaattaattttatttattaccatgtatgtatttatttattattagtatatcatataatatataatagttgtagatatgtttggggtacttgtgatattttgatacctgtatgcactgtgtaatgatcaaatcagggtaatgaggatatcacctcaaacatttttcattgtgttgggaacattataattcttctagctatttgaaatatacaataaattatcattaactataatttccctactgtactataaaatactagaacttttcccatctatctgtgtttttgtatccttaaccaatttctcttcatcccctcgtctcccctacccttcacagcctctcataactatcattttattctctacctccatgaaatccacatttttagctcccacatacgagtgagaacatggaatatttgtctttctgtgcctagcttatttcaggtaacataatgacttccggtttccaccatgttgctacaaatgacaggatctcgttcttttctgtagctgaataatattcctctgtgtgtgtgtgtgtgtgtgagagagagagagagagagggagagagagagagagacgttttctttgtgcattcatccactgatggacacttacattgattctatgtgttgactattgtgaataaatgctgtagtaaacaggggagtgcagatatctctttgatatactgattttctttcttttggatatatacctaacagtgggattgctggatcaaatggtagtcctattttttttttcttttgaggaacttacatcgttttccgtaatggctgtacatctttacattcccaccaatagtatacaaatattgccctttctctacatcctctccagcatttgttactttttgattttttttggtaatagccattcttactggggtgagatgttatcccgttgtggttttgatttgcatctccctgatgattagtgatgttgagcattttttcatatacctgttagccatttgtatgtcttcttttgagaaatgtctattcaggtcttttgcccattttttaattgaagtatttggttttttttttttttttttttttgctattgagttgtttgagtttcttatgtattctggttattaatcccttgtcaaatggataaatggatagtttgcaaatattttctcccattctttaggttgtctcttcactttgttgattgtttcctttgctgtgcagaagcttttcagcttgatgcaatctcatttgtctattaatattttgtttttgttgcctgtgcttttgggtcttacccaaaaaattattgcccagacaaatatcttataagattttcccaaaatttttttcagtagtttcatagttttaggccttacatttaagtctttaatgcattttgagttgatttttgtatatggtaaaagataggtatctagttttattcttctgcatatggatatccagttttcccagcactatttattaaagaaactgtcctttccccagtgtatgttcttggtgcctttgttgaaaatgggttggctgcaagtgtgtggattgatttctgagttccgtaggtctatgtgtctgtgttttttttgggtttttttttttttgttttttgttttagccagtaccatgctgttttgattactctagctttgtagtataatttgagattaggtagtgtgatgccttcagcttggttctttttgctcaacatttctttagctattttcagtcttttgtggttttatacagattttaggattgttttttctatttctgtgaagaatgtaattgctattttggtagagattgcattgaatctactccgtatagcgatgtgcagattcaattgttaaattgatatacagatttaattgttaaaatgataagcattttaacaatattcttccaatctctgagcatgagacatcttttcattttttgtgtcctcttcaatttctttcatcaatgttgtatagttttccttgcagaaacctttcacttatttggttgagtttattactaggtttttttttgtagttattgtaagtggggttgctttcttgatttctttttcgatttgatcactgttcacatataaaaactctgatgacttttgtatgtttattttgaacgtaacccttgaaagtgggtatgcttgtcttgttccagatcttagtggaaaggctttcaattttccttctactactttttattgattatttttattctcctctagaagaataaagaaacaaagtgaacaactcaaattttgtacaggtttatatcagttgatgtacctcaaactaaaagtgcctgcttaaaatgtgtttttggctgaatgttctatttctgacttaaaaaaaaagtgaattagcaagaagatctacaacacccagtgcagaattattgtcatttatcattctcactattttaaactctatagaagaagaatatgtcttttggcagttccactacacctactatagcttctcctgagcagagtttatctcctggtctcattggtcaaacttcctgtgttttaaaatggcattttgcatacacttgcacaagttgaatttggatgcagtgagagcccttatccaagaaacacggattctgtctgactcatccggcctctctgctaacactttggtgcgccctggtcaagtgacttgaccctatttgtgcattttttctttttctcatctatggaatgaaaatctagccactggctcctgacctcattcaaagacatgttgtgaggccaaatgaactgaggacctttgaggtccttagaacaaaagcattgcacacattagagaatttattttgtaagaattgcagaaagagatcaggctcagggtagccaccattatagcccacgagtaagcaaatatgagccaagaggtccccataaaggagaattctctcccatcactaaggccaaagataggagtgggacactgctaaagtctgattagagttccagaatttaaacatcaccttcagcatggatgaggagagcagcatggatgaggagagtggcatgcttttatctttaaaaagagacgaaccctgaatgtggacgtttattgaagaaagcaaaactcatacttacttgttaaagaaaaataatgttagtgaactgcaaataattcatgtgagagggtccaaactaggacataattctcttaagtattaaataagtttattgcttattccgtttagtttgtatggtatgtggtagccaacttatcgtatcttctgagtgcctaatgctctgccttgcatacaaggatgattagtgttttacttggtgctgcccatttagatgtaatatgagaagctcctagaagtcacccagaaaacacttttaacacctatggaatctttcagtttgtttgactttaactggacatttctcaaatgctaatgaaaatcttatttaataatagaagtatttaaactaaaagggtgtgattggattgtttgtaacacaaagaaaggataaatgcttgaggtgatagatatcccatttaccttgatgtgattattatacatcatatgcctgtatcaaaataatctcatgcgccccataaatatatacaccttctatgtaccaatgaaaattacaaattaaaaaaattgaaatgattatagtctgatgacctataccaagtgacagaggaatctgactggaattacctggccaaaaatgagggaaactcatagagtataacaccattggcataagtgtcacaaaattggatctgtactcatgacattggatttataataagagccccaaatcttaattctttagttaggctggcagtgaatagagtggcacaatcataatcatacaggtgccgtttctcagttttctgcttttagaatcagattgtggactaagcatggcagacttggttatgattgcaggctacagtacaaatattagcaacctcaacaaaagaaaaagtgtagttggcaggaggtgggatgtggcatcagggaggagagggtgctaatatcctcatttcttaaaatagcaagataagctatagctgttaaaagttgctggaattccacagtggttgtgccatcttgcattctcatatgagagtttccgttgcttcaactttttatgaacacatggtatgatcgttcttttgaatttagatattcaaatagttgtgtcctggtggctcattgtagctttaaattgcatttccgtgacggctaatcatgttgagcatcttttcatgtgcctatttgccattcttatatgatttttggtaaggtgctaaactcttgtattgattctagtaaagttgttgtttttttttttagcacacatattttttatatagacaatcatgttgtctatgaatgaagatagttttacctcagaacaggtgttggcgaaaacaaaaatgaagactttagtacttaacgttgcaaataaattaaacagaagaattagaagaatatattaaacttcaagaggaggccagggcagtgtgaggagaatccttgatatgggtcaagacctagagattcaagcatggtatcaacagttgtaaagataactatcaagagactaaaacaaaatttgaagaacagttaccttgggagaatgaaactagtggcagggataggaaaagcaagagttgatcactctcacgaagtcttctatctggtttaatttattgccttgcacatacgtttccctgaaaaaagtaaattattggcatattggtaattaggacataaagataaaaacaatatgaagtaattataataggtagagggtaagactgaataatataaaataaagaatatggggaagtggtctatgtttagagttatataaagaaaggaggggtcctgaaatgacagtcagtgctgataaacgcctgacacttacttaggctcttgctgcattctaggtactttctaaacaataaacatgtgacacttgtttaataatcacagcaaccatggagtggatactattatcaccatttaatagaggaggtaaggagacgtagaagcactgatactaagtatgttatttgagttgacacagtcaggtttcagagccagctggcccagccccagagccgtctctctaccctacaaaactgcagtgtgtctcatggaaggaaggtaggtgtgataccccacagtacagacagtgggtgctccttcatcctaattaaacttggcttgttctctgaggccatcccctaaagagatacttaactttagttcattcatgattcagcaaatatttgagtgcctattaacacagctctaggtactaggactattcctttccccagtcagtggcaaagaaaaataagtgcattatttgatacaagatgctatggggaaaataaggcaagataaggagtagaatgatggtagtggtggtggtgaggtgttattttagaaaggaaggtgagagaagtcctctctaaagagctggcacatgaatattgtctttgcccattctggctgctattacaaaatactgtagattgagtgatcaagtagcttaaacaacgaacatttatttcacacagttctgaaggctgggaagtccaagatcaaggtgctgacagatccagtgtctggtgagggctcactttatggtttacagatggccatcttctcgttgcatcctcacatgcagacagcagagaggaagtgagctctctatgtctcttttatgagggcactaatcccattcatgaggactccaccctcatgacctcattattccccataggccccacctcgtaataccatcatattgggggtatggattccaatatatgaatttatgtgggggaggggggcacaaacattcagttcataacagatgaagacctaaatgaagtagagaaacaaactgcagatatggggaaaacattccaagtagaagggatgaatagtaaatgccaagtcctgaggcacagcttgtttggcccacttgagatactgggggaaacctgaatggccaaagctgagagaagtagcagaaggggaatacttgggaccaagacaagtagagctttatgaaccagataatgactttggattttgttcttagtgtgatgagaagccattagagggttgagtgaagggaaaggatatccaacgagaacctcctgccctgtgtctcatgaagaggcagtatttcaagaagaggcttaaagctgagagtgttttgctaatcagtgaagatgtgactaatgagctgctggggaagtcaagccttctgtaagtgaaagtgtttgcattcattgtactcataggtaccttccctaatggtgattgtgagccaggacactagttaaattgtagctacttagaagtggtaattcatggcacacttaatgatttcttcctatgtttaatgacattaatatgttcaatcatcatttaaaaattatctttcttagctctaaagtaataattgcaagaaatgcattagggtactggtatatgggggttgcatagggagaaagaaggaattttgaagaaaggtttaacaagaatttaaaatatttagatgaatggagatatttatatccaaatatattcatgttcttataatatccttcttataagaacttttcaaattcttctacttgaaatatataatttttaaatcactgattattgaagagtaggagtaaactcttgctttctgttacctagggcaaagcatatcttggttcatttctgggagatagaaaaaagctctagtctaattgatttttccagaatagaaaaggaaaataatttcttaacatgttcaactgtattaaaatttatattaaaaccaatataactaagattatctaaaaggcagtgagaaagggaacatatctatatctatacacacataatggtcagtatcccgaatatgtaaggtatgtgtataattatacaagaactaacctttatttggataaatggccaaaggttaggtactatcatttttatacatgaaaaggaccaacatagacaaaagtaatcatccatagtaatagtaaaagcaatacaatctgaagtaactgagtcttaagaaataaaatgataagttacaatgttggcatggctgtgtagaatttggtatttgtagatttttgttagctttcaaattagtatatacttcctaaagggtaccaacaatatttaacaaaagccatttcattgaatatacccttagatccagtaatttcccttttcaagggaaaataagtcaaaggagaaaaaaaaaaatcttgttagaacaacattcattatagtcatgaaaggctaaaaatgacttcgatatctaacatttggggaaatgattaaacaaaccataataattcataacaatagaatattacttgcagatagaatattatggagaagtctgtgtgaaattaagtgaaaaaagagacataatgttgtgaaagactgtttataagcaagtacactgatcaggatgaaaaagcatagaatggttacatacaatttgcattgatgattttgtttaccttttaattgtgtatttggctgcatatgaatatggcatgaagaacagaagaaaatataattcacttaaaggaggtatatcataggatatagaaaataatatccagggtcaacaagatttggagcacctgatacgaacagccaggaaatgggatgccaatgagggtctactctatgcttccaatgaaagtgaggatggagtaattgaagaaatactcctcaagactaattgaaactaacattcattcccaaaaagtaagccatgtcagcagatgagatttatttttggattaaaaaataacttcacagaaacttttagatctgttatcgcggcccatatccagttacaacattaaatttttttctatatagaaacagatttctaaattcttaacagatatcacactttgagtaatgtcatatacaagtaaattgcagaaaagcagagaatttcagccaacagaagtcactgtagtggactttgacctggactttgttgtgaaataaaactcttgagcttgtcacaccaagttgtattggaatgggacaataaattccaaagattcattgagtccttaaaatgggtgggtaggctttatgtatatgctgggtacaaattcaaatcgactaggttggaaacaagaaaaggatgaatggatttcatgattgttttgaatttagaattttgaatacagttatccaatatttcttctcccctcttttcatgagaaaggattaccctgaaatggggccaggcaggccactggtttccttgaagtcttagttgaaatatgcttcttcaatcattaaccagtaaacagatatgacttccataatcttcactgtcaaggaaagttacctttagcacatgcctgtggatccctttcaatatgtgtgataattttggtttcaagggtcatgtgttatggtcaagtgctgcttcagaatcttagaggctgttctagaacgcttgatgtctaaagcttgccatgtttcaatttaacatcagtttgtgaatatctgttgtgccaatatgatttctggtatccctgatgtctggataggacgtatatattttgtggggaaaacagaagaggtgaagctaacactgcattgtgtacactggacaggatcagtgatgatccagttcctttgtcttcccagcaaagaacagcctctgaaatgaggctgatgttgaccacttccatagattattgagagggttaaccgagataaaggaatatgggtggcaggaactaagtaaatgctacttcctttcactttttatgtgcaaagtattttgaaaggtgcggagggcaaaggggctaacgttttagactgagtgggtggttggggaggcaatcgcaaaaacaaatgtgtgatccttgctgtcagggaatttgcaacaggttggaggagccaggcaaacacactcaattaggggaagataatgcaattaaaagaaaggtggtaaaagtactgaatgtggctggagttagacagccttaggattgcaaattaagcctttgaggttagtgcatgtgatggtttgtataacccaaatttgaagaaaggctggtacacagggcaaatgcatactaggaaaatactctgagagacagtcacacactttaaaaagtgataaaatgttgtaattatactgtttacttttgaaaactgcctattgttcacttcactgtatttcaggaagcattttataataagcaaactgcaacccttttttaatgtttgtggaaggaggtgtgggaagtaatggcgttgactctcagccacttctggctggtctctgtcttcgagggattcctgagcctccaccgaagcaccatgggtggggctgctgtgaactagtcacgagctagatttgcttgctagccactcctgaaattcttactgtgatgttggaatagggaggtggaggaaataagtgttttatttatacctctcctttgggacttaccacctttcaaggtgtagtttcagttatttgcaggtgtgtcttatcttccctgttggattgtaaattgcttgcgggaggaagggtctctcgtttatttttcaataaacaaaatgttgtcaaaaggaattccctttactccaaagtcttgctgattgaattacatggatcttttttgttgttgtttatttaatagcactattcaagagtatctgaaactatatcagtattcatttagtctttggcatatttgggattcaaaggaaattcattctcttcccacgtctaacttgtactctcccggtgttagggatcaaccacagcatgttttagagtcttcatctatatccctctggaaattcagaactttgaccacctactgtttgtgcagaggagatcagaggaggcacttgtctcacatctgatagctaaaccagatacgtgggtctggtaaacagaagcaggtggaacccaaaagaagacaaattgacacatctaacaaatgtaagaaggccattgttttccctgggcatggctttttgggagagctcagagttaagtagcagttgacatgacagaaatggcaagaacacagtggagtagaaaggtctgctgtccctgaggcaaagccgggtaattctttcttggaaagagtgggcattacaattgattactggcacagtgggcaggcatccatgaaaagctcataatccgttgctggtgatgtggaggtgggttggggggggggcggcgcggtgggagatgatgatgatgatgacgacgacgatgatgtggttggaacctgtaccaattttgatgctttgcacatccattgaattttggtgccctcttcctcatagcagaagggaaagttatttgatctaggtgtgggccgcaaggtgattgtaaatgctcatgtacttgtgtagttgaattggtggtaacttatttttagaagtcctctaagaagccaaccatccaaccacaaaatttccagtgggaaatgagaagcagattgctgaagagaaccttgctgcttgccgtctgtacacatgcagtatggcactaggtgctggttattcctccagtacaatggttaatctcttgcctgttccaccaaagcgtgtgagccaggctggcattgggctccaaactgcagagccttgcatatttcgtttttctctgtttgttcattttgtgtctaccagtctaactggttgacgtgtgaagcagtgtgaagaatgagggctaaccgcagtgcttcccaaagaatttttaaaattgctctttcccttgaatcctattgtttatactatgcacaaactctgtgtgacatttagatttgggggagaacaattgaataaaatttttctcagtcagtttgaggtcacagaccaagggtttttctcttttcttctgagatccccacttattgaaatacttagactcttttttttttttttttttttttttttttttgagatggagtcttgcttattcgcccaggctggagtgcagtggcgtgatctcagctcactgtaacctccgcctcccgggttcaggcaattctcctgcgtcagccacccaagtagctgggactacaggtgcaggctaccatgcccagctaatttttgtatttttagttgagacggggtttcaccatgttggccaggctggtctcgatctcttgaccttgtgatccacccgcttcggcctcccaacgtgctgggattacaggcgtgagccactgtgcccggcaatacttagactctttaaaggatcatttaactagtatatttattaggaggcagtagaatgtattgtggtgattaagagcttgaatttgggctgaaattctggctctgcaacttccatgcaaccccacgaaagtcacttagctactttattcttcagcattttcagctataaaatgggggtaattatattcctacctcattgacttattgttaaaaactcaatgttaagtactcaaattcttgctaatatttattggacaatttgattgatcaaggcacaaagtatatacagaaaagtagatgaagttcaccccattaaagagtttactacagtgttgttgaggaaatacgcatgtgagacacaaccaactgcctgggaactcaaagtgagacaggttttattagagttcagaggagagaaagatcactcctatgtaggaggcacacagaattaataaagctagaagaaacaatagaaagggaaagatgtcttaactgggagggaaggaccataagaacaaaggctcaaagctacgtccaacatatctctactgctttgttgagtggttgaccagtgaagactgctggtagcaggcagatgggtccagaatgtataaaatggactggatatagaagatcctcctcctttttctctctacttatttttcctctaatgtgatgactgctacctgctcccatgacattttgctcaaatggtcttgaaactcacaaggataagaatgtccctccagtctatacaaaagggagaaacaggattgataaggaaggaagaacatgcttatctataaatccacaatctgatggaggaactattctgcagaacatttggtgaggttaaaagaaaaaggaaagcagcccatcatttgattgttgtaggaaccttctactagccaaacagatggaggctgaggctgatctgttgatactgggcaaatggcaaaactggaaaaggcaataggaggtgaccatctcagcttctgctggctgagtaattgggctaaaaacaacctagtgcctttcggcctatttttgtcacttttcagaatacaacaaataaattgctatattggatttaacaccaaccattaagaaagaatgactttatggcatggaagatggaggagcctttgatgacagtggtcctgatctcttggaagttttttttaacaaactttttatatgagaacatgtttagatttagagcactattacaaatgtagtgagagaattcttatataccccataccagtttcccctatctttatcttatattagtatatacatttgccacaattcattaactaattttgatatactactgttaatactttattcagatttgctgttttcccctagtgtcttttttttttttttttttttttttttttggtggttgttcttgttccaggatcccatctggaataccacgttatatttgtcattagatttgtcatgtctacttaggctcctctgggttataagttgacctcctcttgatctcagctcactgaaacctctgactcccgggttcaagctattcttgtgccttagcctcccaagtagctgggattacaggcatgtgctaccacgcccagctaatgttttgtatttttagtagagatggcgtttagccatgttggccgagctggtctcgaactcctggactcaagtgatccgcttgcctcagcctcccaaagtgctgggattacaggcatgagccactgtgcccggccacaaatagatattttaaatatgacaataatacatgctttggagaaaggtaaagcaggataagggagtagggggttctgaggtggaatgatgggactgttacttatatacagcagttgaagaaagccccattgctaaggtggcatttgagcagagacagggaggaagcaagggaatgagccatgcgcataccactaggaagagtatttcaggcagagggagcaaacagtgcaaaagcctgaagcaggagtggcttggaacactccaggaacagcaggttggtccatgagcctggagcagggtcagccaggtaatgagatggagtgagtgaggacaaacacaaatttgggcaggtggtgtctgggatggaatcacggaaagcgcatgtgagtggctgtcgtgggagctgtgtactgctgtggagttgggctatagaggtccttgtggggacttggtctttttctttgaggagagaggagctattggaggcttttgagcagaggaatagggtcatctgatttcatatttgaaaaggaccactctggtcactctgaatgttgcagaagtagaaagaccagttaaaaagtcttttactctactagtatattttatcttaatctattaatcttgatctatttgtatgcatatttcacatgtagtaattgtgtacatacagttttgccatctgtgtattttaacattttttttctgttgctctgtagtcctcaggtttataacattcagtggctgcataatagtttgtgtattagtctcctactgctgctgtaaaaacttaccacaaatggaatggcataaaaggatacaaatttattatctcacagttctggaggtcagagtcctaaaatcaaggtgttggcagagctgcactccttctggaggctccagggagaatccatttccttgcttcttccatcttttagaatccaccctcactccttgactcatggcctctcactccatctttaaagccagcagcatcttcaaacctcacctctgcttcagtcaccacttctcctattctgaacctcctgtctcccacttctacacacttttgttattactttgggtgcatttggataatctccccattttgaggcacttaatttaattacatctcgaagattccttttaccatgtaaagtagtatattcacaagttctggggattaggatgtggacatctttggggacattattcagcctaccacagctgatgttttgtagtttacttaaccattcccattgttgaatacttagaaggcatccagtttggggccattttgatattcctatacttcctataattatatactttgaccttcttttctttcagattgtgtctcttaagataaatatccaagtttaggtttcctggaacaaagagcatgaacatcttatgtatttgcttccaaatacagttaaattattggtaaatatataaggatgtcagtttccctacaacgtcaccaggtttgctttctgtcaattaaaggtgtgtttccagtttgttacaaaatgacattttattggtgtgtttattttatttccttgctggctaggttgaacctttttggagtgtgcatggcggcatatgtcatttgtattttgagaatagtgttatgtttattttgctttttagttgtatctggagctagaagaatggggacaggattagactattgcttaagtaagggcataaggctagcatgaatagatgatgtatgcagaactatgttgctttcaattctccatcaaaggaagtgatttccaaaattaaaagggtgttactaaaagggatttggatgacaatgaaagaaaatccaggtaatttgaatgcatttacctctctggggcacactggattgtatctcagggttagcagggttgaaggagttagcaggcatcatctttgagccattgctggtgattgttgagtgaacttggagagtggcagaggttccagaagaccagagatatgcaaatgttgttctatatagcttttgacaaagttgaattcctaaaactttcaatgtgtgaaatgcacccttgcaaaatttctgaactatcatcatataaattatttaggagtccagagaagagattgcattgatccttaggaaccagcataaatctactaatgcgtagtgaccaattgtcacattttcttttataaaaggggcttctatattggaagataatgccaaagacatcaaagcatttgacaaatatctctcaccggtctccttacgcacataatagagagatgttggaggatgacagaataatgcaataaattcatagctgattctattcatatgccataacataggtaatgactgagtgttcgtcagcctagaaagaggtttctagtggcaggtatttagggttttcttggccccaaactgaagcaggatccttagaacttggatagagatctgaaaaattcatatgtatgtggctgatgatgtaaacctatagaataaatcttcataatatgaactatgaaaataggccaacaccaactaggtacatttaacagaaataatgagaacttctaaaattgaggttgtatttataattgaaacaacagttgattttctttatttttggccgtcttgaatttcaccaattaaaaacagtaacacttgtatagtgaaaatgactttttaaggttaattcatgtatggtaggagaatgctgggtccacctacatatggttgctatgagagcatgctataataaagaattgctggactgagaggaaaagatgtgagtactgttcctgtcaccaccataaactagttgtcatcttgggccagcagttggcatcaccttccttggatctgcgtattctcatctgaaagctggagatgacaaggggtggggtgaagttagtcactttgctccattccggctgtcatgtgatatgaggcagtacaacttgattctcatgttccttggcgagtttggccaaatttctagacttttaaatggacccttccacatatttctagcttaaacagaccctttcaggccctctctgagaaggggccccttttcttttaatctgcaagttccttcagatcacccttcttcaggatcatattaaactatccacattttcaacgcttcaatccaagtttcaaacagtgtacttgagcccactttgatctcaggaaggccaacattttttttttcttctttttgggctcaggcccatgcctcaacatttctggatgagcctataccctcttcttcaccggccaaaaaagttctccatggctttaccatggggtccagccttcagtttcttcattctccgtcagccgaccctgaacaatcctggccaccgttggcatttgatcatcgactgtttctctagcttcctccccagcaccactattttgattctgctgtaatctttatgaccatttaattttgaatttttaaacttcatattttattttcctatttcatatcttcacattatcatttgtaaaggagtttaaaatatttcatgtgcctcgatttactcttgcatagtctgattttcccctcttatcagtcctcaaatatcatcaactctttgttttctgctcttatgggacgcaacatttgtacatcttcatacaatctagcctttggcttcttttgtctatatacttagattaacctctcagagttggagatctttgactgagggatatagtagtatagttcttgatccattttgggtacctttattttgactgacaaagacaagaggccacgttagcacattatattctttccttaaaactttaaaatatttaagaaggcagcatttatatttaaacataaatttcagcctccttcttggggcttcccttaataccaaagtaattttggttggaggaatgttttgcaggctgtgatatctcagattgcaacacttctcagcctgctgtttcctgtgcttctcctccagctccttccactgagaattctccccaggcagcattttcacgctttcagtgctcatttcaggcactctctgctctgctgtgcctatgcatgcttgaggctttgccctaaactcatgtgacctgcatagctaatttcaggttctcagtctaggcttactactgctgaacccaagagactgatgtattgcccagactcctgcacgctgtctgccagccacaggtacattctggggtcatgtattatgctcctggttagcacattgggcagggaacaagctacccattgtggctgtgaccaggtatagagtctctgcttatctgaaaaacagttctttgacctcactacctgtggccattccttcctgctactgtgtccttgatcagccagctccccaccctttgcctagaaagcattcccaatccctaccagtaagataaagggagcaaaacagaaagccagttctgtgtggcccaaggctctgctatatatgtgtttgcatccagtgtctgaattttctccctgaagaaatggaagatcttgggacggatcttttggtaagatttagatgttgcgtagctcctaacaaggctgtataaatagaagtacttaaagcctttaggacatggacactctcagaaagtgtttttagtttatctgatttctatacatgtttttgggctgactaaatgttaagtagttctaatacagtatgatacaatgggtctctacagtctcttgggttcagtggaagttaagtggctgttacatgtgtagttcacaacagtagaagacagaaataacctgtgtcttctccataatcacagagatacctcgcataaggactaaggtgccttttaatacatttttatcctgaagctctctgatagtggtcttctatgcaatgcgggagttcaaacttcataactagcactctggttcagtagctctgatgaaatcactggggctcctttagcaactgaattgtttgcatgtcataaaattatgatatgcttcaaaggcaaatatttatttagtgagaaatataggtgtgcacagtaaggcttgtgccttcctcatggcgtatttccttatgaagttcattagtctctgactctaggcaacgtgatataatgggagtggcacagaccataaatgtcacaagatctgagctcaagccatggtgtagctagttatccccgagttggaagacttcaggctcagaagccacttggtgtgtcagaggtcttttacctacaaacctgagagggactgggggaagttttagatcaggtcatttctaagaagtcttttagctttaaaatctcaaattagtatttctaaatgccattttacccacttttatataattacttgcccatttaaccacacttagaaaattaagaaaaaatatatctactctttcattctcgaacacagataaaatcattgttcatgttctggagtattagcttccttttttctgagcagatatatctaagaatgcctaaaacagtgtgtgtacatacatttcaaaaattggaatcacatattttttcataaattgatttttgtttcatttaacattatcccatgtcatctgagtagaacttagagtttttatccaaaactagatttccttggtcacttttgcagtttctttggaattttccatatcgaaggcaatgttatgcactctccaaactaagcacccttggcttctgaatgtgctgtaagtacagtcagttgattccattccagagaacaagcagtagaaatatcccagagcactctgccttcttgctgtcactgcgtgggtagagactgccatggccaggggtcaaggtggaggatgaggggtgacccctaaaaaatgatattagcatgtgaccaaacagtgtctcaaatcgtctcgaaagcccaccaatccattgtggaatgacctctacaaatagttttgcttctgcacaaccaggtgagatggagctgactctaagcaaagagatagagaagggaaacttggtaaccaagccttttctttctgttctctgcctcccttctccacgcctcacctcttcctctctttggcatttctcttcaccctctctagccccccagttatcactttctcctccatgggcccgttacattttgttcatgctgctgatagagtccttatcacgtattactaattggaagatttgggtggtagttgttgggggtggggagaaccagggtaggttatcatggccctactcataagaagtttatgtctcctcacttctatatgagtttcagaactggaagataatcttagctgaggttagaagaacatgtgaagctgaaatattactgaatatttaaaaattattttccactattacttgtttccttgcatgtggtttcaatgacattatgggttacattggttttggtggccttgcttagaatttcaacatcagagagcctatattaagaagtcctacatttagtgggaagttttactacatcactagatgtactataaggtcatctagtttctgattctaaagttctgtgatttgtagcactgtttccatgggaaagtgcattccaagttctaaacagctgagttttggatctcagctcctttgagagttgtggaccagtcagacacaaaattatctttaaatatacagataggggtatgtaatttgtgttgtatgtagaactaaccaccatttgagcccttattatgtgtcaagggctataataagagccttcatacattcacttattcccctcttcaccatgattgtttgaggtaggcattattatttccattttacagatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaaggtaattcttttgaaaatacctattttaaagcagtattattcccttcgagagacccattgattccctttgatggagcccaataccatgctggatctttgctgtttctgagtggtgtgaatgggcagctgatgtgggtggcctcaggagcctgtagaaagaggtgccccaggaaaatcttttacacaaaagaacactacagcatctgactgcaagattcaaataaacacactcaaaatggtctgtagagaatagagtggtcaacaatgatggatagtaggtctctctctttttaaaaacagatttaattatagtattcacacaaatctaactgaaaatatgagccagaatgttcatttgttcactcactcatcagctgtcagactttgaatgaacgcacatatgtaccagattttgtactaggccctaggagggtacaaaagtggatgaaacatagtccctgcttcaaggagctcagaacctagtggggagcaggcccagaaaccttcagatcctctgctgtgcatttttaaaatagcccaaataccaaaactttttttttttttttttcgaaacagggttgtcactctgtctcccaggctagagtggcacaactatagctcacttcagccttgaccttccaggctcaagcaatcctcctgcctcagcctcctgagtagctgggactacatttccatgccaccatgcctggctaattttttattccagtataaagttggggtttcgctatgtgcccagtctggtttcaaactcctgggctcaagtgatcatcctgcctcagcctcccaaactgttgggattacaggcacgaggcaggcttggcccaaaatgtcttttaatgtcagttttgaatgagctttcataagaacactgcatatgtgtgaggagaaatccctttcacatggtgtagatttggtaagcaatatttccaatatcagaaagacttggtcagtgtatgttgatttgccaaaacccactggcatataaggatgctgtggctgttgacttttcacatttgcttaaccaaagtgccagtttattgaagatgagttctgtgtcatgttttactgccctgcatgttaagatttgcttttcatgacactaagacaatgggagattgaatgggtggagttaaagaggcccctgtccttctattgattctccttgggtttcctgctgagtatgggttgaggctctggccttctcaactgggtgccagatgaatgtaccgggaatcctgttagggtgacatctaagaagaagactcataaagcacaatattgggaactcaatcagagcttgtttcaggaggatcagggctgagcttagtgggggttcttggtgatagggattccttcctgaaacacatttgtcttcctggaaaaggaggaaggtgtaagaacgagaaccactgatgtatgcaggaggtccgtagcctcagttgccatagatactgaaggctctgcatggcctggccaaggatggacaatgttacaaggtggacccacaaaccacagtgatcttcatcctcaagctggggcatgctgggcctcatttttggaaagtacattttccacgagatgtgctaacacaatggggttctatgtataatctgccttgaacaaataggtttcatgggaggccacgaaaaaacaacttcatcaagtctcccactctcccattaaaatttattcagtggaaagcatttcccctgttttttggatgaaaacatatcacgtggctattctgattcctcatatataataaaaagccccactttaatttgccagatatttaaaatgtctagtatcatgggatagttaaagcttccagcttcattcatatttataactgctccccttcccctggctagggcctgttgcagggagagggggctgtggttggaggctttttctcttgcttactcagtagctatgacttctggactggggtgaggggctgggtggggaacaggaaggagtgtaggaaagcttttactaggcaggcggtatcataggagagctctttttgtgttgtgggtgtttagagttgattctttctcttgtggggcccttttgtgggttctttggagataccctctcaccttgtctctgggggcctctcacctccaatttccttggtggggctgctgcactctcttcagcctaattgcagactgtttccacagtctctagaaagcccaccaatccattcgtactcctgtctgctgggttctattgctgtccaggtggcccttgttgggaagaccctaatatatagccctgtacatatgctcatggtgtggtccatgggaaacactcacacttcctttgttcccaccaactgggagagggcaggctgctcccagggcaactgtcgtttcctttggcttgtccgtcagcatccagccagctctccagttcttcagatttcttaggcagaagtcccaaacaaggtcacagtgccttccacatcgtaagagcctcatgctctccaggtagtcctgttgagccccctcatgaggctggaagggggagaagcagggaggggcaggtactcttatctcttcctaagcttagtcctttaggctaggaccagactggactgcagcctgcttgcttcaatcattctctccttttagccaccaacaagcagtctgacctacttgtagccacaccgtaggtaagaggtttaagaccagtgaaaaaggttttgggctatgttctttgaaaaactgcatctaggcctggcacttcactttggaacctggtatctcatccatcttagcggcttgtttgacacatcccattttgacattctgtaatactttcttgggaagcagggcttatccttagctcttggagatgcacatgacacacagcatagaaaaggctcctgggagtagacaggaatgtccacttcactccagcctcttcctctcctgccctccatcctgctccaagggcctgtgctccacctgaatcttccatccaggaagctccctctctgctgcctgctcccactctgtgttgccagctccttctgttcctttaggattccttaatgttccttccttagtaaagacttctttgttcaaaccccacctaagtagatctcccctaattttctgttttctgttaccgcaattccctttatttccctcacagtacatcttatattataaatgataacgtttccaaataaattatacaagctatttagtgtcttactctcacatcaaatggtaagccccataaaggaaaattcatgtctgttttattcggaaactaaccagtgctcactaaatatatgttgaataaatgaatgaaagcatgaattaaaaagttacttttgtttaagctgttctttccccacatgtctctcttcttttgtgttaactcttttttttttttttttttttgagacatagtcttgctctgtcacccaggctggagtgcagtggtgcgatctcggctcactgcaacctccacctcccgggttcatgctactcttgtgcctcagcctcccgagtagctaggactacaggcatgcatcaccatgcctggctaatttttgtatttttagtagagactgggttttgctatgttggccaggctggtcttgaacttctggcctcaagtggtccacccacctcagcctcccaaagtgtgttcactcttaacaaacagattcttagttatatggcatgcacagagttttggaagtactgagacaaggcttaatttttggtatatttttctgttcatcatcatctcccctcaccctttctctcctctctctgtctcactttctctttccctctggctctgtctttttctctcactctcttctaacaagaacttagtttgaggcaagtggagcagaggtgccaccccatgttacagatacccacaccaaggagagttagctgtgagataacctaaggggttgatggcaggcatggcccagagctcagcacttccatgtctcttctggtcttgtcctctctgtgcctctcctgcagtcctttgtgtccagctgtcatctggccttgcagcaaggcctggcttaccacttccagaacctgccgaggtagcagcagcctggcctcgggctggagtggaaagactagttcccagcccagaatctatcttgcatggtacacagcaagagaaattctcttcaagatgcagccccatgaaagcagcatgtttacaggtagtagatccccaaagttgtcatagcctcccctaaccccctcacaccagacctgtccctgcccttggcccacacagttggggattcatgggctatgggaatgtctttctccttaggaatagaagctggattctgaaggaaggcgctggacttgaactaggcttggcgatcgccttccctctcattctttccctgcctactccatagacagtcctaactctggccacaagtcagagaatttcacattcctcccttaacaagttttactccgtataaggccctgggggcagtctagatttcctgggcaacaacttgggtgtacttgcttcaggaggaggaggaggcttatctcgtatgtgcacattcttctggtgtgtcctatctggttattatcaaatcgaaactgcagcagttgaagtttgttgcttaattactgtctgttgattgtaaaataatagaccaccaattttgttggttagttattactgccacgtcgttataaagtgcgcgctgtaacatggcagtgttttcctttatgctgtctttttgatgagtatcattatttacactaataataatggcttgcatttgaaatatgcttcagagttaacacagcacttccattttattatctcatctggctctgttataaggaaatgcaagcaggcaactaattttaggagagttggaggtaaaatttttattctagaaattactataaattttggcataatatagcttctttttacagcaagtacttattactttagttaaaaaatcagaagcgaattttaaaattgtagatttgctgttttttttacaccttcttgtcataatccaaaaagtagagtactagaagacatattcagtccagggtcatataaaatcataatatcttagctagaagccactcctctagaatttgatccacagtatggtttaacactacattgtaaggaaatggattgtctaccccagagtttgcttagcatagaggcttcatttatgtatttatttaggtaaaacttatagaacataaaattaaccattttattatgaaaaatggaggtgaacactacctctatctagttccaagatattttcaccattccaaaataaaaccccatcctcactaagcagtcactccccattccctactccctgtagcccgaggtaacccctaatctgctttctgtttctgtggatttaactgttctgggtagttcacataaaaggaatcgtacaatctgtgtcattttgtgcctggctgctttcacttagcgtaatgtgttaaggttcatccacgttgtgacttgagtcagtgcttcattcctttttacagctgaatgcccaatatttttaatatcaaaacatttctgggattatggaaactccagccccacagacacacagtcccaccatatccttctctccactgggaatgacttctcacaaatgtgggattttagtccataataaagtacaaatgctaaagaagcatgtgtagttatagctgtaatttgctgcattttactttagactcaggaagaaggctctagatagttctatgcaaagattacaggtgattgtattcttcagacactcatatcatgaaagtttgtgccatcataatttttacagacagtgcttagaatacgcctggatttgtagttttcttgcagtaggcaccactcggcggctgagtttcagatttcttttctttttttttttttttttttttgtttgagacagagtttcactcttgttgcccaggctggactgcaatggcaccatcttggctcactgcaacctccgcctcccaggttcaagcgattctcctgccccagcctcctgagtagtgggattacaggcatgtgccaccacgccctgctatttttagtagagacggggtttcaccatgttggtcaggctggtctcgaactcccgacctcaggtgatccgcccacctctgcctcccaaagggctgagattacaggcgtgacccaccgcactcggccaggtttcagatcttttctccagcctctgtaggtgacaatgtataaagaaaaaagaatgagcttctgaggtggacagagctgggttcaaatcccgcctctaccccttgttagccatttgtccttgggcacatgacttgaagttccctcatggtaaaatgagaataataatatctactcatggtcccccaaagatatccacatcctaattcttagaacttgtaaatattaccttattttgaaaaacagtctctgtagatgtggttgaattaagaattttgaggggattaccctgtatcattcaggtgggccctaaatattttacaagcatcctaatgagaaagaggcagaggggaacagagagggacatgcaggggaaggtgatgtgaagacataggcagggagtgaagtgatgtggctaccagtcaaggagtgccaattctggcagccaccaggaactggaaggggcgagggacagagtccccctgtagcctccagagagagcatgaccctgccagcacctcagtttcagcccagtgacattggttttggacttctcgcctccagaactgggagagaataaattttcgtagttttaagccaccaaatttagtgtaatttgttacagcagcctcaggaagtgaatgcacttctcttataaggtaacatgaccacctgtaaccacatgttacagtttgttttcctcctaaaaaggacagaagtccttctatcaaaggtgtttctcaagctttaagtacagaggttaagagtttgagagcagggcttctcaacctcggcactaatgacacttaggggccagaacattctttgttgtggggcggtcctctgccctgaggatgttcagcggcattcctatccactagatgccagtagttccttccccctagttacaacaaccacaaatgtctccaaacattgccacatgtcaactgggggacaaaactacaccctgttgagaaacaccaaggtagagtacaaattaagtacagcttaatcccagctccatcactaagtagctgtgtggccatgggcaagttaggcaccctctctgagccccagtttcattatctataaaataataacagtccctacatcacagggttgttgtaaggatattcaaatgatgtaatatgtgtaaaggcttcagaacagtgcctggcaaattgcaaagtatttaatgcaggaaaatggttattaacccatgctctgccatgctactttgtcacactgttttccatagtttctgttatagaactaatggccattgaaaacattttccaaacagtaacttctgttgtaaagatgcacatgttttaatattaaacatccttccttcattgccctcccctctcacctttcagctccccaggatttgtatgcgtagattgcctgtcagttatgctaactcactgaactctttatataattccctggataagctgtaacaacaagcaaaacccttccatctgtcagtgatagttctattattccataattacagctttctcgtcggtgacgtagctgttgcattcacttatgaatgtgtcagtgtctccattcaaatgtgtgaaatatttagcagcgtttagcaggttttggtgaaatgttagaaagtgatttgaatagataccatcatatacttttgtaaggaagaggaacgtgctccaactgtgacccaggtcactgtatctctaaacactggagacacagcagtgaataaaatgaagatccctgttctcaatgagtttgcattctagcacactagaatacttatatgcacaataaattagtaaatggtatcgtgtttaggtagtgataagactatgggaaaccagcagtttagggaagggggttgggagtgctgaaggtggcacaagggggcaggttgtgatattagaggggacagtttttaatcctttcatggggataatgaaaatatctttgacatggattgaaaaccagtgtttgttgatgcacctctgctgatgactaatggttggaattcctaagtctttcaaaggtggtgaaccttttgctccttccccacagactgcctgggagtgcctttcaaagttaagccatgtggctttggtttatcccagctgctgtgggaattctttatagaaacggttcagggatcattattggcaatgcggtctcagggaagaagtatgcctggtagttattgtaaagtggatgactttgggcaagtcgtgtaacctctaagcctcagtattgttataacggttgtaaggttcaaatgaaataatgtatagaaagcacgtagacctgtgtcaagagcataataaattcttagaaaatgttggtagttgtaattttatgattagctttaaagcatatttctaaggtactatgtaaatattcatggcacttgtcatttctttctaaagcatacctataattatcagcttttcataggcaaacatttcttgcataaaccttgcctgccaaagaagggtctgcatagagaacctatgaattgatctcttgtgagcttaggcttggacactctttgaatactgtgtgccaactttcacaaagattgagatgagagaatagaggcagggagtaattcaggtaataaaagtccagctactaaaaatgcagttttgtgattagttctcatggatgactccagagattgacttttctgggtaattatatggcccttcattttgttggtagggatttacatagacatttgttaaatgattttagaatagaatgagttgcctagttatgctgagtgaattgagaaattcctcaaagagtcatgggcttcattgggaaatggtcaagatcaaggatggagcacatctggaattcattgctgcactgcaaagaaagtttgggaactggtagaagtggtagttacacaacattgtgaacatactaaatgtttactttaaagtgtttagttttatgttatatgaattcagataataattttcttaaaaatggatttctgacagtgctagacctcaagctcagattccctattttcatatctaattatttaaaagaattgttaaagaatatgatagtccttaacattttatatatatggaataaattttctttaattttataaatgtattaaaggttttatatttcagtatatccaacatgcttgttttctcgtttataaaattcagttattccaactctaaaattttatggtaataaattgattacacaagtagaggccaaagctgtatccccacagtgtctattatggtatcttgcccatagtaggtgcccaataaatgttcactgaattgtatgtaggttgttttctgagttgctcataactttataatgtcatacattaatgcaagtggggttaaactagacagtgttagagatcttcaagttcagcttgctctaagatgagcaacaaggccgagaagttaggtcacttacatagttagtgcaagggtaggatattgctttttaagttaacatttgtagaaacatgcataagtaattcattcagccatagccattggaatatggtttggtttcctttttattctttctttttttttcttcctttctttttctttctttccctcccttgctgtctgccttgctccttctcttccttctttcttttcctttctctttttttagatttacaaacctgataatgcagaaaaatcatgtttctaggggactgcaaagcccatatttcatctcatcttttgccaggagttaccaatgtatcctttagtcagtcttctctggatttttcttacctcacctattagatgagaagggtagtgcttattttcaatggaatgctctgcttttgaggttaatttacaaaaactctttattggttaaaattttaactctctttctgccatatggtgcagatatttccttcaatttgcttgcctttcagttttgtgaaacaaagatttaatctctgagattagttgttagatctaatatttttctctacgattttggctgttggcatgctaagataggtcttttccatcctaccattacataaattgtaccttaattttcttctagtacttttgtggttccattttttacatttaaatcttattgcatctgatatttatttttgtataaggtgagaggtagggatctaacttcatattttccaaaatgaatagccagttaaccaaactgatttaagaatccatctttttgttacattaatttgaaatgccgtaatgaatactgaattctaggcttttttttttttaacattttaaagaacagaataggtaagaacagaataggtttaaattcctatagctttatgacacattttgataacacattttgatatctagttgtgcaagccctatctgaatggttaaatatggtttatttccccccacattttcttgatttttttttttttttgagactgagtcttactctgtcacttaggctggagtgcagtggcatgatctcggctcactgcaacctccacctcccaggtttaagcaattctcctgccgcagcctccctagtagctgggactacaggcgtgtgccaccatgcccggctaattttgtttctttttttttttttttttttttttttttgagatggagtctcacaccgtcaccgaggctggagtgcagtggcgtgatctcagctcactgcaagctccacctcctgggttcacgccattctcctgcctcagcctcctgagtagctgggactccaggcgccagccaccacgccttgctaattttttatatttttagtagagacggggtttcaccatgttagccaggatggtcttgatctcctgaccttgtgatctgcccgcctcggcctcgcaaagtgctgggattacaggcgtgagccaccgcacacagcctaatttttgtatttttagtagagatggggtttcgccatgttgtccaggccagtcttgaactcctgacctcaggtgatccacccgccttggcctcccaaagtgctgggattacaggcgtgagctaccatgcccggcccttcttgaatattcttcatgattgttcttctataagaacattagagtaattttgtcaagttctaaacaaaactgctagtgggatattaattgtaactccattgcatttctgcgtttatttaagggaacattgtcatctttacagttaagctttaacattcagcaggatggtgaatcattttattaatttaagtcttcttttatgttccatgatttcttttttttttttgagacagagtctcgctctgtcgcccaggctggagtacagtggcgcgatcttggctcactgcaagctccaccccccgggttcacgccattctcctgcctcagcctcccaagtagctgggactacaggcgcccgccaccatgcctgactgattttttgtatttttagtagagacggggtttcaccgtgttagccaggatggtctcaatctcccgacctcgtgattcacccgcctcagcctcccaaagtgctgggattacaggcgtgagccaccacgcccggccggttccatgattttttaatgttagttctgtacacctatcttttgaatgtattctatttgtttatactctttctttcttttatgaatgtgaatttttaccccattttattttttacctggctctttctagaaattagggaagctattgatttttgtatattggctctgattttattttcaggtgattctactgaattttgtcagtggagtttcataacatttccaaataataattttatcttccagtttacattatttataatttttactgctttggctaatacttctagaaagatattaaaataacagaggttatatgaggcatctttttttctgattttaaagagaatgtcactagagtttcactatcataaatgatttgtgattcttgtcctacagtactctggcagtgctagtctcttttttttaaataacatgttatctatatgtgatcttcttgacatgtagcagttgaactctgtgaaaatggcaactatatttacctggaactctatgtctaaacagtgaccaattgatcaataaataaatacattttattgtgttgctctttctgccttgctgaactttgaaagatctgtaagaatttgaagtgcatcataattgttaggaaagtagatcaaacatttatgtaatgtaaagcctttatttttcatgcagcattgtcaagaccttagatgtacagtgtaactgaatggttgaagtttacactcatacttcaaaaaagaaatgttttccttttgttgtttgctgactttggagactgctttcccaaagaatccactttcgtttttactactgatctgtgtttttggatagcaccatggcaccttgaaagcacatttatgagtatacctctgcttactgatatcacaagaagtttgcaaatatcacaaatatattaggtgctaatgtcagaggaagatactaattcaaaatgtattcatgtactttcatagatatagaccctttttgtttcttactgctccctcatacaaagaataagttgctctgtataagtaacacaagatttttcctccttaaaatgtggaaaatattgaaaaatagagggaatataagcctgttactagggataaccactgttgatatttacagttgttttgtgtctgagtaattgctatcacactacatactggtttgtatactgtccttttatctaaacattacaatcacatgtgtttttcctagatggtggaacatttaaataagacaactaaagttatttaggctagttgggctgtgggaatctgaagtaagaggtggtctgtgcaaccttagaaatgggtggagccggaggatgaatcgcaggatgaactcagcatggttcacccacagtcttcaaatagtcattgatccaggtgtcctcagagagcctgaaaaacaatgcttagatcatcctgcctgacctctaggaagcttaaggtcacctgaacaaaataatccttttctttcagcaactgggtggcctctgaaagctggccctactttgccatctttgatcagtcgtctggcactgattacagactattaacagtgtagactcattcctgttgtgcacaaagaatcgtgtggagaaggaggctgcataaattgtcttactcctaagaccaaattccagggacttttttagggcctttggccatgtgttattttatgtaaatattttttaagacctccctgtttgacaggtcagcatgtctccttctattgtataatattaattctagaaacttatagcagatccatttccatttccaaagccgaaaaaggaagagcttgaattagaatttaatgtgaagagtttgtaaattgcttatattcttattttgtcagcttgacacatttgtggaaaaaatagatgtctaaaaatgtctagtagctgctatgcagtctgcagtctgtgtattcattcttcatttacagtttttgttttacaaggtcatctgtaaattaacagcctaccaacaaacaaagatagtattgcagagagtaattttgaacatctttttgtcctaatcatttttgcatttcaattaattgaaaataaagagaattagaaaagaattttcttttatctttcaccttgtttgaggattctgataatgtgtacatgttattcttctctctatatgttttctctatcatttcttctttgcaccaaacaaatatcttatatttttgcctatatttccattttctggaatttcagcttaaaatacttgtatgcatctcaatctttagaagagatttagaacagcattgtctgatacaaatataatgagaggcacatatgtaattttatatttcatagtatgcacatttaaaaagagaaacaagtaaaactaatcttaatgatatattttatgtagcctaatatatcaagaatatagtttcgacatgtaatcaactatgaagaattattaatatattttctattttttattcagactaaatctgccaaatccagtgtatattttatacttatagcacatattagtttagacacgcaggtttcattagaaatacttaatctgcatttagatttcataactttcataattgaaaaagtagactgacattcccaagttgttccaacatacttagcagtttcccaagaacagaaacaagcatcaattttttaaaaactttaattaccattatataaaatttaaagttcaccctgtcagttacaggcttatcaaatactaagtggctgcatgtggctagtagctagtggctatagtatttggcagcacatttctagaattttaattttctattttaaaagacaagattaaaatttcagtaaaaaattacatttgtgacatggaaggtggcttaaaagaaagaggttggcattactggccaaggtagcaaaactcagataggagaaacttcagagacctagtttcattaaacttagctctggtttatcgtgactgaagagaactagggggcttcattatgttaaaaaaaagaaaaggccttgaaaaatgtgagttcctacctctttctctctgaaagagtcggtagtggaggatgcttgttttagacctttggttatactcctgctctctctcgtaaattctttaatatgactttctaagaatgctctgaccatgtgtggatactaagccctttaaagagtggctgaaatatgtgattttaaaattatttttaatttaaaaactgatactcatttagttattagaaaacatttatgtatgtttggagcaactgggtatataagtctactttttcaactgcaaattttatgaaatctaaataaagtcagaagattccagttccagataagatgaagtaaacacagtttactctgactctgccaccgagtgcagctataaaacctggatagaatgcatgaagcagctatttgaggaccctgaaaagtaaatagtggcaggacgatgaggggaaatgaccagaattggaagctccaccaaattgacaaaagagaggtaaatctggttcctgttacttcactatggctagaagtggaagtctctacaaaggctttgaaaactaaactgatgttggaaacgtaacccacggaaagaggtttagaacttgaagcctgaagctattcacgacaattgcctgctaagacaaaaatagcaacattctcagtaggattgaaacaaaactcagaatcttgtaatagagtgttccaaatgtctaggatacaaccgagaattacttggcatatgaagaaccaggaaaattatccatttttatgaggaaagacaattgacagaggccaatactgaaatggtaaagatgttggaattatctgacagacttttaaagcagctcttacaaaaatgctcaacaagtaaaaacaatcacttctgaaacaaaaagaaattctcagcaaatgaatacatgatataaagaagaaccaaattaaaattttagaattcaaaaatgcagtaaccacaattcttaaaactcactaagtaggctcaataactgaacagaggtgaaagagaggaaagtcagtgaatttgcagatagctcaacagaaattgtacaatacgaacaacaacgagaaaaaggattgcagggagaggggaagcagagcctcatggacctgtggaataataataaaagatctaatgttcatggcatcagaaccccaggaaaagagaggaaaaaaagtatggcactggaataagatttgaataaataataactgaaaaatcccaagatttggcataaagctacagattcaagaagctcataaaaccccagacatgaacccaagtaaatctcactgaaacacatcatcatcaaactgctgaaaacccaagacaagaaaaaatctcgaaaacagaggaaaagaatgcattacctgtagagaaacaatgatttgaatgactgtgtatttctcatcatggagaaagtgatataacattttaaaactactaagagaaaataattgtcaactcagagttctatattcagcaaaaatatccttaaggaactttcagacattctcagctgaagggaaacttaagagaattcattgccagtagtagaccttgtataagacaattgctaaaggatgttcttcagacagaagggaaatgatgccagaaaagaatttagaacatctggaatgaaggcagaaaaatagaaatggtgaatatctggtaaatacactagactaatcttctcctctttagttctctaaaatatgcataatggttgaaagaaaacaaatgttgtctgatgaggttttcaatgaatgcagatgtaatatatgacaactatagcataaagcagggagtaaggggactcatggcgtgttaagatttttacattccagttgaagtggtaagatactcttaagtagactgttaaaaattgagtacagcatgtgtattgtgatctctagggcaaccatttagaaaactaaaacatgtcaagaaaacataataaagtggaatactaaaaaatatacaagtaacccaaaagaaggcaggaaaggggaaaccgaggaatgaaaaacggaagaaacaaacagaaaacaagtaataaaatggcatccctaaatccaaccatatcaaaaagtacattagatataaatgttctaaacacaccaattaaaaaacagattgtcagaatggataaatacaatcaatattttcaaagaaaatttaacacctgaaatgagatgtgcagtaagtataaactgcaatccaaatattgaaaacttaatagaaaaaaatgtggaatctcattactttttatattgatttcatgctgaaatgttttttgtgtactgagttttaaaatatattattaaaatttcacctattacattgtatatttaaaaacatgactaccagaaaaatttaaattacctgtatggcttacattaaaatttccatcagacagcaatcttctaaggtatggcttttgtaaaaaatgaaaagaaatatttcaagcagcaaacagggttggtcagaagctacatttttgtattatcttagttaagacattaggagatctggattaccctttattaaggctaacaaatgtagggctaaatgtattaaatttagtaatacaatataaaacaattttggtgtgcacaacatctgtggctagctacaagctcagctctgtggcacagttcatgtaactcagccatgagcacagctctcttttggaatgggtcatccatccattgctttacctagtacttctcacaaatcaataacaactactctagttaatcagaactaaaaatattgttgtcaaactactctttctctgaaaaagttactttaaccatacattccaacctgaagcaaacagaagtcctcagtgaaaaaaacagacaaacaaacaggactattccaatgaaatgcaatggaggtggacagtgaaacgtgggagttaagttatctatgaccagtgtctagtggtgtttctcattagctgctgaggctggagttctgtgaaaaggagaattcatacccacatttctcagagtgagttgttggcctatctagttgttaggactttgggacagtccatgagtgagagacaaaccatgaaggtcagctcactctgctggactcttcctctaagttgtggtttaacgtttagctaacagagaccccattgcttatctctctgtcctcacctccagactgtaagctccttgagtccaaaaaaccatgactattttgcttaaagctctgcctctagtattagcataataatacgtaggagctcacaaatatgctaaaaataaatgagcatatgccaaagtctcatctcagccaagccttgctggcaggggatggaaaggtatttttggcttcattctaaagagtcctattctcaaattttcctgttgacatgttctacctcataaaaacacatacatattttctgatggttgtaatctggcagatagtgatcattttggttttagttttagttttatatgtagcatttaatcctagttactagtagcataaggaattggagaataattggagagagagagagagaatgaagattcttatattggctatgcaactaactagctgtgaggcctggagtatggtattacccaagccttctgatgtggatattttcatttgcacattaattacatggagtggaccagatgttcctctctgaggtctctctggctcttgtaaaatggaatgaatcttgcatgcacaaagcctcaaaattccataccaattcgaatatatttcagaccattgctataaaattgctgcaaagtattatggtagagaaggcaatgatcattaagatatggtagtctgctggagttcttgtctctcctttgggggaagaaatactcacatgctttagagattacagaaataatttatttcttctctgaggtgaaatttcctatattcatttcttattgctgctgtaacaaatttatacagaattagtggcttaaaacaatgcaaatgtattatctcatagttctggaagtgagaaggccaaaattggtctcactggactaaaattaagatgtctacaaggctgccttccttttggaggctctggggaagaattcctcttcttgccttttccagattctagagttaggctgcattccttggcttatggcctccttccgtcttcaaagctgcagtagctggttaagtctttctcacatcataccatttgtacactgactcttgtgcctccctcttaaaagaacccttgtgactacactgtgctcactgcataatccaggataatcttattttaaggtcagctgattagcaatcttaacttcacctgcagccttaattccccttgccgtgtgatagactatagtcacagtttccaggggtaaggatgtggacatcttttggcagccattattctgcctatcgcattgccatctttctgagtttttaaagttttaaccaataattgcagagctagtaatttattttcctctgttcccttttcgcactctgaattagttaatggatggcaggaatcaactgaaaaaattagggctaagtaatgtcctggattaactgaagagattctcttcagggaaagctgtcacaatctccagctatttcttaaagctggttatgtgtagaaggttcttttacctaagatcatgttcctatccacaaaaagacagaaactatgtccttttaaaagaaataaaatgcattatctaagcttaattttttttatttctaatcaaaaatatcataaatgtttgccaaagttcattgtgcaattttttctccctgctgagcaggtggctgaaagtcgtggaatgttgtttttctgaatacagattcataatgcccatagtgaacatgctcattaaaatagaaaaattagactgtattaatttgcatttcagtccactcttgggtagatttgttatgtgtagttctcactataattatctgcgtctttggaaatgccacatctatttgcagattaattatgccattatcaaaggcttagaaggaaatcttcaaaattcattgttaacatttaaagaaaatgcacaggaagctgatatagaagagataaaccagagatttttctgagtgtacttatagtgggcaacagaactaacacttatctttaggttaatggtattatttagacttgcacttatgaagtgttgatttagaggataatacattggttaagagggctcagtggttaagttccatttcacatttattgtgatctctgtttcagccacttagtcacttagaaacgtttatgagtgtatgggatgtgccacttcctttagaagacaatggggatactatccttagagctcccatactgtacaactccacgtgttaacattttcctcactctgtagtctatatgagtggtaccctctggagtagcgcagttatcgaatatgaggcttaatgcaaggatcctggcattctctatgacagaggctgtgcacagtggggaacagattcacaaacagactcatgttatgtgtgaatgggtacatacggtaataagagcacagaagaagggagcatctgacttttcttaggatggaccgggatatctgggtttttcagaggaagctttgctcaaacagagtcttgaaggatcaataggaaatggtgagacaagaaaaagttggatgattttctgggccaagccagcagcctgtgcagaggaaaagaggtatgcaaaagcatgctacatttacaagacttgcagatatttgagtatgacttaagtgtgagattcatgtgggcatgtgaatgaggcaaagcgtttaaccttcctgtgctttacttccccatttagtaaaaccaataaaacaacactacctaccttgtggggttttgtgagttttaaatgagatatcatcagtaaaatgcttaggttaggcttgatatataaaaaagcactcaacgaatgtcagctgcctttgagacgatgatgatgatcacaatgatattacatgaggttgaaaaattaggcaaaagctacagattctgtgctaaggagttttgacataatactgttggctggggaaattgtgaaggatgttaaaaaaaaatacaattcacagctctatagatttataaactccgtgtcatcatttagcaaggctgattagaccccatgaattgatgcatactacttgaaatcatttagagagactgatgaagaaaaatgccattttatcaatttacactcaaaatagaaaccactcagcatgctgtgataattatggcaatgaggtggtgtatttccttcctatgaattggtaaatctccttgagctcctatgtgaacatcacatggtttcttaagtgaggatgaggagagtcagagtaaatgtagatgagtgctttgaaaggctggtggattagccttgctcacttactacatgtctggcagggagatgagaaacaggacctggttggtaccttctctggaaatgctggttacactctgatcttctcctccctctccttttacagatatcccttttttggacacccctctactataacttcttttttttttttttttttttttttttggaatcatcacctttgtttcagcatgctttcaggagatgtcaatggttttccagttcatcttgatttttttaaaggtggctgctctttggtgatattttggggtttacttttatctcaacaataagtggtctccatagtgttcatctattcattgcattcagcacctaaacagtgcgttatttttgggaatagtcagttcaacccatccactgtgggagaattcacagtactattgattacataggatggcattttcacttctaaatgtcatcttattttcctaacttgttgttttaatcatctctaacattagattttgagatccattctgtttgaggacctgtagttcaatgaatgagttgggagtataaaatttgtctcatgaagttgctatatttgtataataataagcttaactcatcaagttactactgtaggcctttagaatttgggtatctttctagtgaatgctttagggatataaacatttattttactggattttcatactactgtttaatgctataatgttaccttatacattctaccaagcattgtaagctcagacaaattaggcaataatttgtcaaaacaaaaagtaataatgctagcaaagacaaagaatttatgctagttacaggtgataaactaaagctttcctcgtcctcaccttcattctgtggtctcttaaccataaacatcaatgtagcaaagaaaaattgattttgtaattgattttgaaattgtaattaccttgatttccttagtgatggttatttaaaatactgaagcattttaagctaaataaaactaattttaaaataaaactaatttttattttaaaaaaaagtggagaaggcccatgtaaattccctgccttttagaacatgcattctgaatattgttttaaagcatttcaacaaaaatgctttgatggaatgctacagtcactgctcattatcttgaattcacttgcaggtcatttgttcttaactgtttttttaaaaaagtgagtgtttacatgtttttactccaaaggaaatcagttacaattgttcataatgggtgcttatttaaaaacgaaagctctgagaaaaactgtgcttctaatttttaatatttcaaacattatagatgttggcattgtgatgaaacaaaacttgccactagtaacattttaatggtcttttccatggagcagttggagatgaaactgtgtcataaaatatttattaaaatgcttatactttactgaaaatttgagggtgtacctgtgctgtactgaattctgtgttctagcaaatatttcataatgatgcctagtacaaatttttattaatgcaacatggagaaaatggtcgttctcttgtctgagttggattaaagcaaagttccaagcagaagtgccagagctatttttaaatgtacaaggcatgcatttttttcttttaacataaattctccatcaaaataggacctaagattttaagaaacaaatataatttattatggctattttgtgtttagagagatactaatagattagagaaagtgatttgccatttattgagaagggccaaaaagcacattaaaatatccaatttgttagtaacttttgaaaatgcaaacttaaaaaagtgccactttttgttatctaagtctaaggctaagaagaatgatcataccaaggttgaagtagaggtggagaacaagcactgtcagatctgttgggaatgacaattgatgtagactttctcaagggtgatgtgtttacaagaagccttgctatacatatcctctgatctagcagttccactgctggaaatttaaccttaggaagtaattggacaaggggccaaaaaataagacaatgatattcatgatagcattgtttctaatctcaaatattggaaacaccttaaatttccattagtagataatcaaattatggctcttttatccactgagtaccttgtagctatatagaatgatattgtgtaggaaaagatggcataatatggtaaggaggtgacaacttggtatgtataatatggttaaaaaagaatgtgcactaagacttggtggatatctataacaaaatgttaacagaggctaccactggataatggattgcaggaaacttttactttgttttttgctgctttttttatatatgaaataaatacatctcttataagcaaaaactattgttataaatgtatctatctttgatttagcacttctactttgaataatctgtccaacaaaatgaacgtacaaagatcttatataatgttcaatgcagcactgttaaaaatagttgaaaaaaattaacctacctgcttatcccctattagaaatatgtataagaaggtcatggaatagccatacttcacagccattgaaattgaagatgtaagtctatatttactgatatggaaaaagtgttcacaacaaatatggaaagggcaagttaataaacattgcattatgtagataggtaggtatgtacacagataaaaatctggaatgctttttattacagtgtcaaaagtaattgtttctgggtgatgggattgtgggtaattttcaactatttttttctatgtgtctgtattttaaatttttttacaataaataaatatctctttattaccaaaacaaaggtaaaaaatcaacaatatcagatatcaaaaaggagaagtaaccaaaaaatattgttaggtactacatgaaacactatggagataggtgaagtaagtggtatttctaggaaaatttactttattaaagtggtcccaggagagagtcagtaaccatgaaagaaataaaaatgttatcaaaagatgctttctaaattcaaagtgcaggcccccagatagcccaagtaaattcttcaaatagtcagggatattgatattaagtagggtaactatatagtttattgaagggagctttaattgagagaaccagtataaactagaatgccccatgtaaacctgacagatggtcacattactatttcaactttttctaagtatagagcaaaagacagactttcaagattttttaagataccaaaatgatcttagtaccaaaacttcacaaagatagctggcatgggcatgtgcctgtatgtgcacacactgcagatcaatcttgatgcaaaaccctttcataaaataccatcagatagaatttagcaatgcagtccgggcgctgtggctcacgcctgtaatcccagcactttgggaggccgaggcgggtggatcacttaaggtcaggagttcgagaccagcctgaccaacatggtgaaaccgcgtctctactaaaaatacaaaaattagccaggtgtggtggtgcacacctgtaatcccatctattcgggaggctgaggcaggggaatcgcttgaacctgggaggtggaagctgcagtgagccgagactgcgccactgcactccagcctgggtgacagagcaagactctgtcttaaaaaaaaaaaaaaaaaaaagaaaaagaaataatttagcaatgcattaaataaataccatgatcaagtaggtacatcacaagaatttaagcttggctcaataatggagaagctagtccacatattagatgaaaaaagaaaaacctgtatggtcatcttaataggtgccaaaaatactaaaattcaacatccactagtagattaatttgggcagtggttacatgactgtttaagtttgtcaaaactaactgaactatattctttaaaagggtgaattttattgcactaaattatatgccactaaaatgaacttttaaaggaataaataaaattataagtttatagtaacaaaaaaaactgacacacattcccaaataaaaagaaaaaaattaaaacttagtaaaataagtagaatgcattcccatttaaatcaaatatataagaatgctgactttcactgaaattataaactgtacacggaaagtaccagtcaggagataaggaaataatagacataaatattggggaggaagttgcaaagttaacattatttgcagatatttcaattgcacagctagaaagaatcaactgaaaaattattggaaacaacaagagaaatcagtaagatggatggctagttataactatgccggtgggaagagaagtgggaagaaaaggaaaaagtggatgtatacatgatttgaagtttccaccatcattcatatgtatgtgacacaccccaggccctacactaagtgctgcaggacactttacctacaagacacagtggctgccctttttcagagaccatgtagccagagacagaagttgggtatacataaaaatgacaaaggactttatggagcagtgatcatcaaggggcagaagaggaattcacagtcctggggaaggaaggcatagactgtaaagtaaggagagagaagaatgggttgtcagaggtcacagcttgtcctcagagcctaagacagcctttagaaccttttgattaggtctaccctatgtttaacttttaaatttgttttttagttcaacatctacaaattgtaagcatccacatttttaaaaatctagatttttaacctctattaaaaaattagaagcttgggcaatgtatggcatccttttctgcaagggcagctgttgggtggaattgagcagtagctgtcagccacctttaggtgcctgggtctctccagtctgttaagtgcaaatgctctattctctcagtactgtcacccattagttatctatctgttgttggcccttggaggcatttcaatagaaacccctggtgctaataataaagtaaagatactgggcaaaccttctccactcttggtcatacaacagtacttttaaaaattagctagtcgtagtcgccctgttgggaaaagccacggaagcatttgaacaaatgatgaagtgtttgcctcagtaaatgtacaacttgtttattcccagtaatgcatccctatttccccgtattattttttaaattgaaaaattattttaaaaattgaaaaagaagattgagaggctatctttgtggggaactggccattgtctacatcttcctcaatgcattctttcttttgaattctgaggcatgtgcagaatgctttttagcccagggaaatctttctgttctgtgacacatcattaagattaattgagcctttcaattttacattttccaagagcaaattaagtaggaaaaatgggacaggttttcactgtcacttatactgtgtttttttttctagcttatattctacatctgatggtcagatctgttaggtattcgaaaagcagtagcattaattgcattttcccttcctttttgctgaagggcagatgtttttatgttgttaatggtgggttgggttaaacataagcagcacactgaaagtataactagctattatttatgagaaaagaacaatgtaattccccagatttggctaatctaaaactaaggtttattttatagactttaaataaataaatatttataacctataattttgcccttagttctatgccctcaatacactctaggcttttggtcccatttgtctttccttttttgtatcatcggtatttttcttacctctagttatttctggggaaagaatgaatgtttaaggaaattctgtcctcaagaacacttccgtggcctgtcaaggtggcatgacattgcttgctttcctctcgttcttcatgaaaatgcctagcagggtacctggcacccagttggaacttgaaaaatactttttcaatttgaattagccaaattctggaaaacgtagcctatctcactgcctccagtttcttaccacctgcctacggtgtggctcctctcatctgggttttccacgccttctctcctaggcctctactagagctctctccagatcaccagttcctgccctgaaaaatcaacagtccttatttcttcagcatttctcacaagtgacctctgtccttctttatgcaacaagcagcactcatggaatagaaaggtcttcgctggcttctgaatgaaaattcaagaacctttctttctgctcactcttaggcaataaaatgtcccgctaccatgtcaaatcactgtttcaagctggtatcccaagtgtccagtgctatgtaattagctaagcctccgacttcattatacctactcctctccctcaggaaggggagtggcaagtttaaaatctcagctcctaaggaggggcatgattctcttcctctcttttcctgccttttgccaccagtcctcctgcaccttgctgggggtctgacttctcagggtaaaaataaggatgaaggagagaaggatctagaataatttgagtattgacttggttgtctggagagattgttgtgcagttcatgctcaaaagaagtggactggtaccagtctgcggcctgtaaggaaccaggccacacagcacgaggtgagcagcaggccagtgagtcttactgcctgagccccgcctcctgttggatcagtggcagcattagattctcatagaagcgcaaaccctactgtgaactgtgcatgtgagggatctaggttgctcactccacatgagaagctaatgcctaatgatctgaagtagaagatcccccttccactgcccaccccatcccatgggaaaatggtcttccatgcaactggtctggtgccaaaaatgttggggaccgctgctgtagtgggtttggggtagaactgagctcatgtgtagatgcatttgaagaatctgtggaacatatagcggaaatgtatgtaagtaactatatatgacagtctggaaatgtcagccctatctagagatagaaatttgagagatatcagcatatcgatcatagttaaaaccatgggagtggttactctttcatagagaaagagtttaaagttaaagaggaatctagagaccaaacattagggagcaatccttacagacttcatcaagcatcctagctctctcggatgcctttttcaccctgaagaaatcattggctccttctgaacctcagactccctgctgatgaaagttagtgaaggtgatttctaaagtccctttcagatctgacatgctgtggttctatccctttgcattagttttcacaactgctttgggacaaatagggcatttactaattgcttaattttataaactcgctagtatctgtaagcctacacaattatatggacccctcatctatctttctgataagcagaatggctgtgctgtacacctcaactctaccaacagtcttgaaagtaaacctggaacaccatgaaaatgacaggtttgaggaacccaagtgtatttcatgtgtgtcaatagggagtgatgaataagagctcagcttctgaagccagacccctgggctcaaattcctctactgtcacctcaggcaacttagttaacctctcctctctttgtctcatttcccttatctataaaataagggtaagaatcctagaaatcgaatgagttaatatacacaaaatacttagaaggctctggctgggtgtgaactaccatcatgtgataatgataatgataagacagccttgtctgatgaaaagggtcttaactgtaagggctgaaggttactatcttagacttatagttttcaaaaggagagtgaagaaaaaaaatctgtaccatttcctaataagtgggaactttcagatggctgagctctgtggatgataaaaattcatttcctactatcaaattgagctacaggtgaaaaagttgtggatactgaaatacagttgtatttagtttataaatttgtatgaggtaggaggaattagaacacacccacccttctttttgttgcacttactggtcatatttagctcaaaggaaaggtgcatgaaaagggaagaaactgcccgctttctccataatactcctttttatcttaaagtgtcttagaggctaaggaattcttggctgtgaagttgtcaccttctaaaaccaaaaaatttccctaaggcatgttgcttatgaatctctaggtttgcagcagcagcttcaaacttcttttgaacatttgacctactcctccaaacatccctctggatgtcagctacgtagagggaaagacacaccttaaggagcagtaactactgagacttcttgaatcttctctcagttgctcttcttattttgtctgagagaggctgggttcaacctgtttgtcaggcacagccaaacatgtgtcctcctgcagtttattgtatgccaagaaggatggtgacatgacagcagtaattcaaaatggggttttaagtgaataaataagaataagcctctgggattagtcccaattgaaaagttcagcgctaccggggagggtagctgctactgttggggattaacaaatggcttgctgcagggaatagtattcactgatccagctgcattttagttattgatggcctctctgccccagtgcccatctctcttcccagacacacagattctgctggcaaagatcttagaaatgtggttttgcccaattattctactcagaaactacctgcttgtatatgaaccttccaattcatagtttttagaccacagaaaatgtatagctctataatactatttagccttagggaagaagatgaagaaagaatttccctccacagaatcaaactgaaagtaagagaacagagaaagccttctggtaagagtagtggaaaacgggtaggatcattttgcgatcacagcactgaatatgtgaaaaaagaactctgttataggccctttactgtttgcaaggccttttatggacaccatattattttatctttacaacaaaaaggctgcatccccacttcataagtgacaaaagtgaagtctagagaggttgacagacttgcccaaagtcccactgctggaagtatgataatctgactccaagtttggttctttctttgctatgtcttgctgtgcactaatacactgagctcttaagattcccaaacacccacccagctgaaagatccaagtatataaatccaactagatttgcagcctttgcatgttttaaagttaactttatacattatccataaagccatcagttcctccacccccttggcaaatggattaatccttcaagggaaggatagtagacagacagacagaagcatttcaccaaagaaagggctatcgattgtattcttcgattatggcctaggagggttttaatgtcaaagagaaggcaccaaggaggttcctctgaggttccactgaggaacaaggagagatatcactcctgttttctattctattcaaaagacttaagggattagagactgggggttagatggctattttaatttaatatcttcctttatagtcccccatggaaaaaactaaacaaagtaactacaatccacaattacttgtttacttgaattgtgctgagggcctagcctgtaagattcttccatcaagtctttgaggcccctttctatctgttcactgtctccataagaaggatatgtctccgtgcaatggtgtgatgccttttcactttatcaaagttgagagggctcagtagccgctttgtacacttctaccttgattttctaatctttgctgttgctctgaagttttaaggattagattaagcaattttaaggtagataacatagagggtgtctgtacttaacgggccctcaatgattatttgcaaattgaatggttggtaagtttctgagataatctattattttctttcatcagaataaccaagtaagttcttggtggccagaattgtgtccttaaatgcaattcttattcttcacatatgttctaacagcccacgctgagttcctatgatgctactttaattctgttccatttcatgaattattctaggaggataccactgagaaggcaacagagccgactttgcttgaacaaaatacacaaagcttgcagttgagaaaataaaaggcaataaaatgggcttcatttcctcctattgctttcttagaagtaactaactttaagggtactgtgggaacagggtcaagaaaagctgatggttctattcttggtgatctgtaactggcttcggacaagtcttcagagtttatgtgaggttgctggagtctactggtgtttagggccccaatgaaatgcaactttaggggtgtgtgtgtttctcttttctctctactgtcaagctagttctcttccactgatactgttgtgtgtcagagagatttggaagctcagcattccagtttagatttctggttagtgtttgaataagatatcttccttccaattgaagtacatacattcttatcctattctgtccttctccatttacattccatgctgtttttgtccatatcaacaacattttaagatctaactttatatagaaacgtgtatacatttcaaatagtttgataatgttttccatatgtgtacacccatgtaaactagcacacatatcaggatatagaacattttcttgtagcccctctcagtcagtcctaagggtaaccactataatagtccccctcatccaaggggaaacattccaagacccccagtggatgcctgaaactgcagaaaccaaatcctgtatgtgtactgctacatagtactacagctaattcatccttccatgttttatgtctggtgcctcttttgtactttcatcaatgtagattctactggacatcttccagaagaggccagtttcattgcaactgaagtctcactcagatagtatcttttttccttgatcaacttcttcaactctgctagaaatgtggcagcagcttcttcattggcagacaaaacctctctagtaaattttatatttgtgaatccaaacctattaccaagtcggtgtaaccatcacttatttgcagtaagtggcttggtgtcactcatttcaggggatcccttgctgaaatcttcatataggcttactgctttctgatgcaacacattgccatcaattggaatgctttctgttcatgtcttccacccacaaatttaatgccctttccatcttcactaagcacttatcacacactgtcaccgtaacttctgcaatttgaggtgcaacagcaaaactagcacatatttctttttccttcttcacaacttcatggatagaggatttgttcttaccacagatcttagcaatctcagcatattttttttcaccttttcacttagaggaagcactttacagcttctatttggcatattacaattgtcagcatcactactgttgtgtttggggccattattaagtaaaataagagttactcaaacataagcactgctacagcagtcaatctggtaactgagatggctactaagtgactaatgggcagggagcatagacagcatggatgcactggttgtagggatgattcatgtcccaggtcagatggagtgcgacggcaccagatttcatcatggcactcactcacagcagcatgtaatttaaaactcatgaattgtttatttctggaattttccatttaatatttttggaccaacgttggccacaggttaaccaaaactgtgggtaggaggggactacttattttgacttctaagttggttttggctgtttggggacttcataacactgaagtcatagtgtatgtattcttttgtacttaatttctttcattcaacattatattgtaactcatccatgttgttgggtaaagagttccattgtataattaaactgtttatggttgtttgagtctggagctattacacataataataataatgcaagaaacattcttgtgcatgtcttttagtagacagatgccctcatttctcttggttatattgtcaggagcaggattccttagtcgtgggctataaatatattttcttttaataggtacagcaaaatatttttcctaagtggttgtaacagttaaccctaagttcctatggttttaaagcacagttttttctgcagtatttttactgtaggttgttgatgctaattaacgtggaacattgaggtatttgccagcccatcttagattatatacatacacacatttttgtattttacattcattcaatttggattcagaggtagaaatttgccttgtcatatatttggaaatttaatagtgaaaaattgccctcagaaattaaaagaaaactatctaataataatattgttctaagtgcctactccctgctagtcactttaaacattctagttccacttattcctcattgagatcttataaattagatatcagattgggactctgtcccaattctagatattgttatggtcatttttaagctatttatttattttaattttataagatgaggtctctctcttgcccaggctggtcatgaactcctggactcaacaatgcttccacctcagcctcccaaagtgctgggattacaggcgtgagccaccacgcctggccctaaactatttatttttaacctaaaaataagtaatattttttaaaatataagtaatattttaaaaatctaatattaatcacaataaagtttaactgtggaatagatgtctggttttgtggcttcacagtgagaatgaatcttgactaagtgtggtatttaattcatgggagtgaaaccggaagggggaaatgagccagggaggttccttggatcctgcctctggcattattcatttgcagctggctacattgcattttatggctgctattttctctcatttgtccttgattccttcgaaaggaagtagtaactcaatatattaaacactgcctagaatcctcagtgctgaacattttaattctatcaaatttttattagcatatcgttgaaaaagaaagaaaacctagggcttcagtttcttaggtcacataatgggtagttccagtaacacacctgcatgggctggagggcactctaaataataataatattcctgatctttaaaaaatatatcaaggtatagagctcttagaatcagtgtagaaaagcctgttagactggattttcaaataatagagttctcttcccttttagacaaagctatattaatccatcctttcattcattatcatgcattcacacaatgattcaacaagtacttactcagtacaatgtgccaggccctgttctagatattaagcatataacagagaacaaaacaaaggtctttcccttgtagagcttactttctcagcaaagaaacaggcaagaaaatgtatacatatatgtcatgtggtactccggaggacaataaaaacagagtaaggggcatgcaaatgtagacttggtgttgagaactgcaattgctttttataaggaacagttatgaaagcctctccatcagtattaatatttgtgccaggacctgaaagcactgaatcatacatgactcagtcaattctctgtccccagctctacaaggacaagggtagaaactgggaaaccagctaagatctctaataggtgtgttcaggcaagaaccaaatagcatatatgttttattttgtgggctcatcaccatccttgtgttttattagtaaaggtaattattatgtttatccagacatggacgaacaatatctggtacatttgagccacattgataataatgtagtaatatgaagttaacagtaatatgctgtgggtattataaattgagttctatatttaatgttcttttctacttacctaatattaatttttttgtagacatttcctcctctctcctgtttttattgaataatttgtagcattctttcagccacttacagttgaacttcagtcatttgtgtctcctgttcatcctctgcacagcatgctattaggttctgttgttgccttgtctcccaaatccatctccttctgcctttcccaactttggttttagacctttgtttcgtctcagaattagccatccttctctaattcatgcgaaattctctctttaatccatgtgaaattcagaaaaaacaatacaggtttttgaaatgagtccttgattcaaattggttcagatctttgttcttccgtgtactggctgtagtgccttttgcaatttttgaacctcaatcgttccttcgtaaaatgagtataacaatatctatgcagtgaggattaagtgggattatggagtgtttaaagtgcctagcagggagtaggcacttagaaaatgttggttctttccaccttgtgttcttctgcttcagatctcttaatttctacaactctaaatgtgctattttcctctctcagtaaataatactaccatctcaccagtttaaataaaaaaagctatgagtccccttcgaataatctatttctttcacaatctaaatttaatccatctgcaaatcctatttgttctaactcaacacatatcctcagtctctctgcttctccccattgacactgctacaaccctagtccaagaatcttatctgtactgttgccataggtcctgaattcatccttctgcctccactctggtcttctttcagcctgttttccacagagcctaagtgatatttaaaacataaaccagataatatcagtcccctgcttaaaaccctccagtggcgtttcatcatattcagaatgagatccaactcttaccctctcctaacactcccgctcttatgcttcagcggcactgcccttttttctttttctgctaactcatcaaactcatggctgcctccggccttagcacttgctattctctctgcttggaatactcattccccagatgtccacgtgacttactgcttcttgtcatttagatctcaactctaattgtcccctgacttctatcagtagtgctccatcacaccatcttacttttcctaaggcttaccactatctgaaaatagcctgcgtttctctattttcccctcagtaagaattaaaagttcatactagggcccatttcctagcagtgtttggcacatagtaagtatgctgaaaaaaaaaaaccttgactgactgaataaatgaacaaataaactcacttttaatgagatatcaaggttttatattaattacatgagccaagaattgtggtttcatttttaaaatgtgaggacctactggtttaatccttcatacttcacacatatgcttgtgctggaactatgactgtaaatcaatagcaataccatcctctgttttggcttcttcccctaacctaaatagttctcagatttacttttctctccatctccactgccacactgtcaccttagtgcaaatgaccatcctctctggccttttttctgtaaggttttaatctcccaatatgtattctccagactgcaggccagtgagcttttcagttgctgttacacccatgcttgaaaaccctttaagttttcattgttctcaagataaagaccagaatgtggtctggtccaccacctcacgtcaggccagccctcactctccactccaggccacactttctcctcccctcctggttcccgcctgccaactggctgggtagccgttgcttcccgcttcctgcaaagttctacatcgcacccatttcgcccacttcttcagatttcaggagattgttccttcctcgaggaagccctccctgattaggccaagcgccactccacgtcatacagccccacatcaccatgggcctctctttcagggctttgttttatgagtatgcaatccagaatatgacaatcttattgacatgcgtcaacgcgagcttgcgctcaatagctatttgccgaaggaatatacggactagcggcccgaccactcctcgcccctcccctaccactgccgcgcacatattacgcattaagcaggcgccgcgagtacggacatcgcgagcgcctgcgcgaagggctacgcatgcgcagaggggccagcccgctgacagattctcggtggcggcggcagcggcggcggccctggactgcggggaatgggaatcctaggtccctgactgagcacctcccccgcctccctgcccccgacatggctcaggagaagatggagctagacctggagctgcctccgggtacgggcgggagcccggcggagggcggtggcagcggcggcggcgggggcctcaggaggtctaacagcgcccccctgatccacggcctcagtgacacttcgccggtgttccaggccgaggcgccgagcgccaggcggaacagcacaacgttcccgagccgccacggcctgctgctgccggcctcccctgtccgcatgcacagcagccgcttgcaccagatcaaacaagaagagggcatggacttgatcaaccgagagacggtccacgaacgggaggtgcagaccgcaatgcagataagccactcctgggaggaaagtttcagcctgagtgacaacgacgtggagaaatccgcctcccccaagcgcatcgatttcattcctgtgtcaccagcaccgtcacccactcggggaattgggaagcagtgtttttcgccatccttgcaaagttttgtaagtagcaacggattgcctccaagccctattcccagcccaacgacccgatttaccacccggagaagccagagccccatcaattgcattagaccaagtgttcttggaccattgaaaagaaaatgtgaaatggaaactgaatatcagccaaagagatttttccagggcatcaccaacatgctttcttctgacgttgcacagctgtcagatcctggtgtgtgtgtatcttcggatacccttgatggaaacagcagcagtgccggatcttcttgtaactcaccagcgaaagtcagcactaccaccgactctcctgtgtcacctgcccaagcggcttctccatttattccactagatgaactttcgtctaagtgattcactcatcctgagactttctttttgcagtggagagagagaataatctagttggggcaaacactgaactttgtcaattaatttgaggctatttcctatttgaccccttttcttttttgaaattccctgaaatgatgttattctagagaacttctatgtcaggttcctttggatacccttgaattcagtgtagtaatattttcagacgtttccccaataagtgtgttgaagcatacatctttacgctgctaatatgtctaaatacatatgttatcccttgatttttttaaataactgagagctctatttatttatgggattattaagttctgatgaaaatataaatgttgacttaatcagcatagtaaactgatgtttaaaattccatacttcatgcccacactaatttttaatgttattttcagtggttgccgatttccatttgatgaagaactatacagcttaaaaaaatacgttagttatatctatctagtggttgtctgttttacccaggaattcttggatatttagttttctgggtactgaagtggatgggagggggaatgattaaagaacaaattataaaagtttgaacaaatcttttcaaattaagtatataaaagtaaacttttaagaaaaacatttttaatgagattttaatagtaattctagtcagtcatacaactataactactatagagaaaataaaattttttcctttttttttttaaccggaaagtgcatttgcttgggtgtaatcctaaagtgaaatgggacagtgccttgcagtctttgcccactatacataggctaaggctaagctctttgtactactgcaaacttaaaagtttttcaaatgtgggaaacgtgtgggaaggcttgttgaactttggcgcactcaggtaaacaatactctctcaattgttgatatactttaaaatattcagttgtgcctcagttccagaaattattgccaaacaggagccacagcaatttttggctacttttctgctctgcccatctgtcaccttactggttttcccttgttcaggaaggaagcagctgtttccttgccaacaggtcccttcctctccatctcccaccaaactagggcaccattgattagacaaaggtacagtgtaacttgggtttctgacagcaacaacaggactgtgaattgtttaacctctgtggttaaagctacagcttgagttgactgccttggggatgtcagttaattaaggggtgatgatttgcaagagaaaattagtggagagtcacataggtaaatcattatttaacttaggttttcctaaagttagaatagtcgaatgttcttttctttacctttacaattaagacaaaatgtttaataagaatagcaaaaatttttttatattatgcatccttatacctcacatatcttccttaactagatagtttgacagaaagaatggcatacaaagaggaaaggggaaaaatgactcagaacaagacaaaagctctgactgtttaaagttatcgcttacagagactttaacaattttgtggaatttttacaactatgagagtaaatggaactggtcaactcttgacagttgcctcaagatggagtgaaattgcatcgagggtaagactgtgtccacaggtttaaaattctctcttctgagtaatagtgttcatgtgctcccattctcgaccctgttgttgaaattcaaacttaaatagcctgacttcttgttgggtaacttgccctgcctccagaggtatttgaacttcattatcttcaacacaggaattgttaatcttctcacttcacctgttcttgcattagctcaattgatgtcatcactgatttcctaaactagaaactatggaagcatctttgacttttccttttctctgttggattagcttaatcaccaagtcctgtcaacttctgaaatgaatctcaaatttcttcccttctctatctgttgcccctgattttgccttaagttcttgcctgagtgatctcccagcctgtcttctgtctccttttggttcagtctttatactgcctcttgagtaatctttctgaaatttaaacttgatatttttcgccctcttgcttgaaaacttcacttgcttccccatttcctactctttaaggaatgatttctttagcctcagatagaaggacctttatgatctggccatattctgaaatagcttcaatcctctcctcatctctgttccagtatacatctttccttcttattctgcaaacattagaccacttgatattctttaaatatgtcatgtacttttcttgtgtctgttctttgggataattcctatccttttcagggaggcaaattgcacgtgagtttaagtatgaaggcaatgtatacctgctgattgtaaaatatttaaacattgtacatatctgtgtggttttaaaagtctgcttttaattatgtaaaattcatcttccctttccacagataacttctgttaacaacttgatatctattgtacaagatgtgttactggcatttccatgtatatatgtatataaatgcaggaaaccaacatgtcattgacacctctcttctttacttttccccatatctaatcattcctcaagtcttactgatttttatcagctagaatctatctccttatttctacctctattgccactctgatccaggctaccagcatttccctcttaggcttctgaagcaacttcctaactcccacttgtgctcctcacactcactctggtcggctatccattcattctccatacagcaactagagtcattcttttaaaattgcggacctgatccttccatctcccagctgaacgcttttcatttgcttcctgttctcatgagtatgccaaaatgtattaattctgggctaggaggccctgaggaatttggtccttccctcctcccccctcgttttctgtgcttcgccctcactggcttgcctttcttttccttaaatacatcatgttctctcctattttagatccttttccccgaaggtatggaaacattatttctgtaagcttattcttctatatagatgggaagtttttaaatcagataaggttctaagggcatgtggacaatttacgttatcatagtattgttcataacgtccatcattattctgtagactgtaagggcttacttagctcgtgtaagaattatccttcaaaaagcatttttaaggtattagtattgctaatctataaactttgtgcaagaagtcctaaagtcaatagcaacatttatttaaagtacagtttgtcatacttaataaacctctggtatattttcctttattatgcttgttaaaaacacagtataaatgggagaaatcattaaagatcattaactccaaggctgctggatgttaggacccttaagcatacttaaaagattgattgtaatcaagaataacttgtatcagattgccttccagtgattcacatttattagttcaaccagttacatacctgtagcaagagaccagtttatttggcaataaaattggggaaggaatcaagacttaaatgaggaaagtgagtctgagaacattttttttcagggtgtgtttatagattagtagaacaattttgaagatctaacagaggtgggagtcaggggaatggttgccagacaattgaaccaagaagatgatgatcatttcttgagtagcaccagagaacagaagaaagagttggccttggaaaggaggtctggaaacttatttttcttctgaaacaggagggagagtgaaaaggctaggcaaagatatccataaatgttgaattgatttgttgttgcaggggtttaggagtatggaggtaggtatatgaaaagtagaatttgtttctgattgtgcctattttccaattattgaggaatctaagatacatgaggatagggacaggagatcatttggaagcttgagtgcagtaaaggtttaatgttgcctctgagaatctaaaggagtaagttaaggacaagtagaaggcttattaggctatgatggatgccaggttgcagttggatggcaggcacaaggaagtgggttggattgactaggtttgggaattggttaagtgggtactaggtaaagcccagtgtgtgaagtagttaagggttctgctgaaagtgtagtttgaatgattggctgaggcattgaggataagagaagggagcagaggcttatggactagaccacttttttcagggctttaccttatcagccatgacaaagtatagagaatctggtctcaatgtaggtctctcactccagcagttttgcccacatttttcatggctgttagagaatcagggctgaaggcaagccttgagtgccacttacttggtaaaaaattgtgtcagattgctcactgtagccaagacagagttctttgtggcttctgtaacttgccatccaagtaaaaaaattttcttaaaagttgaaatgacctttgtataaaaagtaataaaatacttgctatgtgtcagggactgttctaagtgctaagcaaatatatcaatgcatttaatctatcactatcatctgaggcaagtgctatcattatcctcattttataaatgaggaaatggagacacaggttgagttacttgcccaggattccagagctgggaggtaggcagcgaattgtggtggttaggaatatagacagtggagcagggtggctgtggtgaggattgaatgggttcgtacacaatgtgcttacaaagatgctgggcaattagcatccttgatggatgaaactcctgctttcacactcagttaacagtacaatatccttcaaagcaggctatccttttatgaagcgattgtttctgatgttagcctttcttatagtgaacagacatttccctctaacttccaccattcaattcaagtccacctttggcaaatgcaaaacaagccttattcttctttttataggtgatagcccccttctagaaatcagaaatactgatccttctctaatgactacttcttccttccagattttagaaatcttgagctgtgtcttcagtatgctgtctgtgaaataaggctatcattgcgtggcagccaagattttcaccagattgtgattcccttatgaccatttgccttcctgggtaggaagtgataaatggcctgataacgtgagtttttgccagtaataataataatgatgtgttaatatttcttgagcattcactatgggtccagacactatttttagtgctttacatttatgagtgtttaaaatcctcatgacaaccctgtgaggcaggtgctatggattcccattgaagagatgagaaaaccaaggccattttctcaagtccctattactgtctattttttttccttttgaatttaggcccttttggtttttttattattattattataaacttttttttattattaacttgaagaccatttcccagctaactttagcaacttgctttattttactagtgctgctacttctgttttgaatcaaatgataggtaatcattccttaaaacagtattatattaaaggaacataccaggaagttttttttttagtaataggcaagaaattaaagtgtatagaaggaaatcatggttccacagctttatgtattttttccctatagcattaattttattcaaagatttaggggaaattttttgttttagaacgaaaagggactggtagctaactgttgtaaatacatggtagagtagagtacaaaacaaaagtctatgaggaaatgaccacttaccaagcagcttcacggagcaaccataccctccacggtaaccattctcttaaggcgattgatggaagagtttccaaccggaaggttgggattcagtaccacccccgcatggacaaatgcagatgtgagatcactcacagccatgtctaccttcatggaaaatgagtcggccctctccaataccatgacacgcaacctctggctgcactgcggttatgggattggcttctctcctacttttgcggttatgggattgaaactctcctactttttagaaaatcctgtggaaggatcaggtaataggaaaaaggctggtgaattctgtaaagggaagtgagtagaattgagttgggttagggaaggaagcattttaggcagccaccatggaaagaaggcaggccaccttctcactgacgatgagacccaagtgctaaaggccagcaacaggcagtgtctgaaaactagtctgatatcatcacagtcttcgagggaaaatatgattctactagggttttcatgtcaatagtggactcgaatttaagaagtctccagtccttttgtagaagtacaagtgttttttatatatgagcagaaggaccagaaagaaaccaactcttcttcccatccctccttaatacagaatttatttacttttcttgccaatctttcatttaaagatgtctcgtaactcttctttaattctgtttcctcctccttctcctgcatagatcagatccttaacagacctttccttgacctaacattcatttttcttccaatttttctttctaatctttctttctttttttttcagagacagagtctcgctctgtcacgcaggctggagtgcaggggtgcaatcttggctccctgcaacctccgcctcccgggttcaagtgatactcctgcttcagcctcctgagtagtagggactacaggcatgtgccaccatgcctgactagtttttgtatttttagtagagacggggtttcaccatgttggccaggctggtctcaatctcctgacctctggtgatccacccacctcagcctcccaaagtgctgggattacaggcttgagccaccatacccagcctctttctaatctttctaccttgaaaaatcaacaaagaagtctttcgtcagctttagataattaaagccaagcaagcaacaaatgttggtctttttcagtagaaaccatgttaaaaatagttacacaagcatcaagcatctctacccccatcacacaccttgtccttgagaactggttttgctgtgtttcagttctgtccagttctccctggtgaccctttcctcccttgattagttccacagcactgcaggctaaggggaaaaaggaatgtgtgggcccaggaggggactgtcctaggagacaggccgatactttttacttttagataagaaatgaaaaagtgttcatgacttttccctctgcagactctcccttcaggttcaaacttggaactttctagctttggtcatgtattttatgcccttaaagggtttgtacttttctccatacatatccagatgaccctaagtccagaaatagccagctgctgcatcttaactacaagttaattttatcatattagaggaagatatcaggaaggtttttgttttgttttgttttgttttgttttttagtaataggtaaaaaattaaagagtatagaaggaaatagtggttccacagaacaatggttctggtttggaatctccaatgtgaagacccatggtcttccttaaacttggtagcttgtggggatttgtttttcccacatcccaaaatagcatctctgtgactgggctgaacgtgtacatcctttgtcgtggagtcaggctcacgtttaggacccctttgggcatctggctggtgactatcactccctctgtggtcttccccattgcctgcttgggtcccaccattattccaaagcatacaagtgaactactgtctcagaaactgatattatatttgacatacactgggattgcaaccagtttctttgcactgacaggataagagagcaggcggaaatttccatcaagagggatgaaagaaaggatatgctcagatttccagcacttaaacacaaggatggaagctgatatcatccaaccacctggggttcatgaagggaagtgtaaggtctggcattccaatcagcttgatacagcatcaatcatcccctgggtttcagcagcaattgtagaacctgatttatcaataatggcatcaatctcttcaatcacatcaaaataggcctcattgttggtgtatttcaccccagtacctcgccaaggcaccattgacagttatccagtgggaagttggtcacccacattggtgcttcctgtgatggtgttgacaactgttcgaaggatagtgggaggctttatcttttctttgaggatatttgactcggtagccaacgagtcagcttggaaacccattgccaagcgtctcttctgatgccgcataaatcacaatcacattgtccttcatcactaattctgaacagactccaacatagtcctgaaatgtgtccactactcagtgaagaaactctgacaaatagaggggagacctccatctggatcacagccacaaaaaaagatcttgtggtggtaaacacttaagagacagtggtgaggggtagggataactggaggcacactttctgcctcagtagcttgttcttgcacctcaaaaaagtattcacaaacagaacagtgtaccacacttctccagtgtttctccaggaaaatatctccagaggagttgatcaagaaaagtctataaatcatgatagactgtgattgtcaggtgagaaaggaaagcctttttcagtctgaaagcctcaggactctgcagattttcaaccccatctttcaagaccaggctcagtcttcctctactgcacgagcctgaagtatccctcccttgaatacccggcctcactcctcggagcacctgatgcttgctccaccttatgaacaggtcccaccctgctctgctttacatattttttaactgactttatatttgaaatttgaaattaccaatcccacaaattttggatttttttgttttctttaaatatatacatatatataaacagagctatgtttaatttatacagtatctttggttgttcctagattgtcattcctagggaaacaaagacaaccagtttgacccttccctcccctcctttcccctaaaaaactctaagttaaaactgtggcatttttttaaaggaaaaatgtaacaccaagattcaaagaaggatcatgcttacctcttctttccctgtgagaggctctccccagaggtagagatttaaattcagaggaattgagcaatccttgagaaactttactttttaaaaacttttcttcatagaaaaatcaattcactggtgagtaagaggatccgaaaaaggaaaacctccctttgaaaacattccagaattggtgattagacttccagtttcatactatcatgtccctacattagacattttggaacaaaccatcaaaaaccacagttggttccaaagggttagtcttatttttagaagttcagtaaatatttagaaatcacttcaacactgacttttagttctatatgtagcttgtttgtgaaaataattttataacagaataaggttaagcagataatgtcaaataattgggtcttgtgtatgtacacccaaacgcacatgagcgcgcacacacacacacatacacacacgcacccactcactcacccttgtggacctttttctgcgttcctggagccatatttagctttcctgccactttagattttcttctatttttcccttcattttcttaaacagaaacttgggctttgtaaatgatactgaactatgcatatacctatgtaggtactatatagatagaaagtgtgctgtgctttgattttgcatcagcggttcagatttcaagtgctgccctaagagagaagtaagtatttggtacttgtacctaggacctctttgtgcctgatttctgtttctcctttttgaatttctagaataaatactcggggagatgtaaaaaatactcatttacaaattttaaggcaacatgactgaaagtagagaacagagaacctattgcttttgtttacccgcagaagttcggttctgtatcaatgccaggtataattctggtttttttccagttgcctacagtggtcccccaaaccaaactaacctcttaaggcttggctagcaaggcgtgttgtgaaagaatacaattgagaaagatattttgtgccccagcagagtaaaatggttgtttgaggtaatcgctcctgggattcggcaatccatctcccttgctttaaggacaaagaaaggttttaatgtcgagatgccaagaggattatcagaacttgggagtgacaagtagctgttgagtattggtatcttttgggaaggaaaatatgagatatttgggagggagtgggagtgaggggatgatggatggattgggtatttcttttggcactgtaaatgttctcttggactattattgtgaactccctgttgagtaaagaatggcattgaggatggttttcttcattgtttgtttcacttcatttaggttttggatttgaatcaggatgtgtttaagaatttctttgagtctctttcccttgatgctctcttcttttgagtcctcttggggaaaaaaggtaaataatataattataattgtcaggttactttgagtcaagaattaaaattcctgatgctctttaccaatttatattgcatttctaactctgaatttaaatttcataccttttctatatagtctttctcaaggccccgtttaccatactacttgctttcagttatttctaaaatacaaacttgagaatgcaactgtaatggctaccacagaagttcaagtttaaatcaaactatgcagtatgagtaaaagacctctccacttcaacatatcccctggattccagtactctagctaactgagctgcctgcagttcagtgttttctgtatatgcttactggctgtgctttcagacaagctgtgtcctctgcttaaaatggcatcttcttcctccttcctccacaacccctgccaactgtttttccttaactaactccttaaaaatttagttcaaggggcacatctttcctgatggcccctgcctctacaaccacggtcagttaggtgctttcttctgtgatcctgttgttcccagggcttccctctataaaggcaattaatagtctgaattgtatttgtatggtttcttttctctttgccccatgcaaaaatagggactaagccttttatttatgtccctaatacagggacataatgcagagcacattatagttacgcaaatttatgttgagtagatgaattaatagatggataaatggatgaacaaatggtacacagtttctgttttgttttgttttattgagttcatgatatttgcggtgagattttattccatttacaacacagtgccatttagaaattcattcaacaagcatttattcagcatttactgtggcacatgtgtttttttgttgttgtttgtttgtttgtttgtttgtttgtttttgagacagagtctcgctctgtcgcccaggttggagtgcagtggcgcgatctcggttcactgcaagctccgccttccaggttcagccattctcctgcttcagcctcccgagtaggtgggactacaggcacccgccaccatgcctggctaattgttttgtatttttagtagagacagggtttcgctgcattagccaggatggtctcgatctcctgacctcgtgatccgcccgcctcggcctcccaaagtgctgggattacaggcgtgagccactgcgcctggcccacatgttttttaagaaaaaggaatgtagtaagattcttagtggaacaagttcagtcacatggctgagccctttatagtttgctgagactagaaattcattcattaagcgatgttgattaaagcactgattatgtgcctcacactgggctagtctcttaggatactttggtgtacaaaacaaagactcctgccctgtagaacccacattttgcatacattctaacagggtagaaggaggggcagtaacaaacataaaaaataagtaaattactatgtaaatttacacatataaagtgtgtatgtgtgtatgtgtatacacatatagtgtatgtgtatacacatatagtgtaaggaacaggagctcagcatggctgaagcagagttgttgaagggaaaaatagttagaggggggttagagaggtgggcaatagtgaggattattgcaaacataggtggcatagtatcttgtatgaaggacactggctttatgagtgagatgagagccatcacagagctttgagcacaggagtgacatgatctgtcttagattttaataggaacactcctgctgtgttgagaatagactctgagggcgtggtagaggcagggggaccaattaggaggctatccagcaatccaggtaagagatgatgatagcttggatgagggtggtagcggtggaggtggaagaagtggctaaattataggtatattttgaagatagaaccaacagattttgctggtagatttaaggtgggcataagagagaagttaagcataactgaaaggtttgaggcctaaacaacgggaaggattggagttgccatcagctgaaatatggaaatctatgggtggagtaggatattttttggtggggggaggggctatggctgtggaggtgagtggcattagctgctgagttttgcatacgttaagcaatctttattagacattcaagtggaggcatcaagtaagcagttagatacctgagtcaagttcaggaaagagggctggactgaaatacacaattgtgagtcatctgcctgtggatagtgaagtcaggagagtagatgggatcactaaggggaaagtgtcattaaagaaaagactaagaactgaaccttgaagcattctataacattgaaagatcaggaaaaggaaaccaagctagagcaatcagagaggtaggaaaaccaagagagcacggcgctttagaaaccatgtgaagaagacatgagagaagatggagtgatggtgtgtcagttgcagctgatctgacaagtgagatgaagtctaatcactgagtgctgcatttagtgacatagaggttacaagtcacctgtgtgagagtcattgcggtggagtggtgcagttggagcctgacttgagtggagttaagatagaatacagtgagcacaattggagacagccagatagctgaagaaggatgtgggttcttctagattcttgaggtgaaaaaggaactgaagcgaaaggtcatcttcctccccttttattggtaaattggtattaagtgtttcacaagaaatactcctttacacgtatgtgattatagcttgggggaacaatcaaggataaatgacagtttcttttctttctttctttctttctttctttcttttctttctttggcattattgtgagagggaacaattttataagtaaatgtttttactccaaacatgagtaaactgttcaagctaagggctttactgacttacttccttcatgggtttgtctggttcatcttattcccttgtcatctatttctcctgatgacttttttccacttataaattgaaatatagttccacacccatgacacaattatttctgtaactttggcccagtttcctaacccagagacatttttctcttcagtgagtgctgtaaattaaaaaaaaaaaaaaaaatagttcattgtcttcttagattttattcaggagcagatttttccctattcctttgcaaaattgttgctgaatagtgggagaggagaggaccagtaatgataggaaacaaacaatattttcctcactttgaattgctaagatttccttctaatcatagaatattgtcaggttccttcttgtgggttgggaagtctgtctggatcctttacaaaagaggactgagggacatccaagccatatttgtaaccagcagggaaaaatgccttctcctggaactgcttatctctcctgataatgcatttctgtctttcaagacgtcagttaagtgccgtgcactccatggaatgtcctctgatccttccggctctaggtagtattggttttcctctgaatcagtgtactaccttctgcctgtactccttactttgtgtgtgtgtgagagagagagagagagcgtgtgtgtgtgtgtgttttaatggttaaaacatctgtgtctctacaggctggtagaactacattccacacctaaccttgtgacttccaagctttctgattttaggcaaattgcttaatctttgtgtgtcttagtcttttcatctgttaaatgggagtggttcttatcacaaaaagtagtaaggattagaaaggaattctctataaaattgtaaagttatttattcagaaaactggtaacttgaataaatggaaacccgaagaatatatgtaatatatggaataatcccctatctttagggcaaatttcctgaaggaaagggacaatagtttatctgtctttcctaataccagttgactgagaaagaacttagtgaatgtttattaatggtgatagataacgcttggaaaatatgtggaatggttgctcacagaaatctgtgatatgtgtcttaaaatatttgcacattagcaaatgttttagactttaggaaatcttccagactaaaactctttctagggaaatggtgttgcaattttgatggtatataggaagtcagtgagctttccttttagttttcctaacattcatgaaaatttctgggtttctcctatttcattcatattttcatagagaattcagaaatctgctttaattttaacacagtcaatcaaccttgttctataattaggatgagaagttaaatgacatttacttttgagcaaactttcataagatatgtattttaatcatgtgaaaaaaagattagaataacaaaatatactgaaacaggcaaattacaccttctaatgagagaagcgatgcaggttcattttagaaattgtagaaagttctgataagcaaaagtagtacacttcactgagatgccattgtttgcacttcatgtatattgttccaggctttttctatgtctaaatatgtatatgtgatttcatacggtgatagcatcctgctgtatattcagctccataaacagcttttattccccatgtaatatacagtgaatgttttaaatatgcttctgcatttttttgatagttgcatttttttgatagttgcatgttatttttttctgtggatgtaccacagttaatccactgttactctttagtttgttttcaattttttcctcaattacaatgttctgatgtacatctgaacaaacttttaaaatttaaagaccacaaacatttcttagacttgccaatataaaatacctaattcaactttgttcattcttaaaacattcctttctgaaccggttttgttatttatttgatggtcatgtttggagctcctgtgtgtgactgaaaaaagaagaaaagtgtagttttctgaacataatctgcatttcagattttttcatgaatctaagacagcattttcctcatttgatccaaactagagagttttgataatgtcatcaggaaatgatgctccgaggttgtcttctcctcaaccagagcaacccgtaattcatggctagtgaggttgccaggaagtcagtgatccttaccattgtgtcatttgaatgaaagaaaggctggagcataggaagtggggagatgagaaagaagccagagttagatatctatcccacagatttaaggtcaccaccgtttccgtctttcatagctatggcaacttgagatcccatgttttctaggttagttatcaaatattccctccagtagcccagtgaaacatcttagaaattctagtatttggacatcaaaactagcatatttctattttatgcacctaaaaatgacaccaaaaccctttatgacatcatggttgtcagttttagggttataaaatatggtgaccatatatagatcttaggaaaaggagtaaaagagatgagttaattattcattttttcaataaatgtggtgaatgaatacttactatgtacctggcactgtcctagggcctgggcttacaaagacgagtggacaagtccttaagttgctcttggcgtggtacacacatatatgtttaatgtctacgatgctttgttgttatttgttgctgtgtaaaagacatatgtccaagatgctacaggaacccagaggaaggaaatgcaaaggtttttacagaggaagcaactctttagcaggttaataagtggataggcattccccagggagacaaggggtacatgatgagtgtcattcaatatgtgcaaagaacagagtatattctaggattctccagcaaacaagaattgcaatgttgatttaaaacatttggagtaagtattgggttgaattttttgttggtgatggtggtagtgtttgctaattgtttttatttttccatatttctcagttttttaaaatcttcattgtttattcctttttagggaattactaaaccatttgaccctgaaagatcagatgaaatggacatggcttattaaggagttgttgtaactacttcttgtctcaatgacatactattttcctgtcttggatttaattgcttagaaattatggctacagattcacaaagagattggaagaaagaatagataaagaatatatagttcaaattatctgctaaattttttgtgctgttagtaattaatactccaaaatgtgataaagatcactgtgcccgttttgttttgttttgttttgttttgttttgttttagcattggaaaagccttgggctatacattctgagatttcaaacaaagtagatttatagtggaaaggaaccagaggtttagactaaatagatacgctgtaagagagccataatgatcttatttaaatattttccacattaaataaggcatgagtactgttatgctactgccttttttttaataattgaatttgcatccatggtggttttttttcattccccgtggagttccacttgatagccaatgtgaatatttgaagaaaataatctgttggagcccagatttgaattaaacttcctcaaagtataatgaaagttttgagtttgtcttataagaaagaaatttttgtttatgctttagaagcttaattgatagaagtctggagagcaataattggggtgaatttttaagatggttgtaagattgttcacttggtaaatatttcttgagctcttactgtagacactgtggaccagtcattgaactgaattaactttcactctagttcctaatagacatgttaagctgctggcttcatggagtttacattatagtgagaggaaacagacaaaaacaataaaaggtagttagtagttagtaaaatcattgccaattacaataaatgttaggaaggaaataaacaatgggctgagaacttgaaccacagagaagcacctgctttgggtagagtggccagggagaatcatcatgggcaagggggaggcatgtgcatgcacttggggaattgaaaggaggctggtgagcaagaggaagcatagcatcagataagcatggagagctaggcaggcaacagaccacacggggtcttatagggcaagatcagaagtctagattttattctaatgccataagaagacattaaagggttttacacaaggcctaacctgaactgatttcttttttaagaccattattgccttgtggagaatgggagcaggaagatcaagtaggaggatgttatattagtctaggcaagagatattggtgactgggctgaggtgtagcaattaggatggagaacaaaagatggttttgagaaatcagcaagatttgggagagggcatactaaggagaaagagagagaaatcaagaatgactgatttttgtaaatgaagtttactgacttgagtaaaaatgggaatgaagtgacattgaatgagatgggaaagtttgcaggggcagaaataaagaggtgtttgagttttgtttaggacctatctctaatatgtttttgaggattctaaagggagctgtcagttggctatataagttcaaagctagggaaatctggatgcagctaaaattatatttgagataagcacaccttccatcaatatgttggctgtaattttaaaaagcatttggagtatacttgaaaatactgaaactctctatctgtagtacataccttctgttcatcagtgactaattttagggtacacaacagttgtgcaaaagaatgaagtcctcttagttgcacttcttatcaaaatcccaatggtattgttttatagaaatagaaaaaaattaaattcatatggaaccacaaaggagcccaaatagccaaagcaatcttgagaaagaagagcaaagttgaaggcatcacacttcctaacttcaaaatatattacaagccacagtaaacaaaagagtatggcactctcataaaaatagacatataggccaataaaatagaatagaggccccagaaatgaacccatacatatacaatcaattgatcttcaacgggagtgctaagaatacacaatagggaaagatagtaccttcaacaaagggtgttgggaaaactggatatccatatgtgaaagaatgaaactggacttttatatcagacgcaaaaccaactcaagatggatgaatgacttaaaaataatacctgaaactgtgaaactcctaggagaaaagctaggggaaaggcttcatgacattggttttggcagcaatttcctggatatgacaccaaaatcacaggcaacaagagcaaaagtggacagataggactaggacaatatcaaactcaagagcaaaggaaatgatcaacagaatgaaaaggcaactcatggaatgagagaaaatattaacaaactatacatctgaaaaggggttaatattcaaaatatatagggaacccctacaacccaatagcaaaagaaaaaataaggagcctgattgaaaaataggcaaaggacttaaatagatatttttccaaagaaaacatacatgagcctggccttcccatatcaggttccttagagaaactgaaaatagtgatggtgaaggggctggtggagatacctgtgggcagcaggtgcccggtttgggccagtgagtgaggagaagcctcacacacagcatgtggtatgtggctaccattttttctcttgcttaggccctgcaaatgttgggggtagaccttgcctttcgaatgcaatagtccttgaggtttgtaccatgcttttcatccagcatctagacagggcctgcacatgcacaggtgtttgttaaatggatgagtaatccagttttccttgttttctgtggcatggggaagaaacatgggttgcttgaagtaccttgggttcaacagacctcaccatttccttcttactgatgtaagaaggccttgaagacccatcccagtcagtcatccatggatagcatctatgtcaagaggatgtcgggcctttatgtgtgattctatagttagtgcagtgcacaatggggctccactgaagggtagatggaggctgatttccaacctgttctcagctgccacgctctgtatctgctgttgaaaaggggcctttttctttgcagggttaagtctgcccagaggtggtatctttttctcatttttctgcaagggcataggcatttgctaaatcagaaaggttgcctttttgtcattcaaacaaaggtgtcctaggcttcccaaggtcatatttgggtacccttgctccaaattctccatgactgttaagttcttgaggaacttgagctgtaagcactccaagtgttggaatactttgagcagttgtctccctgtgcttgcatctcttctccccctcatatagaaatcccagataggaaaagtgtcgatccaagttgcaggcttccatgtccattcctagggctctcaggcctcgctgagtcagcacctgctactaccacacaggtggattggtccatagatattttaacccattgctctgttcccagatgcccctgccttccttctgataaggcaaatttaatttgtgtgtgtgaggaggggatggagagggtgctttgcttgagccaggatatagtcctttatattctgctgaaaattctcaaaggagggctatccaagggaaaataacaagcccgggcatgagagaacttagaattccagggatacttagcggtattaacactaggaaaagggcacattttttttttcatattggattgctaataatcacaacaatgctaaatacttcctggatttctttcagttgggctgaatttaagaagtataggtttatgctgttccttgatgctgagaaaagagggtacatgtaatactgagacatccgcacagtggtgggtgttgaggcaccctgccaggtgggagagatttgaaatatattccaagactaaagatttgggatttttttcgtactttcaaaaccacagggattgacagagtttaataataagattacagagttactcctgtgaatataatataccacttgaaagaagtacatttggtcaggctggacggaatctcatcaaagagataagggaaagtccggaagacacacctgagtatggtctgaagccaaagaacagcatgctccaaaacaagcccaatctcaggttaagaagccttcatcatttagagtggccaccacacggactctccttgttttgtcttttgactgttaggttgagttctgatggaatgaatgatgggggtttgccccagcatattagcagcgcatttcggcccttgtgccagtctggaaacaggcgatagagagtgaagtcagtgtgttaccatcacagaaaacagcttagaaaaagataccccaccagataaataatgggcatctctggatgagaagattgatggctccttttattttctttgtgattttctgtctctttctcatatttctaaaatagatatgagttgcatttataatgatttttaaagttattccaaaagagaaactattcaaagaaactgaaactttatggaatgaacctggaatagcaagaaaagatatcttatggaagtattcgaaatactaaattgatagccatccttagtttttcatgtcagtttgatgcttgaacattccttgattatccagtgctaaaaggaggaagaaaacatttatgaagcatctacttaatgtgtaaggacttaaaaaatgagacatcctttctgaactcaaggtagcttatctaagaacaacagaaatacgcatatatgcattaaactttccatttttgtgtctattcatgtgccaggcactgtgatggatagaaaatggatggatggatggatggatggatggatagacagaggttattgccctcaaggggccaatagtgtactagaaagagaagaaatttaaactgaggattacaatatagtcagtaagtgtcacaatagagttagtcccagagcacgtgagtacagagaagaaacgctgccctttgcctcaggaggggtaggagaggattcatacgaggaagtcatgcctgagctgcatcttggaggacaaagagcactcagcctgagagtgaaggggatgtgccaggcattgaagtgtgtgcaaaggtaagatgcaaagagaaccacgcattctgagagctgacagtcatcccatgtggctgcagttgtgttggggtgagctgggaggagatatgagagtcgtgagaggtcatacgctgtgccaaaacctctgaggtttgccctgaagcagtgggaagcccttgcaggattttaaagaaggagagtggttagacagatttgcatatagaaaagtccctttagcaatgttgttcaccaacaaggcagactaattaggaggctagggcagcaatctgtgttagaaatgatgagatctcaattaagtttgtataagggaaaatgcagagaaagactcagagtcaaggaacatcaaggagattgattggaaagagcttaattgataggttgtggggaggatgtattgaggaggaattgggatggccccttgatttcaggcttggacaactgggtgctaatggtggcattctttgagctggatgggatacgataaactgcaattgaagcattttaaatttatagtgcctgcgagatactatagaaaccctaaaagcagctgggaatataaatcttgagctcaagaaagtctgggctcaaagagttatttgggagtcatcacaagtaggttgcagttaaacccattggtgatggaagagattattcagaagcagtgagaagaaaagaattcggaagaccatgaggaacaggaacatttaagaaacagtcaaaaaaggtggaagcctgccagagagcccaagaaaaagtgttcagagaagtggaggaaagccaggcataccaggaagggaaaaccaggcatatatggaggccctgctcatgctgtctcccaagttcatcatccgtggaagaaagggcaaagagcaaatgccaagtggcagacatgcacttcccaactgagtttgcctctaacaagtctctctggatgtaaatgtctgtcgatacctcactgctagaatgtctaggaatacaagtttcttgtttgtttaactgggaacattaccttcctaaataaagctatgatcctgttaataaagcacatggggaaaagggatttggggtatttggggtaggcaaatgacagtgttggccacttcaggtagccaagggaagagggacagtcagtgaaggaggactggtcattcatcagttcaacacagatttgagagcctgctgtgtgcaaggtattcagtgtccgtgcttcagagaagttgaggaaggtcatgaatgaaatgactgcttgggtgaagcaatgaggaatccacctttgaacttggggtggttgtccaggaggccggattgctgtgcctccatgagcgtgtggaggggtgggggtgaagatggagaatggacaacagtcttttgaggagttgactttgagcataaagggagtgggatgatgccgcagccaggagggagcatcaaggtgaagaagaggtttcaggagccaggaggaagggtctcaggaaggagttcacatgctcatattctcagggtgaagagccagatgagggaaagtagtcgattcaggaaaaagagtatctgataaagctccagacaggtatgtgttgtggggagcggagaacataccttagctgtgcatcagagagggacaaagatgggtatgggcgttcatagtttacaggtgggaaggcaggaaacaaagggcccaccattcctcggggaggcagggggcaggtagcggacttaaggaaataagcgaagtcttcaaataggcagtattagcagagaggttaagagccactttggaactggacagtctgtgcattcccatcctggctccaactgtatgaccttgggcaagttatttatatattttattcttctagttttcaatttttttttttttttttttgagagacagggtctcactctgtcattcaggatggagcgcagtggcatgatcatagctcactgcagctttgaactcctgagttcaagtgatcctccagccttgacctcccaaagcactggaactacaggtgtgcaccacttcacccagctagaggcaagttatttaacctctctgttgccttcgttttcctctgcaaccaagcaatgaggataataacagaaacctgttacttggagttgttggaagaattaaatgagttaattcatgtagtacttgtctgagtgcctggcacaaaggagtgtttcatatgcattggctgtgataatgattatttataggacagagagcacatgcagtccagggtcacctaaacgcctaactggtccagaatgcaagtgcgttggctgagggctgtgagggcacagcagatgaagcattgcattcttcaaggaagtcctcagggggaggcatttgagattggcacagccctggagaggctagctcaagtagaacaaacactgttggtgcaggcaagaggctgtcagagcacctgccacatttgcagaggaaggagccctctgacacttgagagggagcatgtggggcgcagggggccctgtgtgtagaggctccttcacctcaagggtgggaagaatggtggaggagcggccagagatgagggtgagcatcacactttgcaaggcctcgaatacctggagtttcttctgtagccacgagaaggttgggagcagggcaatgagggtccactctgtcctgtggtgctccttctggtgagagtagctaaaaatagtcatcacaatgctgagtgcagggactgcgtatggtgtgccaggaacattggagtgctgtaaatcttggacattactaacgactgccctgtgagagaggtactgttatttgttttatttttcagatgaggaaactgaggcacacagaggttaagccacttgaggattccatacagctggtgtgcggcagagtcaatagtgaagctgggcagtgttgtgacaccagagcctcttcctgtgaccaccgagctgtcatcacctgtcacattagggtgtggctctccagagggggtagtgacaagtggagattggagcaatgacctctgctaggcttatggcagcttattgataaaacattttctgtcttagtcaaggagagtttggctgtaaggactagaaactcctgcaaagaactcaagtgaatgctgaatggattgtgaagatacaggggcgctcccagaacccagttgcttgctagggagtatggctagacattacacagctggagagttgtcaggctgtagcagtatctctgtctgtctggaaacacagggccttctctgtgcatctttccacagtctgattaaattgcagctttcctagtttcactctcccaggaccttggctagccctgaccctacctgacctgaaaagtcacttgactcactcagtccctgtgttgtagataaagttcttgctttggataatctgctggtttagcctagttcaagtgtccctccttggttccttctgcagctgggataaaggtggcacaggttatgaccaggcagggagaaagctgctctgagaactccatgatcttcagtggttagtgaagcttgcacgccttgccatcttgacttaactgctaaccctgcactcctcagtccctggctttgctcaggttctgacagtgtttttgttgtaaacatcttgtggggctccttcctttcagcctgcagctctgccctggtctttcaggtcttcatcctcatgactattgcagcaggctctagagtcacccttcaaatctggttttcgcttcccattttatctcgccttcttttaagcaatattatttttacaatttttattggcctcctattcagaagccttcagcagatgttccttaatttgtcacattcatggctgtctcccagggccatctagcccgccgctaatcatcctcttcccttgaattcccatcgtatcagcacaggataattttctcttaccagacatgccatggcccttcccttctccacgcctgctccttccctcctgctctgacatctctcatccatgacttaagaatgctgactgtagaccctgactctagaccacagtcacctccctctcctctgaactccttttagttttgattctctagggaaattgttggtttgttgaaagcagctgcctgcccagtgtgtcttgaacctgcacacagccaagcacatgtcaaacacttggaaaatttaatattcagtgattagtggctgatttattatctcttttggccttggtttttttttttttttttgctttttaattttttattacatattaaagaacattccatataagctctctgactgtgatgattgaatacttgttagaggcaaagccaagtaaaagtattaactctaatcctgttaaagactttcccattattacatgtgcttgagttttggcttctcttttgtgtgccttgagaacagggaccatctcattcatcttgtatacctcaaagtacctcacataaagacatccgggaatacatgtttgagtaaatgaataccctcctcattgaagaatagatcttaagtggtcatttcatgactgcttctatctaggcatttacatttgtgcctagtttgaaaccactttcattgcttgttacgaattaagcttattcacccaaactacagaaaggcttttaaaaattttttcctttggacaaaatttgtctcctgctcagtccttttctgcccataacagcattggccatcccctgcaatgattgtatttatttaacagttcttcctgcttccctgctatggcctttcagacttccccacaggcacagagcccccagacacctggcagggtaactatcagctgttctttgtatttggggcatataggggatctgtgtggctttggtttctcaatagaaaatgacataaacgcagaaatactttgcaggctgctacaggaacaaaggcaaacagacttgtttgtttgtttctgagaccaaacatttttctgccaatcaaaactggttttatttgcatatagtgtatcataaattgttgtaataattgaataattcccaaggcatgtactcttaggaaaaaaagaggaaaatagcttagaaataaaatgtggacaaaaagcataagctggtgaatgaaaaatgagaaatattgccatgtagtaaagatataatattgtgaagtctacccagtatcaaatgtatggtaaaaactagggaagaggctggcacagtggctcacacctgtaatcccagcactttgggaagccaaggcaggcagatcccttgaggtcaggagttcgagaccagcttggccaacatggcaaaaccctgtctgtaccaaaaatacaaaaattagcctggcgtggtggtgtgcatctgtaatattagctactcaggaggctgaggcgggagagtcacttgagcctgggaggcagaggttgcagtgagcagcgatcatgccactgcactccagcctgggtgacagagcaagattctgtctcaaaaacaaaacaaaacaaaaggggaagaaaaaatgtaagcaagttatagaggcaagaagttcaactatgtgagattatttgtgattatcccagatgtgactgggaagagatagaaaagtaacagtgttagttaaatctccatggattctttgcctccatgccaaatatcatgactatctaactaattactccccccgactcccagcttccccaccaccccgacactatcaccagatacacacagatacatactatgtctttgtatatgtaaaatgaaaatcattgcaggacatcatgcagtagcagtgtttttcatgaaaggctgtgagttacattggtctgaaagcaacacatccgtcatggctgttttcactggcgactttcttctgtctaatgtttgcaatgaaggcttggcttgaaaaggcttatgaattcttttagcacaacctttgttgggaaaatgaattacaagtggttcatttgatgctgatccttttgtcattgccatttatagctattctgtttattcactttgggagagccattctgagaattgatgaatgtgttttatgagagaatataagagccctgcaatttgttttgattggtctccatttggattcatagcgagcaggtgccatcgtttggaattggttttggcagtggcttggttatataaatattagatacatgaagtgaaacctcatttaaattattttcatcagtaagaataggagagctttacattgaatgtaagacaccatagttctatttttacagcttctaagcatacaaatgtgtaacataccatatgtctgaacatatgtatgtagaagtggcctccattgtacaaatatttaacatacagattttctgcatttctttgagagtttatgcaaatattctttaaaaaactctaagcctatagtttcttaatataagaattttttctggtctgaaaaatacaggcatttctgctttggaaactatgttaaggattgtttcagtttggtgttttttttgttgtttaagcctcagaaaataacccagcacattttaaacctttgctttctcctgctttttgttgttgttgttgttactgttgtttttgttgccaaacccacattaaaaaaaataccacgcctctttgtaagggctctagaagaagaactataatacttcctatcttcccagcaaaactgtttaccaggctgacgttttcctaagaatagctccctaggttttcatgaatccatataaatttccacacatttgttttttattctggcacaaaatttaagagggacttacgatcataggtggaaggagcaatgaggaagtctgttggtaaccctttaggtaacatcctaaacctcgggctacttgcgggcaaattgttaaaatgcaggactcatgatctctgagtacacccatgaaaatttaaatacccttcacggtgctgggtctttttgtaagcaagccaacacggtgcccagactcttttccaccctctagctctcaaccttatgtccccagcaaacggctctaagtccaatttcagtgttcttcataagtgaagctttccatgagccccacaggctgacttatgcagttcctcctccaaaaacccagagtaaaggacatgccacattgtaaattgtagccactgcaatgcctgtctctcctgctaataggattcctttgaagacgagtacctgtccttgtcattatggccccgggcctagcttactgcctgacatgttatgctccataaatgttcattgaatgaatgaaagagtgaatttatttggtgttaggtaataaaaatgaattcaaaagagcataaataaaacaaaaatgattgactttaacatgcaggtgtgaccaaggcccaaattatcttccaattgctttgtctttcgggaaatgcgctaggaaatgttaacatacacagcctgaatggcatgaaaatatttgaatatggctatcctattggaagcccaattcccatagggcaagttgcactcataatgaccaaataatcaatgagtcctctcctcattccaaagaggatttgaagtgaggccctacctaagaaacttggcagaggcaccaaaacaaaagcactatctaatggagttagcgcaattcataatcgaagagaagtggacagcagcagagatggacatgaaacccaggccttcggaggcctatcccagcgttcttccaattcattcttgttgcttcactttatcagtgtttaataaagtgtttgtttttatgggaagatgagtaaggactcgtggctagtgtcccttaacctcttgtgtctacagattggcctacttagttaagtgattaggtaattagcaattctcccacttatttggccatgtatgagaagcaaactcatctgtggcaaattaaaaatactgagttttatggccctagttggggaattagaggttgaaagggttgcttctgactcacatatggcccccaggcacaatatatctaaaactttcggtaactatagagttttaaaaagctcctctaccaccttttcaattaagacatgccctctgggttgaggcttactgatgtagaacaagttttataggaaaaaattatgtaaattaatataattggctaaccttttgattgcacttacaaattgaaaaatgcggtgcaatattgattagacaatcttctcattgtttttaagtaggagaaaacaagtaaaagagagaggtgtatggtggaaagagcattagttttgaagtcagacaaccctggatcaaatctcagccctaccacttgactggactccaggaaaatcatcccaagtcacaacctcgctcctctccttcctcctagacttaatgcaggggctgcagtagaccctgactacttggtagtgatctatttaagctcttaacggattcccagagctataacaatagaaacgtgtgtaccagttcctagcctacctcccaatccacatttccattgagaatcatgtttctcaggcttattcccctactgctttcccactttcattatactttctgttttgttttatggcccatcattgggtcgtttgtccttagagccattccttactcttcctgtgttctgtatcacagggaagtcatcccatataggatgcatttctcaggcttcctatgggctcagatgcttttcatgaggttggtctctgggagccatagacagggattggcgggtagaaggtagatgagaaaaaccaggatgttctcccccaacctgtgtgtcttaggtggcatctccaatagtgactgtcttctccatgcttctaaacatacccctcctactgcagttccaacttctgccagtcaacccccgtcctgatgttctgaccccagctgacctctgcttttgaggtctgttaacaccaccttctcttgtgcctgcagccctaaaagcaatagtggcatcatgttgattgtgatctgtttcatcaccatctcttgcttagcttttcagttcacccatcacttttataaccaattccatgtattaaatatcccctctttaatatacccaaagtggtttctgttttccctaatagaccctgaaagcaatcctgaagtgataaactctctttattgccttttctggtcacagtagcttagatgatcccaagcctgtgaagcgtgctgaaaatactgactccctaggtctaccacgcagaggtagtgattccctggtttcagtgtgtggccccagaagctgaattttcaaaaagcttccctggtggttgtaatgcccagcactgatttagagaatggcaaagccaggctgagatggaggtgcgtggggtgggaatggatggttgctaggttcattcaccaactaagggcgtcacttttacaaaccagcctcacagcaagagagcccagctcagcaaaattaaaatgactgcatcccatggactttataggacacttacaagtgtcaaaatagcacatgttaaattggggagtgccaacggattctttgaagaataaatgaaatcacatatgtggcagcatttcacacatcgtagttgctcaatacatgatcttcccttctctcaaattgagtgaaaacatagaactatagaaagctatgaaatagtataaattatttattccttaaggtcacagaatccagatactaaataccagaaataatagataagtaactacatagtcaaaaaaaagtcattgtctggcacatattattgctcactgagctggtgctaaacagtccaatcatatgacaccataggttagctctctttcatatcagaaataatttttgaaaataagttttaactaggactcttgtgtcagattacatagtaacatcttctaaggagacatgaaccttgtgagtatgtccttacttggccattggaatttctgcattccaggctcttgccagagactacaactttgagtactccactgtccaattcttatcaaaagactggttaggagaaataatattcatggaggactgcctgaaagatatgcagcctgttcattcctcattgagataacctaaattctatttgtggtttaagtcaggttatcacatagcttcctatttggatctccacgtatttacttcttgtcagtttctctttactggggaagatgaatgaaaaaaggcacatctatcattatggaattttgaacaatgttaaaagagaagaccctcagaggtttccagacagagaaaaccagcatgcttctagcgcagggagcatcagactaacatgaaactactcatctacaaagtgggaagtaagcagtaagcaatacagtatttacagagagatgggacaaaagacctgtgagccaagaatcctgcattggccaagagctctattcctacataagtgcaaaaggaagacatttctggacatggagttactcagactgggccatctacatgccacttctgagaattgaatcaggacataggtgtcaaggtaggaggagatgaagagccaaagagagagtgatgagcaatgaacgttgcaaaacttatggtcaagtctaaataaatgatcataatgtgactacgaagtccaaattgttcattaagatttcttaaagtggaagagacgtgttgactatgaggagatatttagtagcttagagtggagcaggcaatgaaagagtaaaaatattccaagtatctctacctatggacaagaaagagaaaagagatgtcatggattgggttctctggaagcaagcactggcacacagttttggttgcaagattcttagtaggaattaacacccgtgtattatgttccctagaaagatatgttgaagtcctaattttcagtacctgtgcatgtgaccttatttggaaatagggtctttgcaaatataatcaagttaagatgagttcatgagggtgagctctaacctagtataactggtgttcttataagaagaggaaaatgccacatgaagagggagacacatggagagaagcgctaaatggtgacagaggccagggctggagtaacacagtggcaagccaagggactccaagaaagatggctaccaccagaagctaaaaagtagcaaggaagaattcaatcgagtctcagagggagcatggccctgccagtactttattttggacttctagcctccagaactgtgggaaaataaatctctgtcatttgaagccacccagactgtcgtactttgtagcgacagccctaggaaactgataaaacctgtaaaaagatgagggaaggcgcacaaaatgaaagtcccacgcaagacacacaaagcctgggccaccttgatggggagctggaggaagagtgccaccgtgccactcagtcacaagaggtgactgccccaggaaggccatgacctaggctaaactggctccctgcagaggcatgcagtaaggcagtcttcccttcttacaggagatctgggtagctcatctccatgtctacacagcaagccgagcgaaaaaatgggcagcgaaaatagtgtatagtcattttgctttcttaattgaaaaacaggtttttaaatgatttaaaatcaaaaagataatatgagcaaaccagcaaagaaataatgagtaaaaataagtatagtaacaacaaatgtaattaatagtaaacaaaacattgttataggcattgcctttatttcctgaccaacatagttctggaatgtataaggcaaaaaaatgaagtagacatacaggagaacatggcaaaactataattatattagggaattttgatataattatttcataatttggccgggcacggtggccatgcctgtaatcccagcactttgggagactgaggcaggtggatcacttgagctcaggagtttgagacaagcctgggcaacatagtgtgagaccccatctctacaaaaaaatttaaaaaattagccaggtgtggtggcgtgcaccggtaatcccagctactcaggaggctgaggtgggaggatcgcttgagcccaggtggtggaggttgcagtgagccgagatcatgccacttcactccagcctgagcaacagagccagaccctgtctcaaaaaaattaataataataattatttcataatttgacaaagtagacaaataatgatacaggttcgtatttgtatatagtgtttataccctaaaaacacagaatctgcatttttctcttttgtctatagaaggtttacaaaaatctatttctatggccacaggaaaaaactaaatgaatttgcggagaaaagctattttactcatccccttttttatcccactgtgataaaacaaaaaattgacagtgaaataataataataagtaaaatgtaaatgcttgaaattaagaagccttcttatagatgattcctggatcaaattgaaaatcaaatacaaaatgacaaattctctggaagttaattaaaaagaacatttcacatcaaaacttatgaagaaattgttaatgcatttaggaatactttatagcctaaatgcttttggtactattaaaaaaaaaaagagtgaaaaataagctaaatattgcatctaagaaatttttttaagaatcagaagaaagaaggtattattaatgacgaaagctaaaattaatgtaattggcctcaaaacaattaaaaggagagaatctgactaatgaaaatatgtatataatataaagaatgtacatatacacatgcaacattaggaatgaggaaaaaaaattgcccagatcccggaaggattaaaataagtcaataagacaatgttatgttcaggtttatggcaataaaatttgaaatctagaggaaattgatgtttttctaataaactataaattaccaaaatttgattcaaagaaaggttataaatcccgagaggagttataaacagaaaaaaacgtgagtgcgtataaagaaagccttccaattttatgaaaagtataaattctttcataccaaaaactgataaagatggccacaacggttgttcaatatcacttatgaaaatatgcttttaagaagattaagaaatcaaatcaaagatttattctagaaacataaggatttttaattttatatttttatatttctagaaatataaggatttatatttcactttatttaaaagagtgacaaatgaaaatatccaggagtgaatttagtaagacataagacaaattttaaaaaaagattgtagtgaaagacaaactaacatttgaagaagtagagagctatactatcttttcaaatgagaaaacttatgatcctaaagataaaaattgttctaaaataactatatataatcccagtcagaatcccaacttggaagataaaagtgttgtcagctcagtcaacacgatttttttgtttgtttgttttttgttttttcgagacagagtttcattcttgtcgtccaggctggagtgcaatggcccgatctcggctcactacatcctctgcctcccaggttcaagcaattctcctgcctcagcctcccgagtagctgggattacaggcacctgccaccccacccagctagtttttgtatttttggtagagacagggtttcaccataatggccaggctggtctcgaactcctgacctcaggtgatccgcccacctccggctcccaaagtgctggaattacaagcgtgagccactgcacccagcccaatcaacatgtttttaaaggccacataaaaatataaatgcaagaaaatttccaaacttgaaggaaaaacagtcagcatggggaagtcgtgccagcaggcatcaaagcatactatcatgttactgcattttaagcaatatggcattagcttaggaatccacaagtcaatgtttggaacagagtagatgccataactaaatcaatgtatataggaaaacttaatgtatgctaaaggtggcttgtctttctggtaaggaaaatatcattaagtaaatgatttgggggcaattaggtgtccatctggggcaatattccatttggattagattccatttgaagtaagagctaatattaaagatggacccataaagctatcaagagaaaatatgggagaatacatgtataacatcaggttagggggagctctctttcataatccatcttccaaaaaggaaaaattgcaagatagtaaatttataatccataaaggaaaaattggcagatttgactgtgtaaaaatttaaaatgtctatgacaagacacaataaataaaggcaaaagaagaataatacttgcaacctctaggacagagctaatgtttaaaatactaagaggtctcacaaattgtttataaaagaaagataaaacagcccagtataaaaatagtcaaagggcatgaactggaattgtaaatcaccaataaacctgtgaaaagaatcagccccgttagtagtgagagaaggcgaattaaaaccagagatgcctatcaggtgagcaaacacttttaaagatggcgaacaccagtgctgatcagtgtgtcaataagcaggcactcaccatgcacatttgggctgattgcttcaacctttgcaccggaaagaaatgtagcaatagtcattcaaatagttaacatgcttattatgtttggccccacagttattccacttctaggattctttcccacaaaaataaaagtactagaacattaaagatgtttgaataagactgtttattcctgctctggttaaggtagccaaatttggaaacagtctgcatgttcatccacagaagagtgattggttaaacaatggtatgtccatcttgtgaatatatgcagttatttttaaatgagatagatatatagatttttaaaatattttgataagagcaagtggcagaaataaatgtgtgtgtgaaaaagcatagggaagattttgaaaggctataaaacaaacagactgtttatattggctatcgcacggtgggggagataagacctcattctttttttttttttttttttttttttaagagacagagtctcactatgttgcccaggctggtctcaaattcctggcctcaagcaacccttctaccttagcctcccaaagtgctacgattacaggcgtgagccaccatgcctagcctaattcctttttactttatacctctctacatttttaaattgattacaataagcaagtatctcttctgtataaaacataattatagcacaacagcttttttgaacttttctttgaagttgtgtcatctaatcaacccttatggaaatcacaggtagtttatcatagggataatattgaaaaattgtccacatgtcacatggtgtcacctctgtgaagatccataggagaaatttccactccagcttgaatctccagatacctgtggttcatttgagcaactgctttgcttttatcttttgcgcattgtgcatctggtaactgatcgtattttcctttcctctggaaaccaggaatctcagagtcaagttgtagactgtaaagtttattcaacaaccataccagactctgtggcttatgttctatgcacagcccttgctgatggaatcatcttgctctccatgtttattttccctcacccacattccttcctttgttttaattttaactgcttatgttgcatgtatccctatagctacctctgatcttttttgggagatgtagtagggatatgaataaatgatgaccagaaatttctattttaacagaaacctggcaaagaaaacggtctcgacaatgagtaggccacccatcactactaactacagatgacttgccatttcatttacaaaggtaaggaaataaagtctgtatttttaattaattctgatcaaatcagtatagagcccttacctttttattgtaaatatttttacaaatattctaaaacatatatctagctcataacctttaactctgacatcaaatttgaataaaacatcaagcaaacagaaacaagaaattttatgaattttggcatgccagaagggttaaaaaaaaaaccgagatgtggtctctgttgttaattactatgtgtgttaaatttttaaatagtattttccttatttttaagtgtagcagtgttcactgtagaatacttggagaatctaacaaaatataaaaatgaaaacctaaagcatttataatcccatcatctgtagataatcaccagaacttctgagaatgtctttcctccttccttttatgtgtacatggaaaatacacatgattataacttcaaaaaaaatttttagagacgatgtctcgctgtgtctttcaggtgaaattcatataacataaaattagccatttaaaaatgaacaattcagtgttcatttttagtacagtttagtacatttacaatgttatgcaaccactacctctatgcagttccaaaacatctgcatcaccccaaaaggaaactcagtgcagtcagcccttggtatctgcgggagattgattctaggacctgtggataccaaaatatactcaagtcccttatctaaaatgacacagtatttgcttttgtttctctttttgagacaggctcttcctttattgcccaggctggagtgcagtggtgcgatcatggctcactgcagcctcaaactcctgggctcaagcaatcctcccacctcagcctcctgtgtagctgggaaaataggtgcaagacattgaacctggctaattttttattttttatagagatgagttctcactgtttttcccaggctggtctcatactactggcctaaagcaatcatcccatcctggcgtcccaaagtgctgtgattacgggtgtgagccacaatgcccaacgtaattatataatgttttttaaaacaatgttttgaattcatacttaccttgacttcattagttacagatgatgtggtgcagaagcatagcaagtctaagaagaaacagtagtcatcattgtgaccattgtaatggccctttgcagtttaccagtacatccccaagcatcttatttgtccctgctacatggcctctccgactccaatgcccctggttaataggtttatgtgacctttgttaaacatcactctacaggaaaaataaatgaataactcttgaatccagatgatagttcatggccttcgtttatcattattttatgttttgtgctgcttaaaaggaagtgttttaaaaaaaaatagaagtttacctgtttttctcctcctcttccctactgtcaagtcagggatgattcacaaagtaataaaaagtactttaagaccatctcatcctccgtccttcattcatgccagttagttaacctctcattaaggttgtttttttaagcacccttcagagttgctcttgtagttttttggttttaaaagctgcaaagtcttaaaagtgaaattactggaatggcattctttagggaggtcttcattctgttggctctgttaaacagttgaaggcctgtattttaccctgagcctgatacataaaccattttaattcttctggcatttttattcaaaactgacctaatatgattataaagagactagaaaaatgaattattctttaagtcaatttaagctgatacagcatggaaaacaatagtttgtgaaacatctgtcctggaagactctattctaacacggacagattaaatagatgcaaatagaattgcaaaattatgtaagagggtggtttgattggtgggcagtactagatctagtgaggttggctcaccgtgattcttgcgtttattttcctggatggtttttagtcatatcaagctcatggcagtgtgggtaaactcagtcacttagttccaaggcacagaaatggttgatgaatccctaggtttagcatatgccgtgtttattaaaagcccagaatttaaagcatgcttcaaaagcgtaaaagaaagtcagaaattttacccttccttggtgtattaaatgttctgcatgcagtttaaggtaagacccttaaattatggttccctaattatgaagttatccttgtttaccacagaagtagcataactggctttaaaaattcagatgaattataggtcacatgtgaaaatcttatcattaggaagagagagaaacacatttgaagatcagatctcccaatgaaaaaacatattttatcttaaggcattagaattcacaaagatacgcaatagttttgagtgtgtaaaaatgtaaacttctctatatcataattatgaaacaagttaaaaggacacggtaagctgggcacagtgcctcatgcctataatcccagcactttgggaggccaaggcaggaggattgcttgagcttaggagttcgagaccagcctgggcagcatggcaaaaccctgtctctaacaaaataattacaaaaaattagtcccagctacttgggaggctgaggtgggaggattgtctgagcctgggaggtcgaggctgcagtgagctgtgatggcaccactgtactccagcctgagtgataaagtgagaccctgtctcaaaaacaaacaaaaaggcagatactaacacagaagaatattaataatgcacttggcaagcaattaatgaccttaaaacataaaaataagcaaaccactagtatgaataaccataataggtaaaaatcaatatcagaaacattaagacctccatagataaatggacgaaacaatggaagactcgaagaaatacaaagaactaaaactgatgtgaaaacaatgttaaccttcaccagtaattttcacagatgcaaattaaaaccaggagatgatttcttttacctgtcagattagcaaagctgtttaagatgataacagtcattactaaatgtgtaatgaaacaagcccccactcactgctgatagcagtgtgaatgagtatactcttctggaaataaatttaccaatatgtagtaaaagctttaaattttttaataccctagtatgccctagcagttccaagaattgagtccaagaaaacattgaagttagataaagatataagcataaaataattattgtactatttgcaggagcaaaactctttgagctgcctcaactatccttcaatattagcattgactaaagtattaacacacagtggtgtccacacagtggtatatcttgcaactagaaaaaaattattcttacaaagatatttttgtaatcaaatgggaaaatgtttattacataaatgttcagtgaaaaatactgggtaagatagtattgtaagttttttcatatgaaaatacacataataaaaggtagaaataaatatgacaaaatgtgaatagaggagttgcccaagggtagtagaattgagtaatttttttgttctgactcatattttttggtacttcccagataattttacagtgagcatgcataaccagaagaaaagttttttaaaaggctatgtagcctgggcacggtggcacatgcctataatctcagttactcgagaggctgagatgggaggactgcttgaactgaagagtttgaggctgcagtgagccatgatcacaccactgcattccaattccagcctgggtgatagagtgaaaccccatctctaaaaaaaaaaagctttgtagaaagaaacttatacacatgtacatgctttcttagagcatatgggataaaatatattacgaaaatgttttagatttatttttgaaagattaaggaatgcagatttcttttttagtattctgaaatgtttctgtcttccttaggaacaacagcaatagcaataacaaaaacatacttaactaaaatagatcctttggttagcaatattattaatatattgtatttcagagtaacattgaagttcaaagggcagtgtgtttctcttgtagatgtcttctgctgctgaaaatggagaggcagcacctggaaaacaaaatgaagaaaaaacctataaaaaggtgagtgtgcattttattttctaaagaggaacaccgttttgctgtttggcacgtgaatattatcaaaggcctttccttctcccaagcagttgtaagttactatcttagtttccagttgctgctataactaattactgcaaatttagtggcttagacaacatacatgcattatcttatagttcagtgagtcagaagcctgacatgggtctccctgggctgagatccatgtgtttgcagagctgtattccttcctggacactccaggggagagtccacttccttgtcttttccggcttctagaggctccctgcgtgccctgtgtcatggctccctgccatcttcaaagccagcaatggccggtggcgtctttcccaggctgtatcactctgacactttaaagggcctgtgtgattgcattgagccctcctaggctcacagaaatatgggaaaatattaataaaaattaatattctttatctaaaaggtcagctgattagcaacgttaatttcctctgcaacttgaattcatttttgccttagaaggtgacatattcacaggtcccaaggattagagcatgggaatctttgggggtcaattcaccataatatagaatattgagtgaagagagttgtttgaagacccttcttattcctaagaagaaggctcctgagggcatgcagtgttctgtgtataatatatgaatcctttaatggactcactactttccaccaacatttaaaacatttcctacctttgtattttaaaacttttaaaatgtgagatgctcctcttccccaccttttctaagccgctcagattttatgtcttcagcccatttcacaaaaagtctttttccagacttcctaatgtatcttaacttaccagtctttgataaattctcgactcccagctaccaagctaatgttcaaacacgttactgggtaaaatatgttcccaagcacctctactcctgattataaattgactatacattttagcttttcaaagttcttgctattttgccctcttaagagtaggaggtttgtgtattgaaggtttattatttcttaatttttccttttatactttgatggacagcctgcaagacgtttagtcataaagtacatgagctatgggctctgaccacatattcaggtcatggaactagcatgatgtattttctattccattttcatatgggagaatgtgccctttttcctggcatatcttctttatctgatttttccactcagccaaaccttgaaatacaaactgggaggttgtcattcaaagtgatggtgtggttggaaaagagttgggtaaagattcaagagctcagaagtgccgcagtatattttataaaatttgtacattgggccagaggcaacaatacactattatttatttttagacacaagtgaaaaaccaaatcctgtctcgtttacccaagattccgtgtacattcattcaagcatggaccaacacagagatgattacgttgctagcctgttattacttcagatcagtttcaggtggtattctcaatcagcatcaagatgcactgaaattcttgaccaaattctgactcacaggagatcctttgtcgctgcaaaagttatagaaaaaatgtgaccatgacatctcagagtttgctaagtgtaccctgcccaagaatttatttagtcaagcaggttttcaataattagtataggtaattctatgattaatgtctccagtaggatatttaactcagcaatgttttttaggttgtaaaaactaaaaatcaaattctatggtaggagaaataaggaaagacacagaaaacctaaggggaccagaaattttttttaatgaacaattttttatgtgtaataatatcaggatcttattaatgatttctggttttaaaaagtataagcaatggaaggagatgtacgtagcctctcttaaaaagcaccaagaagaccagcacagcacttagaacttcagcccttaataaatatggtattgatatgaatagcaagaagaaggaatcgcttagagagagtgttgttttactggcaggtaaaagctcagctgaattattcggtttagttctctgatcttcaaactagagaaggtgttcatggtggacttaggagttagctattgcaaatgtgtttatctccaggtccagataaaccatttcccagatgaaagaacttaaagctagaataggaaaacctctgaatgtgagctttaaatgaatttcagaatgggaaaattgtcagaaaacaggacataagcaaatattattcttattttcaaaaatgaggaagagtacattctggaaaccagattataagtgagacattattccccagtataatttgagcattattattaaacatatggtttatacatatttagagaagaaacatatcttttacaaacctggagaaattcataaagatgtagtttatttcaaactaactgcatttcctattttgagagagtcattaaattactcataaagagtatgttcaaatttaatgagtcttgatttaaaggtgtctaaaagattcgctagtctcctttcagacaaggtggataagtatgggttaaatattatgtttattgtgtttgtatctggttggactgatggtctcgaaaactggcaattttgctccctgttcactcggtttccaccagcatgatgcatgagttggccctgggtagcttaccatgttcacccatgaccttaatgaaagcataaaagcagtgctttgcaaatgcaaatgacaaaaaaattgtaaatgatagcaaacagactacacaagtgttgtcaaggccaccatacatcttattccctttacaaataccttaaatttctttcccagtcctgaagccctgatcataaggtatgcacagatttactaagaagctttgatgacccattgtgtttttgcattgactgaagccagtccatggatcccaggttaaggcccctggtcctttatgctaggagtgagaaatataccacaggagtttataagtagctcacagtggagtgggagaggcaagacatgaaaacagttttagaacacagtagtctataatgaggagttcaaaagggaagaaaccaatgttgttagaattaagcagcaggtttaggctttctgtatggagccccagatttactgggcagctgccagtaacattcagcgtcatgagtgctatgatttccacgtgttattagggaacactcagtgttcatgggacaactttacactttgcgtctcagctatttgcatgtgattattgaggctggctgccttttgtcttgcagttgaccatttcctgaatccattctcagttcttggcaagcccgggaagaacagctaacattggtccgtgaggttaataatgtcttcagctaatggctaaaataagaagtttgattttagctgcataaaacaaacaagttgcccattaagacaggcattaaaggctgcctggctatatttacagagtggagtatttccattatcagttaatttattgagtgctttccgcaagagttgtaaatgcagaagcctactggggccaggcagcaaagaagggagtgagaaaacgaggggaccatggtaaacagaacccacgccttccttaaaaggggcagcaggcagtcagctctagccaacagagctatgaatgaatgctcgcccagggttgccagatactctgatgtttttcaagaaaagagagatgaagattttgatatgaaatctgccatttttaaataacagcaactaattcaaatgtttttaaaaatacactctgggcaaaacagtttgcctgcaggccctatctgtcccgtaggcagtggccagtttacaacctctgacctccctgttggtgtaaaaaagtgagaagaaaaaaggaggatgcaaaagaagtgtaagaacttgtctctgcctcccctgaccttacaacttatttgggagaaaaaagagggacccacatgaaaaaattaaatcttgacccaaatcggtgttgagtaagtgccaagacaagtggtatttctcttttatttttatttttttgagatggagtctcactctatcgcccaggctggagtgcagtggcacaatcttggctcactgcaacctctgcctcccgggttcaagcgattctcctgcctcagcctcccgagtagctgggactacaggtgcatgccgccacgcctggctaattttttgtattttagttgagatggggtttcaccatgttgcccagactgatctcgaactcctgagctcaggcaatcgacccacctcggcctcccagagtgctgggattacaggtgtgagccactgggcccggccaaaaattccactttttaagtgactgtgcattctgatttacctacgtgtttgtcttgatgtcagggagtccaatgagcacaggcacagaaacagggaggagcatgatttgttggcattacaggagaggctggcctggacaaagctaagtggtggtgtctggggaaagtagtaggcagttttggaagtatgggctggctctaaatgacagctacccttgggtgctggtttgaggtgtttggattttatgttctaggccagtgttgttcaacggaacttcccgcaatgatggaaatgttctataatttgcaccaatgcggtagccacaagctatgtgtggctatagggcatttgaaatgtggccagtgtgtctgagaactgtaatttttaatcttaattttagttaaatttaaacttaaataagcacacgtggctgatgactgccatgctggggagtgcagttttcaggcggtgatgtactgtaacattgttgtaggggctagtgacaaatgaaaggcctgtgcaaagccagtggcagagcacaagttgtacagggttgagggagatgacacgggaaggcttttgtgttagttgagcaacaaagttgggtgcaaagttgagtaggaaaagatgtggggaatatttttgaaaagaaaattacatttccaatcagtgcgactaccagaagttttctgccattggtggaactagggaagtttgggaaagagtattgtgttattttgggattttgtttgtttgttgtttaaaaaggcaagagacctaaaaggaagcaggaggcgcagggcacgagtttacttgaaagaggatggtctcaatgcaagtcaaatactgatgctagacattcaagttttgtctgttttatatgtgaagaaatgacccagccccacctctccaaaacaaacagatgtcagggtggttcagtgacatatgccaggttaccttgcagttctttgttaggaagatgattagaagctccagtcacatgatgtcccatgttgtcatttgtccgttggactgggtcagtgtttcccaacaccagggccttgactgtcatgggaaacgtgcactgccatttgcctttcttcttgtctcacctcttcaccctgaggttgtcgttctaggcccctcaccccttcctcttctgtttctcctgcctttctgggcctgcccacaataggcctccactgggagattctggttttgatgaccgcaggctgccgtggggtcagaggccacctgcctgtggcaccgaggcctcgcctacagtgtgcagagtctttttagctggttttcactgtgacgggcacacgtgctcacagcattcagaaagctccattgggaaactgaccagaccaggacacctacaggatccttgacccaaatgcccagtttttttcactttgttttatctttgaagaccttggttgttgcttcattccagtgtctgagacagtttcctatcagtggaggcaggcagcggtgaggaaggaggaaatagtacctgaccgtgaccacattccaaggaaagatgccttttattgctttttcaccatgagtaagataatagctcagagacactttgatctaaaaggaagtatttctttaaatacagggtcttttataaaatgtttctgacagctggtaacactgtctgtctccagggagaaccgggtagtagggtccttagttggtgggaaacttctctgtgtaaacctttctatggccgagcatggtggctcggtggctctatggctgggcacggtggattatgcctgtaatcccagcacttcgggaggccgagatgggtggatcacctgaggtcagaagttggagaccagcctggccaacatggtgaaaccccatctctactaaaaatacaaaaatttgctgggcacggtggtgcaagcctgtgatcccagctgcttgggaggctgacacaggagaatcacttgagcctggaaggcagaggttgcagtgagccgagatcacgccactgcactccagcctgggcgacagagcaagactctggctcaaaaaataagtaaataatacatctttctatgcatatttaattttgaactatgtgaaggtaataccagttcaaaaattgaacaaataacgtttcaggattttggagggaagaggggctggagtgtgttctctgtcctgaccattcttcttttccttcagattctggaaagccaccacttccataaaacaagcaaactcgtttgtgctaagcagcagttgtcatgaatagcagctatgctggtctctaggatgaatgaccctttggtattctaagtgtgattcctaatccaccttaatccaaaataccctaacctgctggttctcaaccagcaattctgcctccaccccccaggaagatttggcaatatctggacatatttttagttgttacaaagtgagggctggcgctactggcttctaggagatagaggtcaaggatgctgcgtcttatgatgcagaggatggacccccaaaacaaagaattatctaaacgttgttagtgccaaggctgagaagccttgttcaaatcaaactaccctttttaagaggagggcggatgtgagtccagctcttccagatactggttgataactgtaggcatttttcctagttgttgtgaaccttaatttttctcattgataaaatgtaattaattaatatctacccaagctggcttatagtgctgtgaggatcaaacagtttaacagacttgagcaaatactgggaaaagtagcatactaatgagtgaagtcactgttttgatgagcaagaatgcagtccctgagcctctgatttccagattagttctatggggacggagcactggattcccggggagaagggttacttagtctcctgggggtagctgcagtcaagcctgggcatgggaggtgagctgacagtactggggcatgatgctgtatgcgtcccaacagcaacaggtgtttaaaatcagagagaaagatgtgctcttactagtaaacgggtgccgctgtgctgaagcctaggcaacagagcaagaccccatctcaaaaaaaaaaatagtaaactgctgttgtgtttttaaaaattaagcagcaaggaggtgagctgcatcatttacagagggaacattttttaaataattccgttacacttagaagcatgtgtaatcatatcacgttaccatgcaccccccgccctgtcagatcacccctccaaacacttgtgcttctgtctccttcctcactaagtactaaagcaggtgattgcaagtctgcctttatgagttttaagcaggacattacagataattaagcaaaaagaattggcagcttcagattaaaacagctgagcgagccaaccctctcattattagcctgttgccctgaatggttcattctgaagtgacctctttcagcattcgctttggagggggcctccatatgttaagttacccaggtttgttgtacttctgccttctgattaactgtagactctctgtgttttggtccctaataccaataaacgtcacattgctgtctctaaaacgcgaactataggaaatcgtattctacacccaaaacttcctgcacggcttccttcactggcaaaaaaaccccacagtgttgttgagtttggtgtgaatggcaggcgaggaggttggggtgttcagtgttactgcagccagtggggccgtctgaactgtggcccatgttctcagggcacaacgatgcttttgtttttcaattaaaaggcttaatataagcaggtgttcactcgcttccctgcacagctcagccaacctggttccgatctggccagcaggccccctttccctgaggcctgtggctcatccactttcaccactcactacctgccctcctttgcctgagcacataaaagagattttttttaaggtggctcttaagaagttgcaaaaggacatgaaaatttaaaattctaaagttctctgttctgaatttgggaaaagataacagcaatgtaatttaggttctagtcttacatctactcaatagtcgtagggaacataccttgtgcttattcagagtttttgctgttttatggagttagaatcattggctgatggaagaatgttatcaaatatattgagtttattttaaccagaagcctactaattcagtgaattgaagcctaattattaccaatcaaaagcaattttaaaagcaatgctaataatagagttaacataagtgcttagtgcatgcccgctatcattctaagcactttagaaaatacatttaatcttcctaacaaccttatgaggttatactattacgaccattttacagatgagaaaacaggtacagagaggttaattaaatgctccagggcataaagcaagtatgtggcagaataagtctgggattttaaccccaactgcctttcttcaggatctgtaagaccctacccactgcattattgtctgaatgctgtggtgtctggagggcagtgctgctcaagacattaaaacagtgattctcaattatctgcaatagtagcaggggtcagtaagataaactcagacagctttggaatgggaacaaattaatagaatttaactttttttttttgacggagttttgctcttgttgcccaggctggagtgcagtggtgtgatctcagctcactgcaacctccgctgcccgggttcaagccactctcctgcctcagcctcctgagtagctgggattacaggtgcccaccaccacgcccagctaattttttttatttttagtagagacagagtttcgccatgttgtccagcctggtctcgaactcctgacctcaggtgatccacctgccttggcctcccaaactgctaagattacaggcgtgagccacgccccaactagaatttaacaattttaaaatgttttccctgattcattggttccaaagccatttttctcatcaaagtgtatctcacttctgaacacagaatctgaactgtagcctcaagaataactttttctagaaagtatgtagtgattttaaagtgaaaaacaaaaaaatcccttgggcactgtgcataacactagaaatgggaagatgactaaagtgatcatttcaaaaattatccctgagtgcagaactcaaaattgacagtaaaggatgagatccacttgacagtggtgacatatcttggattgtcaagttaggagaagaacacattttaaaacctaactggcagttctgtagactgtcacagaaagagtcacaactcaataataatcttctcaatcacttaaaaacatctggtaaagaaagcattagctaggaggatgactattttgaaagtcattttcctctatgggaatccagttctcccaaatggtacactgtattttctggcaagttctgtttactgtctggtcctgtgtcagctgcttttattatgccagagaaaggaatatgtggcagctcagtcctctgcatgaaagaggcaacccttcaacatatcattaaggaaggaaaagaagatgggccgtgggctctgtgggggctgtgaaattaagattctcagtcctctatctgttctgcccaacttctgacatgcacgtacacccagacacccagagacagaaattgggttcaattactaggagacttctaaactattcatgaggtcttgctgcagttctttccagcagagttgatgagctactcttcctcttaaatcagtgttttctgctcatccaagatgcactgctgtctacttcattgcagatcaggaatcgtttggttattgagcacagggctgaaatgtagactgtctgggtaacattctaattttcctgagctaagttttcatattgtgaccttgccatttttatgggtgtgcttagtgcctagaatgtatgacatacatttgacttacgtccatgtactcattcatttctccagttgacaagtatttatttagcttggcatggtgctaggccttaaggggtggaacagaggccaagacagacatagtccctgcccctaataatgctttcattgtcatggtacagacagatgagaaagagtatgcacaatcaaataattactaacttttaaagtactatgaagaaaataaagataggcaaaggtactgctgccttttagataaggtattcaggggaccctccctaaggaggcagcacaggggctgggatcgcgagtgtgtgaaggaggcagtcaagataagagtggacgaaagagtgtgcttggcagagagaatggcctttgccaagccctgaggcaggaaggagcttggtggattcaaggaactgaggtggaggccagtgtgatgcaaggttctgagcagggaagagtggccgagtagcgtgacagcagcggttcccaatgggggcagatttgtcccccaggagacattagacagtgctgtcagaactgaggggagtaggtgctactggtaggaggccagggacactgcccccccaccccccgacaacaaatactcatcagccccaagtgtcaatagtgctaagttgagaagccctgagttagagaaataggcagcagcctagacaaaggttgtggactagaggagaaagaagaaaacaagtttgagattcatttcagagttgatattgactggacggggccatggttggatgtgggggtgagggcatggtaggaatgattgatcccaggattctaatttgagcacctgggtggatgctgtgaccatctgttgagacagagatgaatggtaggggggaaacaagtcttccaatttggacatgtgagtttgagaatgtcagagaggcaagtgggtggctggacatggacttgggactcaaggaagaggtctggggctcagcttcaatttgtcaaattgcagatgcataggcattggtgaaatagatggagaagagaggcctcaggaagggggaacatccatattttgatgttgcctcctaagatccttttccacagttatattcctaaaatacacaaagctggccaagtcactgccttattatcttccattggccttctggtaccttcagaaaatatccatgctccatagcgtggcatgtgagtccttcacagccatccccattgggtgggtcttgaccatctcctgccattatcttggacacgcacctaactgcggccgcactgaatgctgcaccttcctcttttccatccccattccttcccacgcaagctgatcactctgtgatgtcttcattccagaaacagctctatcattgcctttgtccaccctcccaggcagtggctgtcagtcaccctccccagcctccctcagcaccctgcacttaaccctgttatgacacaggtgactttgttttgtaataattgttggcagttatgtcctgccaactgcactgtgagtggctggggagcaggagccttgcccaattattttgacatccagagggtcccacgcagcgtctggtacagcatccaaaggatgtatcacttttttcttcttaattctaagattgttatagattttccaaagagatatgttcttgagcctacagttctggaggtgcaattagaggtgaaatatggggcggggctggggggctgaagagggatagaatttgtactgtggatgttcacagaaagaacactttgaaggtgctcagttccattcccttggctttttctgtttcaaaatggtagtgattacctgagttgtgggtcactgtacaggcatttgaaagttggctcttaatgatgtggcatcctgaagtcccctcatctgtagtctacagatggcttgtgatcagctgttcctggaagaacttcagcaatgaattttaaaaggcagtctttttccaacactgtcacttaaaggttctattctttccagatgttggctcaattaaaggcagcccttagatgacagtaacttgtcaggggaggtcaggatttgggatcgtttggcagcccatttctccagaacaaacatcatagtcaatgcccttttctttgtaacatgaaagaaacaagatcaatgattgttcaggtttgctatttcaaagagagtgagagggaacaatagcctagcagttttaaaatcaactgtatccctctcaaaatcatagaggagtgtagactttatagctgcacttaggacccagaaacaggcattgatgagaacagacagaacattggaccttactctccgtcttccttcctcaccagcagtggactgagaagggagtgtgtggccagggccatcaggctggctgtgccattgatgagctcatccttgtgcaagacaatggctgagcatagaaatattatagtatggcttgagtattaaatctaacactgtatgagaaggtaccaggaagatggtaattggctgtacaaatatcaaattgctactattgatgctggctccccacctactcccaatggaatttaagccctatgagaatggggacttggcagtccaggtattactagaattcaatacttagtgaaggccccaataatactgccacctactccatattgggatactgttcaaagtatggaattggaaatttcaaacccattccaattgcagattgggaccccattctccttctgtggtagtccttattattgactattgaaggtggaaggttgtttcaaaaagcagtggaattctgtggcaaaaggaaatctaaccttcatggattaaagacacctttttaaaaagcctgtgcctagaaagtgaattttttttttttttttgctttccgtcatattaaataaaaacgacaaattttctgttgtagctttaccatctctcagtgtctgatttagtttgaggaagctatattgggcttcaagaaccctttttcctcatctgtctctgactacacattcaaactgttcttcctgggacaatagagtttttctgggcagaagcaagtgccaccctcttgaaggacagagagtacagtagaatggggtgagggtgtatggttgaagacagtagggtaagggaaggtgggagtgggcagacaacatctaaaacccgttcatgggttttaaagaaaatcatgaacaaactaagctgcacaatcagcatagtccctcgccccaggttatttctttatttttaacttatttattaattattctaatcttggagacaagtctgttctcccattcctgacccccaacccagtgttctttggaatatttgatttggatataactttaagattacaaattagaggggttttaaagttgtaaatacaaaagagatttaaagcggtaaagtttcatttgagaacaaaatcaaaggatggagtcttctgagattctgcttcataaaaaacaaaacaagaccctgttttccaaggaagtattcaatgtaataaaaacatcaaacgtttccatttcctttggaatttggggtatgccaactcaagctgcattgatgtttatctctatgctttttattcattttttggagaaattttgtttttagcatatgggatatgtacacacatacatctacacacacacacacatatgtatagcttatttttaagtgtgcattttttttgtttttttttattatgagggtcctgaattgcttcagatgagttaatagatgggtgggaagaaactacactttatgataaagctcctgatttacctggtcaagggaaggctgtcttaccagaagccaggtggccatgccgagcagatgcagcatgtctcaggcatcccttggccctcagagtccctagtggggacacacagtggctggtatacaaagcagagtctggtcaaatctggggcaccaggccgaagccctttcccctcaggcttccatttccatgagagaggaatttaaacccacagtctactcctggaataggaaatgttacagacatccatgcccttcctgcttattgacccaaattcagccttagcgaggtcacttgggccggaaagcgttcagcacccagatggcctggaacagtatctttgtttccagctttccagcctcagaatgcctgtctccccacatgttctccctcagtagataaatctgggcacctgtttgtgttaggcagggatacagcagtgaacacaaggaacttggcccatgacctcaggaaaccaagttaaggggttctgtgcattttagcactttactaaattacctttaaaaatggttatcccatcttagacgtccccccgctaattaggggagccctgtttttccgagtcctcaagagtactaagcactgctcctttaaaaatgttttaacagctagataggtgaaaatgccttagttttcactttaatttgcattattattgtaagttagactttttcagatgatttttattgatttatgtgtattattatttatgaataccctttgctgtctgatttgtaagcactaatatatttagggccttgcatttttgttgcagatgcttttccattcttaaattagacttttacttttccttactttgtgttttttttttttttttttgacccaagcttttatatagtcaaatttgttaatagttcccttaaggcttttatctttgctcttattttgtaattttgtgctagtaatgccttgctttaattttaataatttgtaatgcaagacttcccatggtattcttaattttcaaaaatttcttagtgatgtttttacattttttccctctaattgaactttagaattataaggtcactatctctaaaaaaatttctattgtgatttttgttgaaattatattaaattaatgaattcagaaagaagcatctttaaacttgtatttttccttccaagaatgaaatgtttatgtatttattgtcttttatgctcctcagtaaacttttattttcttcatagattttatacctatttttagttgaatatatgtctgtgtaacttatgtggggttttttgttattaatgttttgaggttttttttttcttttgcgcatgggatttttttttccattacattttctgactggggatacgttagatcttgatttatgtgagtttattttgtaaactgacaacctgttttttttttaactattctactcggttcatgactgattcttgggtattctaggtagcaatcatataatgtgtaaattatcatttttctccttctaaccaatattttgtaattggcttgtcttattaatttgatattcaaaaacagtatcaaagaattcttgtgataacagcacagccttgtcttacttgtgttttaaaaaacaaatgcctcttgtactgtttccaagagtgcattctttgtacacacaagttattaatagatacataaataaaaatcccttggtcacgtacatttgggaagtgtcactctagtgcttccattagtatactgttgtcttttagcttgaaacattattttctgcattaagaaagtttttttctgcctccaattttactaaaacttttttaaaaatcataattgaagggagaggaagggaggggagcaagggttgaaaaaactattgaatactgtactcagtaatggggtgacaggattgattgcaccccaaacctcagcatcgcacattatacctggtaacaaacctgcacttgtacccctgaatctaaaataaaacttgaaataaattttttaattaattaactaaaatctttattgaatattggctttttcatataatttaagctgaccatggaaaggcaattattgtaaacacagttagctttttgagatactccaagtactagcaaataataaaatcatgtttctcttaaaatattatttaattcagattttatatcagtttagatgaatgggatcattttatttccttatagtttggagaatgtcttaaaatttcttcctatgggtctactgatcacttccccataccagagtaatgtgtggaaattatcttaagagttagtgctttttgcaagttattttggggtgggcagtttgttgaaatcattgagaaattttggttttggcagaggggaaaaagcttgtgtttcttttgcctgaaagtctgtgctttttcatctctgttttccttttattgagaattttaatgtaatttcatgttatatttgggcctatgcttcttcatttgcaaaatttggggtgtggttgactgctaaatgccattgaagtctcttgatttcttggtggtggtggttttgtttgttttattctgtgatcatctcttgcagcagtcattttatgaaggccaggcaggatgccttgggacggggaaagagaagaaggtaaagagtggggagaaggttacatctcctttcgagaaaacctgagttggtttccctttggtgcaaaggcaataatatcttgcatattttcccaccctcccttaaacaccctgtggattaggaactcaaatgactctataggtttaggaagattaatcctctgtgggaaaaagtagagattttctcccccttttctatgttcttggcaaagtgaatacaacagaaaattatcaaaatctgtcatgagagtttgaatttaggaaaattaacttgaatgtgtataaaacatgacactgtgctgccatcccaccggcccttcaagcctaggggagccctgatgtaaccagagcctgagatggagacgtcttgcagaaagaggaggagaaatgccagggtgctgtattcctgttaggtccagccatggtcgtctccattccagagaggtcatgacaagaccattttctacccagatggccaagtgtgtactcttccttgttataaactcatcacccattcatttattcaacaaattgtcctctaggaccactttctgggaccacacagatgcaagccagtctccttcatttcaacccagtgccaattagcatcaactcttggggctagtgggataaagagtgaaaatgttcgggtgcctcaagtaaacaggacctaaaagtattgaaagtatttcacggcccggcacagtggcacatgcctgtaatcccagcacgttgggaggccaaggcgggcagatcacctgaggtcaggagtttgagactagcctgaccaacatggtgaaaccccgtctctactaaaaatacaaaaattagccgggcatggtggcgcatgcctgtaatcccagctacttgggaggctgaggcaggagaatcgcttgaacccaggaggcggaggttgtagtgaactgagatcgcgccattgcactccagcctgggcaacaggaatgaaactccatctcaaaaaaaaaaaaaagaaaatatttcacacttgctatatgtattagtttcttattgctgcagtcgcaaattactgcaaacttagggacttaaaaacatttattatgttatagttctgtagaacagacatttagtattcttctggctgggctaaaatcaaggtgtcagtgtggctgtgttccttatggaggctctaggagagaagccttttccacaggggccacttacatttcttggctcatggccgcttccttcacctttaaagccaacaatggcagattgagtccctcttacattatgtctcactcacccgctcctttgcctcttctttttttaactcttaacaacccatattattacattaggcccacctggacagtctaggacaatctccctaactcaagatcagctgttcatcaaccttgatcgtatttgcaaccttgtaaagtaacattatattttgccttctaaggttacatatttgctggctctagaggttaggatgtggacatctttgggagacattgttctgtctgccaccatataatttcacaatgtcctcctctgtgcatctgcagctctttgttatgcctttgtcattactgtcagtctgtctggtactctcagtagataccaactgtgatcctgaggtgtagacatcactgtctcaggtctgtatttccttctcctcttctctttcccttttctacttcactccttccataaaatcgatgtgctcaataaatgtaccttcaatacctaagtctccctgtaatcaacttacataaataagaaatcactttctgggacataaacatgaacctggcttcaaatgcaacacgttgtgactgaaaagcaaatgtggctcaggttactactgttaacatgaagcaattcatgtttgaacagaattttcaaaatcaaattttgaactcactgctggagacgatgtggcccccttcatttcctggattattatgcatctcccacagaaccatttgctatattatttctttggtgtttacagaagcagatcatgtttatgaagcatgtccagaagaaggaaatgatatatggaaaatctctacgtggggtatagagtcaagtgatccctaggttacagttgagagctataaataggccagtgacttcatgtgtaccatgggactggtattttccatctttcgtcccacagtttggataaacttagatggattttttaatagttctttgaaaatggaacattagctatccacagagatttaacttgggacaaaaaaaaggaataaaagtcatcatttctgatgacaggattagacagaccttttttcttgaaagtaattgaatattctgtgtgttttttgcagtttctgttgaattgagaatagtgaccatcatttgaggtggaaatagcagaaatgattaatttagaaagaagaaggattgtagggtgggtggaagtggcattttctgcattgtattcttagaaacttagactgttagagttggaagtgctctgataaaaccgttctttaacatacgagaaaacagaggcccaaataccttaagtcccttgtccaagagtatgctgagtgcagaaagccacactgtggctcaggtcctgggccctggccctcagcgtttctcagcccactgcactcatctccagcacttctgatggactcactggggtgacaccatcaaaccatgtgccccaaagatgccttcatgttggtttccacttgggcatttctcatgcttggatggctaatatactccctgcctggtttactcttgagaacccggctttcatctgctgtgggacacagtagcctttgcgtgagtgcctacgtgcacatgtgtccatggaggcagggagggtggacaggcagggagggtggacagtggtacacacactgcaccagcagcacttttaaagacaaggatcatgacaaaagcaacagcaagtgcactttcttttccaaattacccaaggttgttttttaaaaatagtaatatcacttcaagtgttttgcacttggcttggtgaaacaaaatgtgagttaaaactgtggagtattaaagcattattcttgacacacctacaatatgagacactccattgatgtggatagcatatatgcagacaacaagcattgatgttgtacttccacctatagatagaagggggatgtaccttggtatgggagttttgcacttagacaaagtcttagttctcaaccagagctgattttgctcaccacccctccagagggcatttattactgtctgcaggtatttttggtttttatgtctggaggaagtggtgctacaggcaccatttgtaaagaccggggatgctgctgaacatcctacaatggacagctccacacatcaaagaagtctcgaatccaaaatgtcaatagtgccaaagttgagaaatcctggcctacaggaatttatgacttatctgatactgggctttgaaggctatatagacagttgattaatttagaaacagcttggcttgtggaataaacatacctggtatagtctgtgaactgaagtgagccaaggtggtcccagtattgcttccacacttgctgtctcagatctctgttctcagtgaccagagttaaaaaccagcttccctctgcccttcacgtctgtgggtcctatggttgaggatttttatgtattgtttttctttggggtcctgataaagcttagataaccaaacatagaatttttaaaggtgattgtgaatacaaagaactaaggagtgccttaccctgatccattctttacacaagcagccccagtcagggaaccctatgccaggggaggaattgggcctcagcatggacaagtcttggcaaagaccgctatggcagcagtgtctgaaaaaggaaaagagtccaaggagggaggaaatgactaggaggctgctagagccttccctcagcgccatgttctactcacagaccaatgtagtaaaaatgatttgtatttccttgttcctttttaaatttttgaaaaaaaatttccatatttgggggttttccccattgccaggtggttacattccaaagaaattatatcatgggatacagacacaagtatttccaatcatgcttattgtgtagggctgatggcaaggtgattcccctccatggccacacatcataaccaggcaagcccgttaagtatcagcaactggaagtccagcatcaggaccacccatccctctgtcaggcagccccggttggtggtggtaaatggaggagactgaggcctctttcactcacttaaattcggagagtgagccactctactcctgttgggaaaacctatttccttacccaacgagactgtagaaaattcccctcagccatataccatgccaggtttcttttacaagccaacctgtttccaagcaacccttcttgtaaccttctggagccaagtatctgatattcgtactgggagaaagatgaacggattctgcacagacacgggccctgccaacatgggcctgggaagaggggaagctggatgtgtggctcaggagacaggcagaggttgttagaggaagcacagaatactggaggtgaagataaagtcagtagttggccaggccttttgtgcaacggactcaagaaacatgtaagagaacaaaacatttttagactgataactgattacttgtgtacatcttgaaagttggctgctgcagggcctaaacaagagagaggccttacagtaggggttatgtgtccataggctcatggaagcttggcattgagatgatcttcattcattcaatatcatctactcagtcattcagccaacactgagttaagctctgagcaaggcattgtagttagatggcagataggttagcgttgttggaaagagtgtggggtcagaggtctgggctgcagaaacccaccacagtttcctctaatcatgcctgggaagggggaaccaagggggaaggaagcagccctctattgagcaatcaactatgcatcgggcacttccacttgtgttgtagcagcaggagccaataatcgtgcatttgggactgggccactagaagactggcttgttgggatcaagtcaaggggttcttggaaacctgctgagaacaggcccatcacctgacagcccagaaagatgtccgagtctggtggccagatccaatgggggagatccagtgggggagatccaatgggggagatctaatgggggagagccaaaggtgtttgttggtagctctgacaccaacttttatgacctgggcaacaaccaaaacaatttaataacgctctctcagagttcaagagaaaaggactaaacagaaataagcagcagcccagcctctacccagctggtactcctggaaattgcacatgggtgaagcaaggctgcttcctcctgctccacttgtgagaaaaatgactgcctgttctcctttctcagtatcggtctctaagagttgtaatccaaagaaggcaaaatacaattactttctgttgcatttttagagcagcaactgtaagtgggagggaaaaaaaaacagacatctagaaaatggtggaatgaaatatgttaaatcatacaaaacaagtggcttccagtgaccacctatactgaaaaataaatgaaatcagaaagtcgtatatcgtgtagaattttagaggaggaagaaattttggcaattctctaagccagctgccttcattttctagaggaggaaagtgagcccccgtgctataatgaagctgtctcagagtctcacagccccctggtggcagaaggagcctgaaactgattgtgctgcgtgttggtgatcccaaatgtctgtccatgtttgtaaattaatatggtggggcttatgaaatcaggaccacagtcattgtctgtgaatacttctctttttctacctttggtcaaaaagttggttggtagaagaagagctagaagcctagagccagagccgtggagccgtgggggttctctttcatcctatctgcagcttgggtagccagctgggttttggaggagagtgcatctcttccgaagaccttagttgctttccttgcggaagggctgatcctggcctccgggaacaggagaaacatagtaattttaaaggttatgaggaaaggaggatagggatcccgaaggccagggaggaaaagccagtgagtttggagcgtgggagctgcaggcaggtgggagaagctgaaggcctaacgtggctgttttatttgtttaaatgtacagggctcagaaatagaggattttggaaactgtattccactgttctaaaagagaaagtgtgtaggggggaaaatagcatcttgactacaatgtaatcctagatcttgaaacgtgaggttacatggacaaaaaatgcttaatcccaacttgaaagtatgcataatattcaaaattatcccccaccttcagtgctttacccaggttatggagattcttgaaaaacatgtaaatgaactttgtgtatgttagtctatgtacacatttaggaagagttccatttaatagtctttttgtaaaacatgatctaggatttatctttcatatgtacaatccatctgaatttaagtttcctcatctgtgggggtaatatacgggttatggtgagaaataaatgttgcaaataacttaatcttacacaaaataagcacttaacacaataaaatatatgtgtattaaaatatctcaatggaagtcattgcattagagtcttcaaatactcaaaaccagtctttttctacccaggaaacacctacattctaaattttaaagcccctttaggtaaatactgatattaatgtttcagattgttttgtttaaaattctcttggcattgttcttctgtggttttccagaaatatggccagaactacaaagcacatggtactgtaaacaattgctatgccagtcatttaaaataactcaattattaaaggagggatgtcttcacccccactctttcagaaaagacagcttggcctctaaattcttatgaatttagagagaagccattttcctcatcccttcttgatgtcattccttagtccttacatctgctggatctattctataaggagtgtttagggctggcatatggaaaaatgatttgagattggtaaacagcaagtcacagcaagtgatgcctctcactgtcagtctataaaatcactgcatcgtcaatttgaaagtgtttttgttctatgtatgattccatctcatttagcaacagttaccctgcccctttcttccttctaaaccttggatccctgagctttgcttttctatttcgtaaatgttatttattcctctaacatagataatgacatctgtgatataatacatgtatgtataattccctatcatcaacccttacagcttactatgaaaattaagaggaggaagaattaaactggtagagatttgaaaggaagagaaaaactattttgatttcttctaggcctgtttcactaccatttattatagtcctcattatgtcttttatatatcaagaaaaaaactgcaggaccaaaattgaggcacaagtgggaaaaaacatccagtgatccctaccccaataagaagcttcatttttatttttttctttttgtttgggtaaatggatagcaattaagtcctcctgtcttatgaagtcagagatttatctcttgaattaattaactgcagaatagtgacgagtggcccagtgaacactatcagagcactgagagatgctggtttatttcccctccttagctaaatacattcttctttttaaaactgaagaggtcagttggtgggatgaaaaagaaaggtttgcagtctcttgggataggcggtaaaagataacaaccagatcttgtatgccactgatatttccagagtatattaagtttccatgctggtttccacctttttaagggagttataatcatcccctctcattccctaaatcagcaacaacagcagtggttttgtgtgtgtgtgtgtgtgtgtgtgtgtgtgtgtgtgtgtgtgtgtgtgtgtaggtggggataacattaggccagaagggatggatgagagggtggaggttgctgagggtttctttgaggggaggttggttgtcctaatcttgttttacttaaagctggtaaacagcctagattctaattcctattctaaagattcccaatgttatagtgaaacctttccactttggccccatataggacaccttttcaattagtgcccatgtgtctgtgcacctgacatggcagagggctgtgatatgcccctggagaactctgtagagcagaggtttgactttggccctgacccatctccacacctatgggcaaagagttaaccatggatttgccagtcaaaggagaatgcaaattaaaagagtagaagctggcttggtattgcttggaaacaggcccatgtagccaataaacaagcagttggagtagccacatattttagctgggcctgtgctaaactgaaacacaaaactacaaagctgctatttctgtaattctatgtggggttatgacatcaggtatgacagttatgagcatggactcagggttaacagatctaggttcaagggccagctttgccacctcctcactgtgtagccttggataagctgatttgtctttctgggccagtttcatcttatgtaaatcaagagtaagtaattttgtacaaggcttggactacagtaagtactcaggaaaggccagctagctaatagaatggtgaaaagagccatgaacatattccattcattccccatcaaaagaagagtgagtggagttatggcaagaaaggtactaccgtaatgtgaaaagattccacctaaagatacctgatcatttcttacttcagggaagcccatcttacaggtcctttctggccctacagtgtaagactttaaaagacataggtaggcaggcacaattgcagtttctccatatctttctgcctaggtgtgtttctcaacccccacttcacccacaagctgctgttacatgttcctccaagagtccagcatcccagtgagccaattagggaacacactccttatttgttattgcaaaagtatatatttaattgtgaatatgggtgtaaattcttctaaaggactattttaaattttaaatgaaaaaggctagagaagtgtaaaattttattataaaaaggaataaacaagaaccttatttggtagatgataaagaatagctatagtttctgccctgtgagagcatacaattttaataatcaaaactcttaagagaaggcatggaaattttattgttttagagcttccatggggactattttacaaatgcagtttaactttaattgctgtaaaataattgaacatgactattagtgtataaccataaaaaaatgaaaattataaagttaagagcaaataatacaattaatacacaaaaagagaatctgtctcactagtgatcaggaaaatggagactaaaacaacaagactggcaaaagttaacaatattgatgatactggtattggtaggagtatgaggatagaatcattcttacacagcactctgttggtgagtatgtaaattgatgaaatccgtagaagacatcttggcagtacctaccaaaagtataaatgtgcatttttttaactcatcagttcttctaggaatcaaagctgaagaaatattcaagaaataaatgtataggagtatatgaacaaggatattcatcaccacattattttctattaaagagagagaacaagaaccctagtgtctatcaataagagagtagttaaaacaattgtggtacatacaagctatgaaaatctatgtaaccattacaaataatgagatctgtatagatggaagcatagtatttgggggaaaaaaaagcaagctgaaacaaagtatgaatagtacagtctcattttaattttatttttatttttgagatagggtctccctctgtcaacccaggctgaagtgcagcggtacgatctcagctcactgcaacctccgcctcccaggcttaagtaatcctcctgcctcagcctccccaggcaagagccaccatacccagctaatttttgcattttttgtaaagacagggtttcaccacattgcccaggctggtcttgaactcctgagctcaagcaatccacccacctcggcctcccaaagtgctgggattaaaggcatgcgccaccacgcccagcctcatttttatctgtaatgcgtgtatacagacatgtatttttcagtgtgtagagaaaaaagccccaaacacacactaaacagttgacagtagttaaccctcaagaataagtgtgagaagggcacattggtgttttactttctgtagttaagagtttttttttaactttttctcaatgagcatgggctacaatttacctttctaaattgagcaatggtatctttatggatatttatctttcagtctgatatatttttgagcctatattgtttttcaggtaaaaagcatttggttataggtccatagggtatatgcgcttggaatatagatcaaaacaagaaccagaatgaccatggcttaagctaagttgaagtttatttctcacacgcatgaagtgcagaggtcatttacttgcctctgcagggtattcaggggcctaggtttctatcttgtttttctaccattctcaatgtatagctaacaaaagcgattaaagaagcctacttcatctctgtccatcacatctgtacacagcacaccccttcctggtgaggacgtgacctaggagtcggacacatcatttcctgtcccagctcaatagccagaaaatagtaatgtgatgatacctacctaaaagagaaccaggcaaaatacccagttgaaatccattactatatcacaaggtttccgaacctcagcactattgacatttgggctagataattgtttgttgaggggggctgttctgtgcattgtaggatgtttagcacatccctggcctctgtccaatcagtgctaggagcactgcccaggtgtgacaacccaaattgtctccagacacagccagatgtccctgagggtaaagtcaagcctcttgaagaacaactgctaagtaagaagagaatagatgctgcagacaaccagtaacatccgctataagcattgtgttatttcccccaaaacagtgcttagcactgaactaatatataacctttcaaataacaagtcctctaccaggaaatcaaacatgctaagattgtgtcaaattttattttggttgattctaggatgaaaagtcaatcctgtcttattttaatctattgaatctaaattgatatttatatcaaataaataacaatttttatttgaatacacagacaaatgaaatattcttccctagtgtgtaagaatagtattaaggatattatactgtgttacatttataatgaatatctcagtttaaagtgtaatatttctgaaagactaatataacagcaaatatatacagcaaatataacagctctatcctaaatcaagaatttcatctgcagttgatggcctgtctctttttagggcaattaagtgtccataatttgatgctgctgtattatgaatactttaagagtacagtatttttctgttaatgaggagtgtttacttaacatgctcttcctttccaatgagggaacatgctttgctgccaatcaaattaaggtggagatcatttcaaagaaaccatgaaacactttttctttattctgcctctcctattaaatgttgagaagcaaatcttctatcaaacagatggatatactgggatcttgttaaaaggctgcttgataaaaagggaaagttaaatataaagtggatctgtgttgggcttcttccaaggttgtttagtgcctagtgtgtcagaataaccttgttataaggcaaattcaccacatggagtgttcgtgccagcctagggaaggccatcatttaatggaactccagtattcttatttttgaaaatgcagatgctgcagaaattatatcagaaatgtcgttgccaatcatgaaaataacagaataccccaaaagtcacgtatgaaatgattcatactgggagacgggagtaaccggttttagctcctgtaatgaacagaggctgtgtagaggcatgattggtaaagctggacctggaagagtgggtaggatactgaaaagagaatggaaaaggacagcatggaaagcccagagatcagtggatgcagagaccagaaatcacaaggcaagtttaagtgggacagtttggctaaagtggtggatttgcatagaggcaagaggatctctggcttgtggccaaaacagtaactggtccaccagagtttgtgccccctcttccaaagcacagctgggtctggaaagcagctgcagagccggccctccttgcatctgagccaggccgtgtggcttatccttactggtgtgctatgaatgagtcattgtctgtaggacctgggcagttaaaggatgacacacttaaatcggataatttggaaggaatttaagagggactctttttatgagaacacatggacacagggaggggaacatcacacaccggggcctatcggcaggtgaggggcaaggggagggagagcattaggacaaataccaaatgcatgcagggcttaaaacctagatgacaggttgataggtgtagcaaaccaccatggcacatgtatacctatgtaacaaacctgcatgttctgtacatgtatcctagaactcaaagtaaaattttaaaaaagaaaaaaagaaagactctgtttgcaaagatgtgggagaaatgcagggaaaccataaggggtagttcagtgtcttgaggcaaaatgtaccttgttacccgcctcccccacaccgccccccaagccataaaaaggtaagagaatggcactatttctagatcccagagtaggaatcatctggaaagatccacagagaggagctgtaacctttagaaggacacaaccagaccgagtcaaacccttaaggagggagggatggaagtaaacactttgacctcactctcaaacctccgtccagtcttctgccatggtgtcccattggccaaacccaactagaagccagagggagccctttgatgtggccttactgatggtaacccagggcacagagcagggtgaaggagggttgagggacaggcctggggtagatatcctgcactgtcacttcctggcaaaggtaggaagaagtggatattctctcacttctcctatcagccagctggactggggggattttacgatcctaggggctactagagctacagggatgcaggagccaggctctctgaatcacctgacaaaggcaagtggattatcattcagagacactcactgtggactaggtcctatcaaaaaataaacttctcttgaatcaagacattgaattttaggggtgtgtttttttttataggacttggtatttgaggattgatttattacagcatttagcattaacaggaactcaattgtagaaagttttgaaggccaagcaaagaatttggattcatttctacagatggttaaaaattagtggaggcttctatgctgggaggtggttttaaaaggaaaaacagaaagagagccttggaatgatgagtctggcagtcacatggcaggtggaatggaacacagtgagcaatccattgatgcagctggcccaaaccccatgtgatcagcgggacctgtgaatcagtcccacacaatacaagctgaagggatggaagcataatcatattccaagttcaggtgccagcctgccatgtagaacttggggaaggaggtggtctaagaccagttgaatgatcaccccactctatgaaagggcctggctggcccactgtgagatatggaagaggaaatttggaaagagttgttgatatgtcatgagtaacccacataagggagaggcttgggagagggtctgcccaccatctcaagcctagagaagggggcttctgtgagaccactgaagagtgtgctgtgtgctccctggagcctggaggatgcaatagactatagtatttttctgaaaaatcagaaagttttcagaagagaagttttggtcagctgctctgatgacggcaaaaccaaaaaaggctccttggggagggtgggtgttccaggcaaatgatatgtgaccattggaggacactgagctctagagagagctaatgtggggtcaccccagtcctgtctatgtgaagacctggaaaaacaacaggaaactaccaggcagaggaatgcaatagccatttgcgggggagaactgcagaccccatgagagcacctcacaagaaaaaaagatacatacctggacagccttttcagttcctggtacattttacaactgtactcttcaaaaaacacctttcctacctcttttctcctccctctagcaaccagtcagaaaagagaagagaggctcccaagcccctcccactgctggaggccggcttgtgccaggcaagctgggggaagagagagatggctaccaaaagcatatataagtttttattattattattattattattattaagctggactgtacataccagatgtctagatgagaccatttttacagatctatgactgggaataaacagaaaactttttttttttttttttttttgagacagggtttcattctgtcatccaagctgaaatgcagtggcacaatcacagctcgctacaacctttacctcctaggctcaagcaatcctcctgcctcagcctcctgagtaactgggactacaggtgccgccaccatgcctgaccaattttttgattttttgtagagaaaaggtcttactatgcggcccaggctgatctcatactcctaggcccaggtgatcctcctgccctggcctctcaaaatgctggaattacaggtgcaagccaccatacctggacaggaccttttattccagaagccaccagaagggtcatagacctgccgtatatttcatgctggggcagaagaaaaatctaaccccagaatacatttagaggaacagtgggagacaaaaataaacttgttatgattacattttataaaagcacaatcattacataggtttgttgcattaaggccttgacctaaaagaaaaagctaaaaagatgagcaactcctaaacatgcctttgtcatgcctcaaaatgtattttaaaacatagtagcaataccttcattggaggacatttccatcccaatatataaaacataaaatttagaaaacttgggaagtacaaaacttgaaagcaaaaatcacctaatatcccgctatccagaaataattgtacattttggtatatttccttcctgtcttattttcctccgtggatatgtacacgtgtacttggtttttcttgtttaaattttatgatctgtattgtgtcctgctttttaaacttaacatagtatcttatttttctaagttaaggatcacttctaaaatatgatttaagtgatggcataatttgacgagtccatcaaataattttgtcaaatatgctagatccagatttaggtttatatatgaattaacaatatgaatgagaaaaatatagagaatttgactcatagctttagatattccatcaagttgtagtatttatattatcagatgaaagagctacttgtggagacggttgtcacccctttcttcaaactctcttttcttggtttcagtgaagccatatttccctgattttcttctactgtgttagtcactcctacgtctcctccaaagcttttcctccttccatctattttctaaatgttgttgtggtttaggactctccttggatactcccctctctctcttggttttctcattcaaccccttggttttcaatatcatttatatgctaacaactctcaaaatgaaatattctctctaacctctatcccaagctccagacttgtatgttagcatctccagttggatgtctcattagcatctcaaatggaactctgaatctctgctccaaaataggtaccatcttcagtttcctcagcttggtaaagtgacttcagtcctctcaactgctgaaggaaaatgccaggaggcattgctggtacttttctgtcccttatttctagtttgcagcaaattctgtctccctccctccaatatatctcaaatccacctcctctgcccatcctctcgttcatcacccttctctaagccatcagtatctctatatgaaccactacaactgcccccaatcactttcctgcctataatccctccaatgaaactggttgtaggactatggaaatgatacagtttgtgggtaggcaaacctcctcctctctgagaggaagtgggacaacctcttgcttctgagttcttcaaatcatttctcaagttctttcctgtattaattttctattgcttctataacaaattactacaagctcagtggcttaaatcaatgcaaacttattatcttatagttctggaggtcaaaagttctaaaatcaaggtgttgacaaggctgcgttccttcagaggctctagcagggaatcaattcctgctacgctaagtagcagccagagtgaaccttttcaaataagaatgctgttccctcattgaaacacatcaaaccattaggatggcctataagacccagatctcagtctgtccagtctttccagcctccagttctggcactttccctgttacccgactaatgaactcatatgatttgctttcaggtccccgaaccttactgcttctctatccctggaaatcaactcccctaatttcctaatgtgctttgtctttcctcaccacacatagtaatccaaaatgtcaattccttaagggcaagactctgttcaggtcacctttatgtccccagtttgtacaaaggacacagccagtctttgttgacacgacttgttgactggcccattctcacttttcaggtctcagcctacagatcattcctcagagagacctctgagactccatcattcttgagtgggtctccgcccttctgacctcaattatttcacgctgttctttctgtcactgacttcatttgtctttatgcatgtgtatctttgtctgtttaatgtctctttcccccactagactagaaactcccatgagagcaagaaccacgtctctttttcggcttatgcttcgcacaatgcctaaaataatgcctggctcatactaagtgctcagatctttgctggcagaatgaacagcctctgactgaatggggttctgagggaacctcttctctctgctgggggcaacacgggaaaaaatgccagggtcaatcctgaagtagaggagtgtgatccacagaataatgggaccccaaagagatctatgtcctaatccctggaacctattaagaagacattgccaataacttcacacacttggcaggtgtgattaagttaaagattttgagatagggagattatcttagattatccagatgggtccatataaagcgaagtgagaagatcagagtcacagaagatgtgatgagagaagcagaggtcagagggagacagagatttaacaattctgctggctttgaagatggaggaagaggccacaaggaatgcgggtggactctaggaactgattccccaccagagtctctgaaggaacgcagccttgtcaaaaccctgattttaggacttctgacctccagaactgtaagataataagtttgcatttttttaagccactaagcttgtagtaatttattatagaagcaacagaaaactaatacaaggaagaacttgagaaatgatttgaagaacccagaagcaagaggtggtcccacttcctctcagagaggaggaggtttgcctacccacaaactgtataatttccatagtcctacaaccagtttcatgcaatctctctctctttttccttagttctctcagtgggaatctatccctgtttctttctccttaattctctcagtgggacaaataagtggactatgacttgtttcttgagtataggttcacggagaggagggagaacctggagctgggtttgagctgtagaaatgaaggaacgtggaccaggtgtggcggctcacgcctgtaatctcaacattttgggaggctgaggcaggagaatctcttgaggtcaggagtttgagatcaacctgagccataaaatgagaccctatcccaacaaaaaattgaaaagattagccaggcatggtagcatacacctgaagtcacagctacttgggaggctgaggtgggaggatggcttgagcccaggagtttgaggttacaatgagctgtgatcataccactgcactccagcatatgttgtagaaccggggtggttaccgaagaggaatgaaggagaaataataaataaatggggaggctggtcagcatctcccttcccatacacccatataagaattactctcttgctgttttgttgttgttgttgttgttgttgttgttgttaagactgagtcttgctcttttgcccaggctggagtgcagtggcgccatcttgggtcactacaacctttgcctcctgggttcaagtaattctcctgcctcagcctcctgagtagctgggattacaggtatgcgccaccatgcccggctaatttttgtatttttagtagagacgcggtttcaccatgttagccaggctggtcttgaactcctgacctcaagtgatccaccctcctcagcctcccaaagtgctgggattacaggcgtgagccactgcacctggccctctcttgctgttgacaggtgatactgaaccatttctttatggcctagtctaaggcaccttgtcagtgaatatctctgatttagaattagactctcaaaatctatggttttgggaaaatagatcttctcagaaacagagaaagcattggacctcatccctggtaaaaatgcacacaagcaaaaattttcacatgtagtttttaggggttcataaggtcagcttgctcaaaggatagagtatttggtttttaaaatatatatcaggcgtgggagttggtgggaagcagacagggagtaatattctaagataggcttccagtgttaagctaaggggtttggacttaatcctccagggagggcactgagaacccattagagggcttcaagcaaggcactgacatgatcagatttgtgcttttgaaaacaatcactctgcaaacatctatattggccataatcccaacatttgttcatccattcaccttaggtggaaaaatgctgttgacatgaaatgttttaatatttccttttaaagccagtgatatcagatggcatattaagtgacctaattttatagatagtgtgctgtagaaagcagttttgatgtaaggacgtcaaaatcttgtcagatcattgcttttctaagagatggtttgcttaggcatttggtcttattgtaactttcatcattattatctcattgttcgctgcttctcagcttttatcagatccatctctagcagagaaaactccggtaagtaaagcaaaattgtagaatgccgtattgggagccttctagaagaccagcgtatgcacacactagctaagggatttagaccaagttcatctcctggagccacggtttccttatctatactatggcattagaaaccctatgtagctatgtaacagttgtgacaatcaaatgtgatcgttaaaagacagtgctttgaaaaccataacatattacccaaatgcaagctgatattcattttcctcttagtattaccatcatatctgaacatgtttgggttaatacagaggagctgtgaaactaaacgtttgtggtttgcctttatgatgttatatggttctccctttctccaagtatcaaatgctttagaggtttttctagtatccaggcaacatattgcctccacttagcccttgcaaaaacctgaattaaaaatagactctgtttgctgtgttctgaaacttaaacctatatgttttaaaggagtcaaaggttccccttggcactcaaaggggcagtagtcctgtcctagcacttttagagcatatgccaagccatgcagaggaaagtggagaagctcagttgtgcaaagccggcaacccaccaccgtgtcactggtctgttggtggtatcctggaggaaggaagggagctctggcggcttagagttttcagggaaaggactattggttctaatactgcaatcaccaacacttcacacagaaggttctttgtcatcatcatgatttactaatctcatcagagacactccaggtagtgtttcacagtgttttttcacagtttcaaagtacatctggcttaatattaggatgtgcctcagacatttccacaaagcagacaagatgctttttttctattttatttttttaattgacaagtaaaaattatatgtatttattgtgtacaacatgatgttttgaaatatgtatacgttgtgaaatggctctgttgagttagttaattgaggtagtgtgcatttcctcacatagttattttttgtgatgagaacacttaaaatctactttcttggtgatttttaacatacgatcattgttattaatgtagtcaccatattgtacaatagatctcttggacttattcctcctatctaactgaaattttgtccttggaccaatatctccccaagcccccagcccccaaccagcccctggtaactggcattctacttcgagttcaacatttttagattccatatataagatgctttttagtgatacccaaatatatcactattaaagcatttaatttttacacagacctggggaggaggaaactttgaggtgtcattcctagtatgtcagcaaaatgccgccttttgttaatagtccccatgttaccagtggtgacattaacgatggtgtttgtacagctttaccaagaagtttacaagtttttccttggcttacccgtgggtgggtatgattggaagaaataaaatttttacccttttttcaccaaaaggaatggctctctcagagcttttgctttgttgaggtcaaacattcatacttaaaagagaacttccgactttgattctaggctcattttgcaaacactgatatggaggcagcctgaatttggcagtcagactccaccacatactagcaaagggacttgggcaagtcacttaaccttgctgagccttaaatccacctctgtaaaatgggaacagttgttactatgcctcacggttctggagagggtcaaatgagtgaggagattctgatttagagacagtggagtgtaacttgggactctggagccagcctccctagaggtgagtcccagcttcaccttgtcagtagctgtgttacctcgtgtaagttgctaaaccttcctgagccaatagaaatagtaagagtgcctacctcatacagtcgtgaggataaaaggcttaatataaccagaaagcacttagaacagtgcctgccatttagtagtaaacactacattagtatgtgctatgattatgatagattatgatcataattgttattattcatatatcaagtgcctggcataaattagttggtcaaaaaagattaataactacttttattatttctcccatcagagcacctgaaatttaaatgctctgaaaggaaagtaatattattaccagtctgtttttgatttaactaaatatataacagcagggttcttttcaaaatcttactcctcagggactcaaaacttaaccttacaccagaggagaaagattttttcttagaacaagagcatatatttggtcctcactccagacctttggaatcagaaattctggggacatgaccgtcatctgttttagcaagtatacccagtgattctcatgttcctgaagtttgataacactaggtgtagactagtcacagctttgactaccttctgttgccagggtggagacaagaattggttactctctttggcaggctgttccagcccaagaagtgttaaaatgatgttatcgtggtggttttgtgagttaagcagatacagatagttctggaaagcagcgtcaggggtgcggtgcgggggctgcagagcacttgggcagcatgtgaacctgttgatagatctggcttagaacagtgtggcgtatcgggccctctgggaagtgcttatgtcacgtcttgtgccttaccagtctgagtgacgcatgggagaagagatgccttttgagtttttatgcaaggttaaaatgaagaaaatccatttcagcctttaaaagtcagagctactggtacaaaaggtcactgacgccaaatggtggcattgcagagctccgagagggagcattaaaatagcagggggtttttttgtttgtttgttttttgttttttttttttaagaaacactgaatgcactgtgggcttaagtcttagtcttttgccatcttgctgccctaggatcttaaataaaagggcatgtgaaaaaagaaaaacacgaagacatttttctacctccttaagtgtcaaggatgtagatagtcgtcctcacactaaaggtgacataacctttattgtagaataagcaaagtgatgaaatgatgcccctatgagaaagtagtctgtagatggactagagacctagccctgctctagatgtagtctgtttggaggtcaagtttggataactgaagatgacactgccttgggaaatgaagccagtctcagaagtggtgtggagaggttgtaagatattaatctggctctgtatacactgcattcgtgttgacagaacagcatcccaattgattgaaaagaatctgcgagccatctgaatagaaacagtatttaagtcattaagaatggattgattaccagggcaattaaggagacctgaggatcaaggaccgaattcaggggacactgcaattatagcaaatacaatatgagaggtcagagaagaagtgacaggagagactataagaaaagctggaagtgggccgggcatggtggctcacacctgtaatcacagcactttggggctgaggtgggcagatcacatgaggccaagagtttgagagcagcctggccaacatggcgaaatcccatctctactaaaaatacaaatattagccagatgtggtggtgcatgcctgtagtcccagctactcaggcggctgaggcatgagaattgcttgaacccgggaggcagagattgcagtgagccgaggttgcacgactgcactccagcctgggcgacagagtaagatgctgtctcaaaaaaaaataaaaaataaataaataaataaatatatatatatatatagaagtggctccaggaccatattctatcatagaaatcaagagaagacatttttttccagaatagacaggtgttctctggtgttaaaagcttgaagaaataaaaagatataaagcatgtggggaggtggggatgggtcttagatttgctaagtaaaaatattaaatcagaaagaaagtatcttttctataaagtaaatgatctttattacatccattcatgtcagggtttcttaacctgagcattattgacattttggtctggatgattctttgtggtgggagctgtcctgtgcagcatccctggcctctacccactagacgtaatgccaccacctccagttgtgattaccaaaaaatgtcttcagatatcatcagatgttcctggtgaagaaccactgatttaagtatttaattcctaccatgtatgtagcactacattaggcagtgcaaggcataaaaagtatgacacacttcaccgtaaaaaaatacattctaattgtcctaaattgagttattctgttatttctcctattatgttggttaaaactatatatgtgtatactcatacacacacacatacacacacacacgcacacacacacgtatacagtagttattctccaagttaacattacatcagcttaattattggatgatattagaaaagtagtaaatgggaaatattggtgtccccatgctgtatgttttagcacagattaatgtaagaaattattatggatctatggtgggactagtaagcaatttccaaattaaattataagaaacattatcacaaaaaacatttgaaaagaaagagctttaatgtttggaatagattctgcatcaaaagaagcaacttatcatcttgccaaacctcagcctcgtcattgttttggagcaagaaagagaattgaacctcactcatgttttgttgcctgtaccattgaacaaggccctgactgttaagactaatgttgagacccttgttttctttgcagactgcatcatctgctattaaaggtgctattcagctgggaataggatacacagtgggtaatctcacttccaagccagaacgagatgttcttatgcaagacttttatgtggtggaaagtgtgttcctacccaggtaagaacatttttatttgtgatgatttccatgctaaggaaccttctttgtgacaaccccatattgaagggcttttctactatgtacatgtttatatgtacagatgtgaatattgggcctttggcagggccaaaggcagtccaaatgatgtttacttcctgtttcatcaggatgtctcacaatttttatgtggagatggtaaataggtttcatctatggactaattctaattagttgtgatgaatgcctggaagaccatatggagaaagattttgaggttcagtgggaaagagtgcagtaatcacagagtaatgtccgccaagggtttatagaaagaaggcttccatgaagcagcaactggtgctaggtttttgctccccctaatttaaaagcatgggctggtaggcccataattgggcctcaaatctgagtttagtcttatctcttctcttttatgatgactttaacttaactttcctcgagaaaacatggataatcctgctgtttgcaaaaataccaaagttacccatatatgttgtctctagctttcatcattttagggtgaggggatcaattatttaaaaacaaatacatctggaaatggatgatggtaatatgaatgtattaatgccacaaaactgtacacttaaaagtggctaacatagtaaattttatgttgagtatattttaccacaataaaactaattaattaaaaattctattactacgttcatttaggaagagaagaagtaatcattaaataagtatcaccacaagtgacaggatttttcaaatgatccagaaaataaaaataaagatattcaatttggggacttgtctttggagctgtgagaattgattttaacatttctcttaaaaataagtcatgttattaccaggcttgggtaaacatagctaaagtgacactttgtttaccactagtgtcctcatcaccttattaaaaatctatatgtatctttagaataattgtctttacacatttatctctgtgtctaggtgtcaactgcctaaaaataaaacctgtttgtggacatgcagtaacccccacatagtcaccaaggagcagagcccataaatttttaaaagtcagctacctcgttttgctttaaatgctcttagctgcagaataaagttggtctactggccttttgaagtctgcttgtctagggtcctctagcagccatgagaaccagattccaggcagaaaatggacaaccgcaaggcccaagatataatccttgcttatgatcctactcttctttctatagttggaaatgttctctgtgtttgtttttaacagcctaccattccaaaaaaaaaaaaatgtatattaactacatgtttttctcttaaaagccagggggtcatgagtttatcttcatcttttggtatgatttttttaggctcataatgcttgtaagtgtgtttgcaggatgtttgtttgagctctcatggtctccaaaggtctctacccagacatttcaactttgttgttctttggctacaaagaacaggagaaatggaggacttctgtgggagtgtggagacagtgagctcagggtgctgagagcattacagctgaaggtgggggtataaagacgttccatgtgctccccctatcctcactgactgacctcttctacttccagtgtccaatcaacacagccaaccattgacgggcacttggggaaagcatggctcaggcatgaggtccccaaatcctaaacactggcacacctggaacttgctagacatgcagattcttgggctccacccagaccaactgaattagaaactctgtgggtgggaaccaggaatctgttttaacaagccgtcggggtgattctcagcacagaaaggtttgagaaccactggcctcgcccatgactttccacttgagagagagaatctttctggtagataacaaattttgttcttggagttattacacgactcttacaactaataaaactcaaatcattttttaaaagcatcttaaatgtcaaaatgacatctattagcactttgcatctttggccttcactgtcatccaaggtagcagcagcaggtgtgtcactggcagaggagtagctagctgactttcccttatttagaggcatccattgtcacatttaaaatatagcaatttagagtatttgcagcctataaatgtgcacacctgtaatcccagcaactcaggaggaggctgaggcaggagaatctctggagcctgggaggcagaggttgcagtgggctgaggtcctgccactgcactccagtctgggcgacagggtggtactctgtctcaaaaaaaaaaaaaagaaaaaaattacctccctcattttctttataataatattgtgtaaaatgagtaaaagtctataagaaaaactttaaaaattattaagtgatacacgtgtgtgtgtgtgtatacatatacactcatataatatatatctacacacatatgcaatggagtaataaaaatactacataataaatataaaatagaataaaactatttaaaatagatgcatgaaatagaaaggctaaatagatattgatgtttgcatgtaggcacatttagttggattaagttagatttaaattgtccgatagagaactgtgcatacaattacaattacaaatcaaccctttctctgggctgtctaaaataatcaggtactagaccaaaaaatgacatgctgtctgccttaccttttagtgacgatttgtaggaagaggaaggtgggggctggtgagtggaaagatagtagagtttgtgagggaatgttctgtgtgactgaagacaaaggctggaggttcatggaccagaaggtgtgaatctactctgaaagacaggcaagagtccagtccagggaaaaaggtgcagatggtaggattttggtgggtactcgaattaaaaaaatggatttgtgaggcaatattgctggggtcaaaaccaaaaaatcaaattgaccagagtgaaaaatagcctgggtcctagcatggctctgctgccacgtaggatgactggactgtcccttcaggttcgtgtaacaatccatactacttatagtgtacatgaaatgctttctattcattcaagcaaccttactaaaaacaccccatgaaaataaaagtctatatcttcccttcaaaaaaaaatggcaatacaatatttaacatttgatgcattttttttttcttgttatttttaaatgaaaaagaattattgtcccggtttggctctacaccctcggactccggctcccacgccaccctggcaggtgccggcctcaacatttgattcagaccaagaatttctttcagcagatgctatcttgtttgtttaagtaacacaggcacaccagatggatttacagtaaacagaagaaacttatgttagtcttgcctcagtttcatcatctggactcagtgtcttcgtggatttagcaaagggatttggcccagtgtttctcaatggaggtgctattggctttgttggataagacaactctgtgcaagacagtacctttcaggagatctttggtccccaggccctgccagtaatatctcctagttgctgtagcagtcaaaaaacccctataaagtgatggataaatttagtatcatgattgtggtgatggtttcacaggtgtatatacacatgtgtaaaagtaacaaatggtatactttcttgtatgtcaattaaacttcaataaatcagtcaaataatgctttctctctaagtatttccaagcccatatggggatgaagaaaggggtaggtgggcaggacaggccctggttgtaagcatccaaaacattctgcagtctctgatggctcaacgagtctatctgggtcatagaactaattacttgaggtaccttgagatgttttaatttactgctttctgaagttgcagaatccgtttcccctagcaaccaaatgcattgtgtttttttcttatttatatattttgaagctgctcaaagttatttttaaatatcaagtacataatttgtcctatgaattatttcattttggagatggaaaaagccctgggcctttttaagatttgaaagaggatataaaaatctcttttaactgtttggctccatgatcttccaaaatgtgttccaaaatctcaaagtagataagtaagaaaatcatgatcatatcttaatattttgaccccaaattctgtgttgggatcagaagctcaaggttatagataggtttcatgcattgataggataaagaagaaggaggatggtttataaagcttgtaccatgtaaacaaggacctaaggtggcaaagggaggcaacatttttaaaaactaattgtgaatcaagcatagttttattcatatagtaaattgacttatataacatatattaatttttattatctttcatctttataagaacactatttggtatatgaaataatttgaccctaagacattaagtcacttagcccaaggctatccagccagtaaatggtaaagccgagattttaactcagggttagctggccccaaagttttgtttttctctacattgtggcaataaagcatgggaatggtatttctgctttattgaatcagaacaagtgtccagcttttatcttagaattatagacctcagtctgcttctttgttcccctaagagccagccctaatctgttctccaggagacactatcactaccttacctggaggtggcaaaaatggtttaaaagctggtggtaaaagtttaaatatctttccatattcaagaataattacacagctgaggaatttttaaagcccctatatttcagtctcttcacttgtaaaacaggagtttaccctgatgtaaagatcattacagaaaacagactgcccttgggtttgacccacatgcacttcaggatttatttggacagccagggaatacccaccttttggaaaagaattccaagaaactacggcaagggtaaaacattatcctaaatgataagcaaacatatatgtcaaagattcatataaaatattgcctcatatcatcactcaatgttacaggtttgacaaactagccaactgcctgcatttctaggcataatgacataaacttatccaagagtccatcttataccagggattcccaatccctgggctgtggacaagtaccagtccatggcttgttaggaaaccagcagcacagcaggaggtgagcagagggcaagcaagtattacaagggcgagctccgcctcctgtcagatcactggcagcattagattctcataggagcacaaaccctgtagtgaactgtgcatacaagggatctaggttgtttgctccttatgagaatgtaatgcccgatgatctgagatggaacagtttcatcccaaaaccatccccccatttccactgtctgtggaaaaattgtcttccacaaaactggtccctggtgccaaaaaggttggggaccactgtcttatatcatgtgggtcagcatacaacagcccatgggacaggccccgctaactgcccgtttttgtaaataaggtttaattggaataaagccacatccattcatttacaaattgtctgcggctgctatctacaatggctgcagagttgagtaattgctacagagactgtatggcccacagagctcgaaatattatctggccctttatagaaaaagattgccaaggctggctgcagtggctcacgcccgtaatcccagcactttgggaggccgaggtgggaagatcacatgagctcaagagtttgaaagcagcctgggcaatatagtgagacctcatctctttatatttaataaaaataaaaataaataaaaaagaaaaagattaccaactcctgatctatacaaacattctgcaccagtttttatgtacatgtgggtagaagacaaagctgccagcttagtcttcttgggagaaaatgagaagtgactgctgctgggcaagccataatatgatgctccttcaaatcaaaactctttatgtctttgttcagcgtgtatttggtgaggatggggagaaactgatttcctattactaaaagccatatacctcttcctttagctcaaaggatttattgcatgcactggatattatacaatattctactttatttgaagttatcttcaagcacggttttccagtatggtaataacttcttggatggtttaatgtttatataaccgatgatgtcacatgttcccagtaaatgacatcccggaatgcactgtttggttggggaatttaagctgtcttcagatgctgacttttacagattggctgtcagctggttggtctctgaagatggtgcagcctcgtcttatacaatgcagttcatgtgtacccatcacagaactgctcagcaacaggaggttggcaccagcaaggaatgtgtcttttgttttgctttgttttgtttttccattcatgagcactctctaatttggcaaaaaagaggaccaatttctgtctctctctctctagttacgtaaagaattgtatgtggaaaccaagggatatccaccttggctgaattggcagaggcaattaataataccttaaggccgcttttacagactgctgtgtacgaaggtccaacttgaagactgggtaccatcagtagtttgttactggattgtagtggcattcacccaactgtagtgccacttaagctttcctaatgtctgcacatcaagacaaagcacccttcatttatcctgtcatacagagggtaaggtcatgtttgttgaatacaagtgagggcatttagcatcctttagcgacactgaccactatcacccaggagttgcgtaagtactagttttgtcaaaagtcctcagagccactattgatggtttggttacaatttgaaataaacaaagctcactaaatggaaaatgctgctctagaggcaagaaagctctgagtctcagctccaaaactggtccccttgtgttgtctttgagatgctaaattagttttaccccattgcttaccaccacatctctcagtccagtgccaccaaaactagcacttggtcatcaggctctaaaaccccataaacaaagctgtgttgttattagtacatagagaggagaacaccaactgaccaaagcttctgtaagtgaaattctacccaccagcccctgtggtgtgaaggcctcatgtggaagtaattgggatatttgggcagggagaaacccctgaaacttgtaacagaatcctgaaaaggaggaataacagaggaacgtcaagtctaagttaagccattcctatctgcttatgacttttctgctgttctgatgtgagtctaatctcccaatcttgtttgttcctgatcagtttgggccattgttttccctccctggactatgatttatctgctaaatggggaattccagatggcggctaatgcttcctcaagcttcaacattgtgtaattctgaacatacgttgccattaagatatatgtatttttagactaagacaagcagtagctttggccttaaaaatgaacttgcctcagaagaggtgaatatcagaatgccagagctggtctgtgattgaactttaactgcttcttagtgaataagtggggaagaggacagagaaacttctgttctttatttgaaatttctttctccttttttggagctaaaaatgccctgatgtgatagggattgtaacgtgtgcttgcttaattgtttaggttcttacttggcaaaataaatttggaaatccaaggttggattccaaacttttgttgtcgaaattttactggcccatgggatccaagcatctagaaccactgctcaaaaccccatagctgagatttccaaagcttcaacttacgccaagacaagaaagtcagttgtcgggtgttttttttttttttccacaccctacataagtgcattgaagaaatataaggtaaatcttaaactgtgaggagttctactctttttctgacttcatttttgctaagtctggatgctgagcacagttactcaacaggtaactccagtctcaagcaaggaaagcctgtggacttcaggaggcaaacgttgattgcggtcattgtgtttgaatgttggcagttctgccatggtggaagttgctaagcacttggtacctgtgctgtggagattctgtgctgaacgcctgtgggctggcacccacatctacacacagtaaatgtgccagcgtggggcctcagagaaccaaggttgttgcctgctggctgaccttcactggacttgctgttttgttctctgcactcgtgctcccctgacaaatatccgggcccagcaggggccagcgatctcattaatttgcatttccttcactagagcttcattcatgtcaagctggtatttgttattcattggaacagcttaaatatgcagaggtaaacaaaccttctgctgtggtgctgagcacggagggctcagtttgggggaagaggaatcagtttatggcttttaacctctaactttttaaatttatttaattttgtgaatgataatacacagcaaggcttgtcctgttcttaaaaggaatactgtgaagagttccttttgtccctgtgcctttttttcagtgtccagctccagttatcactgttacttgtggctgttttttccttcaaggattttttatgtatatgcatgccaaaagaatatttgttttcttttttatgcaagtggtgacatcccctacacagcattctgcatcatgtttcatccacttaacaatttatcttagagatcttgccatgtcagtacataataagcacccttattcttttcttaataccacatagaattccattgtgtagctgaatcataattaattagacaagttctctcctgaaggccatccaggttaccataatgagtaaccatgttcacatatattgttttggacaaatgctagtttatccataggataacataggcatgcatttgctggatcgaggagttacatgtttgtaattttgatagaagttgtgaaaatgtccttcatggggaaaaaaagtctcaatttacattcccactaacaatatttcagaatagcattgcccctcaagctacatcacagtcgtggattttcaccaatcttccaggtaaaatggtctctcggtgacatttattttatgaatgaggttaagcatcttatgtttgagtcatatcttttcatttctgtgaagtgcctgatcatatcgtcagctatttttttaagttaactttctgatcttttttttttttttttttttgtctgagacagggtcttgctctgttgcccaggctggagtgcagtggcgcgacctcggctcactgcagcttcaacttcctgggctcaagcgatccttctgcctcagcccaccaaacagccgggactacagatgtgcaccaccatgcccagcaaatttttgtatttttcatagagacagggtttcaccatgttacccaggctggactttttggacttctatgcagttcattggagctctttatattaggagattagcccattgtctgtgatatgagttgtaaatattttcccattttggcatttatttttcttatttttttttaactactttttcaatacattcctcatgtgaagtgtttggctcagggctgtttcctatatagtctcaatcatccaaatgtgttaggggctccctgcattcaaagtactttacctttcaccttttcatttactaagccacttaatttgtagaggttctgtactgggcctcgtgaaactcagcttttaaataacagagataatttgaacccaggtctccctggactataaaatccatcatcttaactaccacacagtgtatccagtaggacttaagagagtacagcccagtcttaatattaaccaaaggaaaacagaagccataaaataaaacctactaggagagaaaacaaacaagaagttttgatgtactatgaacctaatttacagaaggcactatttgagaattttcctttccattcacgcaaatacagaggttcaagagtgtgtaacctcagcaattaattgttatttcctgtatgttaattacgccatgaagcaacatccattctgtatgatgcctccattaagtattatgcccactccttttcattttctctgtttatacaaatataatttcttgattatcccatgtaggtaagcctgcctcacagttggcccatacttctccatgtcttaatatggcccaaagatagctagatttaattctttttcatggaatgatttagtggtttttttgaatgaccaaatacctgttattatttctgtatgcctaaggaaataaatgttccccttctctacctgaagctgctctgctgtgtgtacatgagcattcttgtgtgtatgggtgtacgtgtgtctgtgtgtctgtctcacctccagggaaacctaacactatcgttttataccataactgaataaatcacagcagtcagagagatgtgaacccaaggaaaattattataattaatggaaacttcagggaaagatgaataatccaaggagctcagaactaacccaaaatgaaaataataatagtaaatgcagcatcctctctgataaaatcttgggcccaaaactgcaacaaaatgagaaactccatttaggtggaacatgggtgttttatcttacctctttgaatgttgaaggaaatctgctccagtagaatgagttactttgtatgggatagaaggtgaaaaagagagaagaaattggcaacactcttagcccactgaaagcagcctgcttcagaacctaaggccttgtggttatttttactcgcttgcaaaagtgaggaaggatgttataggtctctttgagcctctttgcttttaccctttatttctatatgatctacatttatattaataaattattacatgccatataagttccagaatcattccttttgacagtcccatgggatttaatcccctcctaaatcccaaaatatagaaagagaaaatgtttgggtacagcactggggcatcatgcatactgaatattcaacaataaccatttgaatgagtggatgatttgggggtcattccttactatgtgactgctcttctctcaggcagtcttagtccctgtgtcactctcctagtgtgtagccgggctgctgcctgagtgtaatcctagcctttcaagataaccatttattatatggtgctgacccctaacaacacaagccagctccatcctctggtactcagcaaaaaaaaaaaaaaaaaaaaaaaaaaaaaaacagtcatctgtaatcgtgcaggaggaaaaactagttgcgttggttatattgaatagatacttcctaaatagttttcaagggtgacctgtgactatgctgaatttctgccttacatattgattttctaatgtaaattccatgtaataatcaaatcttctctgttaacattatgttgaagactcattccttcactcaacaaatacttattgagtgtctgctatgtgccaggcattgatgcaagaatctgattgatctgaacaacttaaactatagtagatccaaagtgtttattctgtgctgaaagcctttgtcatttgcccagtcctttttgtgtggtatccataaaaagcagaccatgataaacttgcataggctctcaatgtcccacctagaatgtagatcaaagggattttgaacctttacataaaattctattgcattgttctaatttttctgaaaattttaagaacaaaaacactgaaaaatttaagaatgagtggcttaggtggtttgactgagctcatgtattaggtaatattgtatggagtcaaagaataaaaaggatgagattgataaacatcaacatttaggccagtggatccctctatggatctgagcagtaaaaagtacagaaggggcttcaactgtatggataatgttttatgtcttaagcagcattttggattcattgatattcactggtttattctttgtacattttatatatcataaatattgtgtataatttttcaaaatgaacccagaaaaaggaaaagaagataatgatatattgaggaatggaaatcaggttttaaattttttaaatatgtaaggtctccttttttggaaaatgtaaataaaagagttcagattggggtcctattccatgtgatggttctctctgttggtaggatgttttaagaattatttcacttatccctggttaacaatgtttgtcaaatatccaaaattcgtggttaaaaaaatgcatttttgaaattgctccacactctaaggcctagatcttttacccaaagcattacaatgtggttacactggtgataatggagtgatcttcccaggaagaaggcacaaggggataaatgaattttcaggcatgtgacactgattgacagggaaagcctgcacggagtgacctcactaactaacgtcttattctgcctggttatcattggcctttatgacatgaactttgagaaacccgctctcaggggatgatttttctagagataacattggcccaggactaatagagctacaatttgcggtcaaaattgtccttgctaatgtgttctttctttctctctctttttaatattttgacttcagcgaagggagcaatctgaccccagcacatcactacccagactttagatttaagacatacgctccattagcattccgatatttcagagaactttttggtatcaagcctgatgattacttggtaagaacctgtcatttttcttccttctatagaaatgtgtgatgtaaacatttgtctcatagcaacagcaacaagtggcttgtgtctctcattttataaagctctggggcgtagtaaaagttccaagttttataatgattataaatttagcttcaagaaatttgatgtgactttgtagcttttactgataactgcaaaatctgtggtggtaattgatatttaaataactataatatcagttgtgacttcagataattattctaacagatatgttataattagttctaaatactcctgtgaattttgctgattagattctatttgaaagcctttctatgttaattgccttatttgtaccattcctctcaactaccttggcccacaatcatttcaccttgacctacaaatttgagtaaacattgtaaagaatctggatagttttgttctcaagatctcttcaggcagactttttaaacatatttttagttggtacaagggcatattttatcctcagatttgtctgtgctcttcatctgccttctggcacacaagaggtacagacacaacagcctttttgtaagaggtagtctgatgtgacctcagagttttacctcattcctgttcaagaagccaggaactttctgttacaagtgaaaaaatggtttgtttcataatttgatcactgttaacaccctgggggctcctcagaattggtttcaaaagactgtaggaagaatgccatcaaatatttattgttcatcccattctgaatgatcttaataagacttgagccagatcctgggataatgcttttcagaggaagtatagcaacacgtgtaacaaagagtgcttaatatgcatcttataatttggataagatgtaaataattaaaagctgattctactctgtgctgatgaagactctcggatgtctcctctgaatcttcttgtaaaggaaaaaagaaaatctgtgaatgatcttctttatttggtccctaagaaaatcatatgacttctgcctaatgaagcaatactgcttcctcaaggcacatcaataagtctccaaagaatggtgagcgcaaggttgaaagtccctagcatactgctgcccttaaatgtatatattactctctttctctcaccactcccctttcattgaagcctcaggtgcctctacccatcactaccaatgcaagtacacaagcacacgcatttgttctgtgtgtgtgtgtgtgtgtgtgtgtgtgtgtgtgtgtgtgttagagaacaccctttggtttctagccattctgtaattactgagggttgccatcattcaggaaatatatttgagaaacccaatggggttttgatattatattatggaaaacaagatctcttatcttctgccacacactcaaatttaatggattctctttctgaatttccttgaacttctcaccagctgaagagatgccttagacttgcgtttcacactgttgatccagtcaatatgaccagatggatgcctgtctttagccctcccatatccattgccccaaaggctggaagtccattctttcattcatctggacctcacaaatttgctttctttggggaagatccttttctgaacaacttcccacacagcctccccaagtttcctaatgagtctttaagctggaaaaattattttcataatgtggttagagtatttacaaaggagcataagaatctaagctcatcacttctcacaagaaaagtctttgtccctgtacctagcaaaaggtaaattaatcaatcagtggacactttgaacaccaattatatctaaaatgctttgctcatagttgtagggaaattcaaaaaactgcaagtcatgacacacaaagaacttaaaatcaaactggaatactaatttgtctatgtagaaaaccaatcaactctaccaggcaataaatgtaaaaactgaagcaaaacatgaaatactctagggttgaggtaggggtctttctctttgttggggtgatgattaggaggtcttcttatgagcatgatgtggttttaaccatgccttaaaaactacgagggattttaaaaggtagaaaagagatggatgctcagggggtgaagggttggaaggggcactgtagaatcagagatgtggatgtgttcagttttcgaaaggacatttagtggaccaatatggctggaggggagagtttttatcaggaacattattaacattattaagagataggtccaggcaactcaaataaacaagcttctaaattataggaaactaaggaaatataaagattgacaagatatttgatggtgttgagaaataacttttttgtgggataataatatcatggttctattttaaaaggagaatccttgtcttttagaagatatactgaaatatctatggatgaaatggtttgatatctgggatgtacttcaatagtatctgaggagttggtcaaagcatacaaaatgtgaattagacagccaggcacggtggctcatgcctgtaatcccagcacctcaggaggccgaggtgggaagatcacttgaggtcaggagtttgagaccagcctagccaacatggtgaaaccccgtctctactaaaaatacaaaaattagatgggcgtggtggcacatgcctgtaatcccagctactcgggaggctgaggcaggagaatcacttgaacctggaaggcagaggttgcagtgagccaagttcggacctctgtactccagcctgggtgacagagcaagactccatctcaaaaaaataaaaataaaaataaataaaaaacaaaatttgaattagagaggaggaataaatacaggagatctattctacatggtgactataggtaataataatatatacttgaaaattgctaagagagtagattttaaagataaatgcttgaggtgatggatatcccaattactcttatttgatcattacacattgtgtataggtatcaaaatatcacatgtacctctaaaatatgtataactattatatatcatttttttaaaaaagaaaaagttcccaccacaaataaagtgatgaatatgtgaggtaaataatatgttaattagcttaattgagccattccacaatgtatacatgtatcaaaacatcatgttgtataccataaaagtatacaattttatttatcaattcaaaaattaatcggaaggattgtgtactctaaacgggtgaattgaatgctatctgacttacatctcactataactgttaaattgaatgcccccctacaaaaagaaaaatctgagggaagtagggcagcagagtggttggaggtctagaagaaacaagattggccatgagttgatcattgattgatcatgaatgagttgtccatgagttgacgctggaagatagatacatgagtgttaatttcacaattcttttcgcttttatgtacgtaaatataacttaaaaggtagagagaggccaactgtggtggctcacgcctgtaatcccagcacttagggaggccaaggtgggtggatcacctgaggtcaggagttcaagaccagcctggccaacatggcaaaatcccgtctctaccaaaaatacaaaaacgttagctgggcacggtggcatgagcctgtagtcccagctacttggtaggctgaggcaggagaatcacttgtaccccggaggcaaaggttgcagtgagttaagattgtaccactgcactccagcctgggcggcagagcaagactgcatctgaaacacacacacacacacacacacacacacacacgcatacacacacacacacacacacacacgcatacacacacacacacacaaaatagagggaaagatagagccaggtatgtaagtgtgcttttgtttgattccatttgtccacctccctcattcaccacacacatggttcagtgtctagacacatctctggggcttgcaagaaacagaacaaaggcagtggccttagctaaacataactacctggtccccaacagctgctgccacccacctgtgcctgcactggggacacctgcagcacaggactgaggcagctccccaacaaactttggagtctctggaagctcacctccaaaccgctctatctgggactgcacctaatgatctggagtgtgatagatgaggaaagggtcgtttgcatgacacagcatgcttgagtgtcaggtataataaccttcagcgactttttagctcaatccttcattttacagatgaggaatctgaagctgggatcagcaaagggagatgcccaaggttacacacattggtgggggcagagcctagaccaaacagtggtctccccatccttccccaagagcttgaagacccttcaccagctggcctcatgctttccatatttgatgagaatcacagacctcttaccaaatatgtactcaaactagcctcttcctagcccattgacctgtgattgtccattctgaagaatacagctgaaagaagtcaaacacctttaacaaaacacattgtggaagagtttagctaaaggaaagcacagaaataggaaataagacattgcttgaaaaaccctgtgaagaaacaaaggatacagtgccaatcacaaagtgcatcgtggtggctgtcaaactggggctactcaaacccacacttgtaagatacagtgagttaagttggaggtgtgggaacaatctctagccattggtaactccatacttaggtgtgatattgaatacctgcgatatgtgtgtatttctacttagctttttgctgttgcatctggattcctgcctgaattactctgtttatgccctccatcccattaaaattcaccctgtgcatgctgattacaagtttcatgttgaaacatgcataatttggattgtgagacagtatggtgaaggggcttctgtacatacagcagtgcaaactttccttcttccttattcctagacaaacacctcccaaggcaaagccaaagggccccagagcattcccatctctgcttgggcaaccagctatgggttctttccttctccatcatgtgcctggatattcaaaaatccagtagaacttatatgagtcttttcaggctcacctgcgccaataagaaagagagcagagtgaatatttcatactatcgggggaagaaatggcacataaaattatctccaccacatggggcaagtttacattgttaatttacactggcagggcccagctgggttgtgctctgctttttctttttctccagtgaatatagcagggagaccctgcaggaaatagaagcaagagcatgaatacattagaacagcttgcacagatgacaagtgcctggaaggtgcataaaacccaggagcacacatgggggcttttgatcatgactaattaaaatgttcccatctctcctcttcatttgctcttaagaggcaatgttgcaaagaaggtggcttagaagagaatgtggtaaccaagttgtagagtgagaaaccatagaattctacagcataatggtgatactcctgttcagtatcataatcacagtttattgcacattgatgctagtctatgaatagcccccaaagggttattaaagtggatcaaaacaatttattatttcattcgtgttatgtataaatgacataataaaagaatatttgacaatgtagtaaccaatgaaatagtcttcatattatgtcactgcatttttttttaatgtcactgcttatagaagaattggagactttaattgggagcagatgttcaggtctgaatccagttttttctagacacctctttccggatcaccccctaatttctcaatttgcaacctctaatttctgcatcctttgttgttttcatattttcacaacataaactcctacccataaggaagttctgtgtcaggaattcaaatgccatggaacaaagaatccaaattcctaaagagagtctagggtctgcctttactttttatgagagcttggagtccacacctttatattccagggtcccaaattcgtgagtaaatgagaaacccaacattttcttgcttcactcagaatgttttagtgtctctttggatcaccctgaagtcatgggcagtaggctgagaacctcagtgtatcctagggtggtatcagctcttccttacctgcctgtggaatgagtatattgtaggccgtgtgcttctctcacctgtgtgtgatcatgtcataaaattaacaacagcaatacatggtcactctttgccagggttttcaaaagcattcactttaaaaacttccagtgactttccagtagatattattacctttattttagaaatgaaacttctaaaactccaagatgctaaattccttactcagaatcacataactagcaactgatacaaatctcacgcccttttcacaaatcgctcttccacaaggacactttgtctgcacacatggctgggcaagtgctctctgattcctctcggtttttatggtgtcctgtctgcagtctgatagctatttttgttttcctaacttatcctcaactcatctgtaggcttaggctctaatgctgtttagcaagagattgtcaagaagcaaggctaacagaaagaaggggaagtggacgatcaaagttgccaatgacttaggaagccagcagacacttgcttctttcttttctgggataattttgtttcctttatcctcagtattttcaaagcaaaataatgtaaaagatgtatctagaagctaccttttaatcatgtttctgctagtttctctctccctcctctccctttttctttcagtctccctcctttcaggtttttctatgatagggacttaaatattcacaagctcagaacaaaaattgtgggatttttagccttgatgttttttcagatgcctacatcctcaagatatggctgtttatattacagagctgtagtatcaaaacagcatggtactagtataaaaacagacacattgaccaaataggatagagagcccagaaataaacacacacacacacacacacacacaccctatagtcaatagacttttgacagaagtggcaaccacacacaatggggaaaggatagtctctttaagaaatgatgttgggaaaactggccatccatattcagaagaatgaaattggacccttacctcacatcataaacaagaatcatctcaaaatggattaaagtcttaaatggaaggccagaaactgtaaaactactagaagaacacataggggaaaattgcgcagtattgatttaggcagtgatttcctgaatgcaaccccaaaagcacaggcaaaaaagtaaaaatagatcaaaagggttgcatcaaactaaaaagcttctgcactacaaaggaaacaacagagtgaagagacaatctacagattgggtaaaaatatttgcaaataacgcatcaggtaaagggttgatatccaaaataaataaggaactcaaactactcaataacaagaaaactaataaccctatttaaaaatgagcaaaggacctaactatacattcctcaaaaaaaaaaaaaaaaagatacacaggccaagcatggtggctcacccctgtagtcccagcactttggaaggctgtagcaggtggattgcttagcccagaagtttgagactaggctgggcaacatggcaaaaacccatctctacaaaaacacaaaaaaattattcgggcatggtggcacgttcctgtggtcccagctactcaggaggctgaggtgagaggatcaccagagcctggggaggtcgaggctacaataagctgtgatcagcccactgcactttagcctgggtggcagagcaggaccttgtctttaaaaaaaaaaaaaaaaaagacatacagatggccagtagatacattaaaaaatggtcaacattcttaatcatgagagaaaaccacaatgaaatatcacctcatacctgttagaatggctgttatcaaaaaagataaaagataacaagtgtttggtgaggatgtggagcaaagggaactcttgtatactgttggtgggaatgtaaattcatacaaccattttggaaaacagtagggaggttcctcaaatagctaaaaatagagctaccatatgatccaacaaccccaccactgggtatctatccaaagcaacggaaatcagtatggcgaagagatgtctgcactcccatgtccactgcagcattattcaaaatgggaaagatggaagcaacataaatgcccatcaaaggacaaatggatttttttaatgtgatgtatatacacaatggaatactgttcagcctttaaaaacaacaaaattctgtcatttagaacagcatggatgatcatagagaacaatgtgctaactgaaaggagccaggcacagaaagataaatatcacatgatctcacttacttgtggaatctagaaaaatcgaactcattgaagtagaggagaatgatgattactagaggctgaggtggtagtgggtggatagagaatagggaaaatgttggcgaatggatatgaagtctgctggatggaacaaatcagctctggtgatccattgtacagcgaggtgaacacagttaatgtatatctttctaaattaatttaaaaagtggattttaaatattctcaccacaaggaagtgtgtatggtgatggatatgttagccatcctgatttgttagccattctacaatgtattcatgatcaaaacatcacatacccaatacatatatacaattattatatctcatagaaaaacaaatactgcatgttctcacttctaagtgggagctaagctatgggtatgcaaaggcatgcagagtggtataatggacattgaagacttagaagagggagggtgggcaggggatggggaatgacaaactgcctattgggtacaatgtccactactcaggtgatgggtgcattaaaatcccaggctccaccactatacaattaatccatgtaatcagaaaccacttgtacccctaaagctattgaaataaaaaaactaaaattaaacaaatcattatttgtcgatcgaaaatttaaaaatagaaaaatttggccaggtgcggtggctcacgcctgtaatcccagcactttgggagggcgaggccggcggatcatgaggtcaggagatcgagaccatcctagctaatgcggtgaaaccccatctctactaaaaatacaaaaaattagctgggcatgtagtgggcgcctgtatcccagctactcgggaggctgaggcaggagaagggtgtgaacccgggaggcggagcttgcagtgagccgagattgtaccactgcactccagcctgggtgtcagagcgagactccgtctgaaaaaaaaaaaagaaaaatttaaagatgatgtggttctttaagcccctgcttctgctaggctgggtctgtctcacacctgcatggcctccttatctttttctctgccacccagtgtttctctagtcaattatgtagcttattaattaataaacactgagcttaataaaaccaaaaacagacttctttgctggttttagcattttttggtgacatttacagccatacaattattggtggagttcagccatctgacggaaatttcttgagtaccaaccatgtatgtaggcacctaccatgttccaaggcacaggtcctggaactgtatcacagtgtaagatagtcacagtttctgctgcaccgagttttacagtctctgcaactcgaggaaaaggaaacaggcaattgcaggattttgtggtgacttctgtgatgagaacatccagggccaggaagcaattgatcttttatccgcggaaccaggaagagttttccagagcaagtgctgcctcagcaggcactgaaagctgaagctgtggcaacagtctatgaattatgctccctacatcttccccttgtccttctacggtggtttcctaacccaacagagtggtcctctgctccagaccctccaatggcttttcggcccccttagagaaaacaacaaagtccttccagtggcctatagcactggatgtggtctgtccccttgacctctctggctccatccctttcagggctcctccttgccctctctgctacagccactggcctctgctgtgccttgagcccaccacatctcaggcctttgcattttctcttccctctgcctgaagtgcccgttccccagatagccatgtggcttgctgcctggtctcaacctctgctccaatgtcacctttgcaaggaggccttcagtgaccaccctatttagaatttactgcaactcattcctcactctttgctggtattctctgctgctttttccatgatccatttttttctccactgcacttaccactttctgatgtgtaatgtatttacttgtttactgtctgtttcctcctactgggatataaactttatgagtgcctgggacatagcagatgctcaatagttattttttaaatacagcaatgagtggtaggcaggtgaaagtagaagggaggttgtcgcaggcacaggaaaacacaaaagcctggctgttgagagtatgcagcacttttaagaacatgagaagttagtctctgtggctagagctaaagttgaaggaggaagtcatgagagagaaggctggggaggaggctgggtcattcatggccttggaagctctgttaagaaccattgatttttagatctcacaaataagtgagaacatgcaatgtttgtctttctgcaaaagatgtgaaagcccagaaaaacatgaagagatttgcattttagaaagatgcctagtttcctggtgaatgtactagaggggatgagagtggacaattaagaccagaagcttgccataacaatccaggcatgaaatgatgaaacctttgaactaagggtgttggcagaggcgggcaggcagcatcaacagtctggttaggaaagatgaggaaatgtgaggaatcaaggatgatgccctagtttctggtttggggaataaggcaaataatgcttccattctctaagggaaaaggcagagaacagggggcagatgatctagggtcaccatatgcagttgtgcaggctgtgcactgctcaagctctcctacctggccgaggggaaggagtggagactggaatccagccttttttttttttttttttgagcagagtctcgctctgtcgcccaggctggagtgcaatggtgtgatcttgactcactgcaacctccacctcccaggttcaagcaattcttctgcctcagcctcccgagtagccgggactacaggcacgtgccaccacgcccggccaattttttgtattttttgtagagacaggatttcaccatgttagccaggatggtctcgatctcctgacctcgtcatccacccgcctcagcctcccaaagtgctggaattacaggcgtgagccaccacgcctggccccagcctttcttctactcaccaactttgtatcctagcccagagctgcatctaccaagataaaaagttgcatctttctaattaccacaaaggcaccatgtgggctaaccacagccttgagatgaacttgattgtgaacttattgcatataaattgtgtgtggtataaccaaaatagaaatgtctattaaagtgttagatgaacaggtcttgagccctagcgaaagatctgggctagagatacagatgttgaagtcatctccttgttgaaaccatgagtagatgacatcttctgggaaaatcatgaaaagagaatagggttggtgttcaagtgataaaacacagtgcagttcacatcttcacttgttattttatggacatttgctggaaacaaagcaccttagtcaacacaactgtttgaattatctcattggactgataggatgattcatgattctatcgcatgactctgggggttaggagtgtatgtctgtttttcatcatagaattattaagataaacagaccaattaaatctttagaaatctcaaaaagagccttctcggtatacgtggagcctcttttaaagcccgtagagaggcttcttgtttcaacatagctaagatgtgcaatgctatgattgtcctccttggaggcatcacgtacatcaagtatatgttttaatgtttattcatttacccttttagtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatggtaaggaactgcacatcattaatgcttctacttgaagtttaattactttcctcaacagtttttttctgttgtttttttcagtgactcaggcatgtttctttctctttggtaagctttattctgcatttaaattatgctatgacattcattgaatagattttttaaagtaaactagaactgaatggcagagcatacttgttgaatcccacaatcctgagttcaaatcccagctcagccaataattaactgtgtgaccctgagtaagcagcataactggtcagccttagttccctcagtctttaaaggctgagaaatacgtggccaggcgtggtggctcacgcctgtaatcccagcactttgggaggccgaggcaggcagatcacaaggtcaggagattaagaccatcctggctaacacagtgaaaccccgtctctactaaaaatacaaaaaaattagccaggcgtggtggtgggcgcctgtagtcctagctactcaggaggctgaggcaggagaatggcatgaacccgggaggcggagcttgcagtgaatcgagatcccgccactgcactccagcctgggcgacagagcgagactccttctcaaaaaaaaaaaaaaaaaaaagctgggaaatacttatcttacatagttgttgtgataaagtaaggatacaggatataaaataaaggaaagataaaggaagcaatgtgtttcaaagctctttgcagccagtacgcagtaatagtataaatggttaactttcatggattgcttactacatgttaagcaaggccttaagtgctttgcattcattaactcatttaatcctcacagcaaccttggatactacaattatcacctttttatagaagaggtaattgaggcaaagataaattaagtaacttgccatgggtgattcagctggagagctgcagagctggggctacgcaagcaaaagggctccagagaatgcatttttaacccctacactaatacaccggaacatattctatattagctgttctcagctactagacttcagaatttagaatttcatgggtaaatgtgatagtgtgaaaaatcacctttcatgtaatattttagagacaaaggaacagtaacttagcctagacggatttactacacgtttactccaaaattttcaaaactatccccactgttcctaaatagtccaggcattttcatacctccagtttcattgtactttgataacagttcttaattttctatgattggaagggctacatgaagctgtctggatttcagaagcccaagttctgccaatcacttgctatgagtggtgataaatatcatctttgtttttaaaaatgcattcatcagatgccatgttatctttttatgtaaaaatattattttaattccaaaatctgctagacacagcattaaatacttaaattaatctcatatagaagtataaaaataaaaaatctcaataaaaatcttagtggcatgcaggcagattttaaaatatttcaatactgagcaattatttttttttggaggaacagaaaatatagaaaagccaaaaaaaaaaaaactaactatagtttctttcccagagatacatattactaaaatatggtgtatatgctttcagttattctttgttcatgcacacattttaaaattatctaaaattaggatcaaattgatataatattatttgataacctgcttaattagtaaatcttaaaattccatagttctgagctcagatatacttgtcctcttgtaaaactgcattggccatatttgactacttatatttaattaaaattagataaaaagttaagggccaggaatggtggctcacacctgtaatcccagcactttgggaggccaaggtgggtggatcacttgagcccaggtgttcaagtccagcctgggcaacatggtgaaaccccatctctacaaaaaaataaaaaattatccaggcatggtggcacgcacctgtggtcccagctacttgggaggctgagaagtgggaggatcacttgagcctggaaggttgaggctgcagtgaactatgatcaagccactgtactccagcctgggagacagagcaaaaccctgtatcaaagaaaaattaaatttagctgaacaagtgattttatcccaattatgtaagctagtataacaatataatccaccccattaacaagaaaaaatgtgaacgtcacgtggttacccaaatagatgttgaggagaagctaaggccctcaaaattcaacatcttcacttaattaaaattctaaaaattggcaggggagtttttttttttttaaaaaatgataaataaatcaatgattatacaagttgtacatttatcagtcttccaaaagttcacatgatagctcatggaaaaatacaagaatcctttctctagaaacaataggaatagaccagagtgcccctcccatcaatagtcctttctgataaatttgctagaaattctggcactgagtcttgagtacaaaaagaaatagaaaaaagtacaagcactgttctctttaaatgacagaattcaaaatgagcaaaccttcattttgctcatgaaagtaaatcaggaatttttagaagtgatatgactccagcagatttgcaggataaaaggtaaatctacaaaatccattatattccattatatagatgatatagagtgggagaatataagggaaaaaagagatcctgttcatgatgacaacaacttataatgaaccctattagaaaaataagtaaataaagtcatgtgagtactgtaattctgattgggaaagcaagatatagtaagtggaaaacataaacaatcagttcagaaagaatgtaataagaaaaattctaaaatacttgaatctataaaaacaaatgttacaagaccaatatgaaggaaactacaaaacgttattgaaggacataaagaagatctgaaataatgaagaaatctgcattgttcctgaactcagtattgtaaagatttcaactgctcccaaatcaacttataaatccagtctaattccaagcaaaaattctaataggatttttcacatagcttgacaaagccaatttctttgaaagtgagagcaagtctcatttgaagaatgttttttaaaatgaacaatcacacagaaagattgtaagaatggagaaaacatttttgaaaaagaagaaaaatagtaggcctgctatagcatatacaaaaaatatataaggctgtaactaatgttaaggatgtaggatgagtacagttttagacagataaattaatggattcaaataaagtgtccagaaatagatctatgtgaatttgtctacttactgtattgacatggagggatttaaactcaattggaaaatgtcagactgttcaataagtatccatttgaggaaaaaattaaattctctatttcagatctttcacatacacacaaaattaattccatatggagtaaagaccaaatgtaatgaccaaaactattaaaaatttggaagaaaataaaagtttatgactttgggatataaaaaagctttgttaaacaaaaagcaaaaagcaaacacacacacacacaaataagaaacaagtaaataaacatgaccacatcaaaaggcaacacatttaggccaagtgcagtggctcatgcctgtaatcccagcactttgggaggccaaggcaggaggatcacttgaggtcaggagttcgagaccagcctggccgacatatagtgaaaccctgtctctactaagaatacaaaaattatctgggtgtggcggcacacacctgtagtcccagctacttgggaagctgaggaaggggaatcacttgaacctgggaggcggaggttgcagtgagccaagatcatgccactgcactccagtctgggtgacagagtaagactccgtctctcaaaaaattaaaaaaaaaaatttaaggcaacacatttatataaccaaaaataccagacacaaaattaatataagcaccttgaatatttctggaatgaaataaagtgagagcagtggttttctcaaatgttgagaattgggggaagaatcaaggatagcagagacacttttcattgactacatgccgttttgtaaactattttaatttcttatctactttaaaagggaacaaaagtaggcatgtattccctattttttttcttttttttttttttttttgagacagagtctcgctctgtcaccccggctggagtgcagtggcatgatctcggcttagtgcaacctctgcctgccgggttaaagcaattctcctgcctcagcctcccgagtagctgggattacaggcatgcgccaccaggccaggctaattttttaatttttagtagagacagggtttcaccatgctagccaggctggtctcgaactcctgacctcgtgatccacccgccttggcctcccaaagtgctgggattacaggcgtgagccacagtgcccagcctccctgtttttttaaataataaaaaagacaacagactagaagaaactaccccatatagatgagagaaatgataaatatccagagtatatcaagaatttcaacagtgacaaaaacctgcagaaaaaaatgagcaaaattatctttaaggtgactaaaaatacataagtaatcaatggcattcaaatttttaaaaacaggtttctatttttcactaatcatgcttacaaagattttaaagtttgggtactattcagccctggtaagagtaatgggaaaatctatgtacagtcttacatagtgtggttgtaaattggtctgccattttggaagacagttttgcaggagctattaaaattttaaatgttcatccctcataccttggcaattcgttttctctttggctaccttagagaatagtcactcatggcaccagtcaattccttgcctgtttttagttggagccaatttgggacattatgtccaatccagtcactttcactgccctgagtttagaataataaaattgctgtccagtaagcagacttaagaaatagattagaaacagcaaaattttagtaatgaacattaataaagataatcacatcccatttttaattattatatcagcatgaaaacacatctttagtggagcattattttgtcaaaatagaagattgtaaatatatttttctttttttggtttctagaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtaaggaagtttgattgttgtgatttcctttgaactctgtgctcatgtaaactgtggctgccacttattgaaagcatagaaataaggaatgtccaaagtggcagacatgtggaatcctatctttcccaatcctggcgctgagccatgcttccctgatattgaaggaattggtagatgataagggagttatctagagtccttaacctacatctctgttgattttactaataagctaagtcagctttctttgataaaatgaaacaagaaagctttgttttcttttctttctccgctgtggggaagatagtttaactagaaagaaatagaatttaggtttaatgtggtgttgagtaagaaaagccgtatagaaatcttggaagaagtaagactcgaactggggagacaagtttaaagaaaatgtacttgggattaataatggctccctagagatcagtgtggatgcaaaactatgatatgagcagcacgtttgctgaaattattttatgtggtctgaataagaggtgagcaggaatgaagcttgccaattagggcagacaccattccatgcaaacttagctggagtgattgtccaaagtggggaggaattcccccaggctgcaatgctttaaaaaaaaaaaaaaaaaaaaaactaagggaagattttttctaacatggtgaaaagagataaaaatttttttagagaaaagaaaaatgcagtgctaataacttctgaaggataataatcatgggagaaccgtccagccacttggctaagttgggtagtggaggtgggcagaaagcatgatggcacaggctgtggttttctgcactttccatgggcctggacggatgacccatgttgttataggggaggggagacacttctctgccagacccaaactcacgtgaaggtgaggaagacagtctgacaccccttctaaggtataaagtagggaatttccactaaggaacacaggtctactgtttctgttttttttttttttatttcttcctttctgcctgttatagcttgcatgattgtgcacaaaaatgtgtccttagaattgtttttctttattgacagagatgttactcctattgtttagctaccgtttattgaatgcttacagtatgccaggttagtctaaggtttttttaatgcatcatttcacttaattctctcagcaattctttggagtcagtactattcatacttccattttaattgctgaagaattgggttcttaaagagattcagaaacttatccagcattacttaccaagtcaatgacagagcccacatctgtttgggtacaaaggcatgtgcttctaacaactaaaacttaaagtctcactctgaggatttttttttaattatcttttcagaagtcagggaaggagcagtaggaaccaagcaaacagacgaacaaaaaacgtccagcagatattcagatatctgagtggatttgagtgatgcatgtttttctattcaaaaaacgtaaaaacagaacacacatattttagtagaaatctttttcctgtgttttttctgccctttacaggatgtgggtaaaaagtgactctcaattccccagagtttagtgtcagcctctccagttttaagtttgctttctcttttgtgtgcttcttgcctctttagtatggaaagcctttatctgctgccttctaataccacatgcttctctgccagaaaaaaaaaaaaaagcaaatgtaaaagagccattgctcaggatttgtctatttattagtgtttcctgagctcaggactgagaccgcgaggtcaaaccaaacttttcatcacaagtgagaccctggagatttgcctttttattttttattctttggcaggtttgttgttctaaggaacataaaggtcaaggtagaggtatcctgaggctaactccctcttactcactgcatttgcagttgtacaagacacagatcctggacattcttcaaaatatgtacatctgccttcagaaaggcttctcttgggctggtatgggagtgtgtaaatgctgagctgtaggggaactcagctcccttccctgatctgtcctgaccatgaccaagtcctctgggatctggattcaacagctggtgctctgagcagagctgcctcaaggaaagcctatttctggaatggtgaatattaatatttaatagtcaagggcctcttagtaaatcgtatgaatgctgtgaactctcctccccccaaaaaatgcccatcctcgtgatggatcgtgaatctcttggagcccgttgttccttcccttccttcttccccaaggctcagaatccccttcctagagttacctctctctctcttcaggtcatcctctgaaaggccaactcactggatgattgcaataggatatgtggttgacatcgccccaatattgcccttgctttgcagagctgagcctcagtgctggctgaggggctgcagagacccagagggtctgcaaggttagtctgagctgaggccagcacctatcaatcaggaatctcctctgctaaaattcctgtgagacagtatggctaaggctctagaaacaaaccagttagagaaatgtattactgtatcagcaccccaggcagagaaaggtgaactaaacctatattaggatatatgcttctattcacttatcagcacatattgcaagcacactacatgccaagcatgaggtgcacgacctttattttttatcaattgccatacagtctagtatgtgcaatgatattatattgtgaagattagagtagggaacattgtagcttgcttttaaaggatgagaagctttctccggataggcaaagcagtagaagcatatttctaggataagagaacaataggtatgaaacaatgggtgtgaaatagcacaatgtgttccgggagctatagttgtttggttttggggcagttaatagggagagcatgtggggtagaagaggaaagtggccacataatatgagagccacatattgtcagaagaccctttctggtggtgccagggagctcttaaggacttagcagtagcaaatccaagaatcccagacctttggaccccagcttctttgttgttcccagacggatttgttaagcctcttaacctatggctgacctccccctgcttcttggcgcccccacctctcctttcatattttggcttgacatctcagaccctggaattctatttcctttagcatgagtgctggccggaagggccagcttgacctagcttattccctgctccccatggactgcttccctgactgccaatcagagctgccgtttctgagctctgcgtctgaaaagacctgaacagcctcatcctgcactgagtcctcctgacacataccatcttctcctggcatccttgtggcagcccctgagtccctttgcctggcttccccaagcccagtcccagacccctgtgtataataagcctgccctttgggatggttcattcctgaccaactcctccatgtagcacattggccacttggaactattctagaaaactgatcttcttttatgcctcaaccctgctgagcccaattcccccacaggatcagagggctctttccaaaagcaggcatccagatgtcaggttctgcaccccatctccacattgctattccccattggctgtgtgtggtgggggagaaatggatatgtaaatgatgagtcccctttcttgaaggctttcctatcccttggtctgaccctctatatgctcactgccacagccatccatacccacaagttaatttgagccaaggaaagagtggtgacattgagtactacaaagacatcacagatcacttgctatcaaaaccagaaagcaggatttattcaaaccatccccaatggctcccacgtgacagacaagctgagatgcgtgtcctatttgaaaactgctcatcccaggtaccccttcatcttccgccaggcctgcacctcttctagtcttctgtgacccagggaacatgaccatcgtgcagccagatacccagatctgcaccctgaagctactccttcctccctcctctccctctttccctgcatgcagtaaaatcaccatgtcccagtctgcctaccaaataactcatggctctgccccctcctcactgtaggcacagccactgcttttattgagaccgtggttattcatcacctggagttttgctgtagcctctttgctggttttcattatcattgccttccatcacatccccaccactgctgccagactgatcctctgatcagaagacttaacactctctggccaaggttccccactgcttttgggcgaaagccagtgattcccagcttggaacattaatatccttcctgatctggtccctgctacattctccagatgcgttcttcagcttctgtctccagccttctctctcccctctcctctgatacagatccccactctccagctcttctaatctactggccacattctctaaaggttttggtttttttatgcatgcctcactctgctggaccgttcttcccctcttctacacctggccctcacctgctcgtctcaggactactcagggatcagttcctccaagaccgtgctgttgtggttccccatgcatcctgggcttacttctttcatgggacttaatacactgttactttttcacatgtaaatcctggagcctgaggagcaaggcttaatctatctttatatctacatgcctggttcttagtaggtacttagtaagtgtttattggaatatgtatttgaacagaggaataatcagctgtctaatgatttaaaaaaagagaaagaaaggtttaggtaagaaacctgtctttggtgatttttgtgtatctagctattttttaagttctgcctattttggaggaagtatccagtttcactgcaatgcctgccaaaaattgcactgagaatttaataaagtagattatctccattttgaatcacttgggattatttgaaaagttgtactggttgtcctcctatcaagagtcatttgtgtaacaaaagtacatttatattgcagtgagttttcccatggaagcaatgttgtaaatggtcattagactttttttctttccaacttttattttaagttcaggggtacatgagcagatttgttacatgggtaaattgtcatgagggtttgctgtacagattatttcatcactcaggtaataagcatagtacctaataggtaaattttccatctttctaccctcctcctcccgccctccaccctcaagtaggcccttgtgtctgtcattttctactttatgttcacatgtgctcaatgtgcaactcccatttagaagtaagaacatgcaatatttggttttctgttactaggttaattcacttagaataatggtcttcacctccatccatgttgctgcaaaggacatgatttcattctttttatggctacatagtattctgtgttgcgtatgtaccatattttcattatccagtccactgttgatgggcatctaggttgattctatgtctttgctattgtgaatatggactttattttattagcactgacccctgtcttctttaggtgtatgtactgtctctccagcgagactttaaatgtctcaaagggcaaagctcattctttacacctctctgcagctgcagcacctggcttattctatacactcagtacatgttgcaagattgtgattgaaaactcttttgaattgaaaatgtatatattaattttaaaagaacaattaggatctatttttgtattcattgtaatttaccatgattattttttctctgatataagttatctatgtaaaatctagaatcccatatcatttaattaatttgataaatttttatatgctgaaatatttattaataactctgggaaatgactttgagacaaagtatattagtgagaacttgtgtttacaacccaaatatttttaatccttcaagtgagagtcatttcagagacagtcttgataattaatgacctaatgacttattttacatttattataatttttgttgagccgcatgttattaatttttaaagagtgtggaaccaattttcttttttcacacaaatgactgtaaccataaatattaataggttctcagaatttaatgaaaccagtctcaagaatactgaaactttctgatgtgcaaagaagggtctttctatgtaaggcaagttctgaatttatgaatcagattcttaacagctatgggcatgtttgcatgggttacaaaatgggttattttatataatatttaacattatggctattgcttaccattcagctataattttgctggtagtaaactttttacattttgttcagacagtttattttctttttttgatattgcttgccttctcagttatcactggggaagaaaaaatgctttagacctaatacaaaggagacgtacatatcctgaaggtagaaatacttcaatttaaattatcctctcatcaataaggaattcgattttgtttttagacttcaatcaaaacatgaaaagggtgcagggacatcattgactccacactcctaaattacttgttttgtttttgtttttgttttttgaaatgaagtctcactctgctgcccaggctatagtgtagtgcataatctcggctcactgcaacctctgcctcccaggctcaagggattctcctgcctcagccttccaagtagctgggactaccggtgtggaccaccacaccccgctagtttttatatttttagtagagataaggtttcaccatgttggccaggctggtctcgaactcctgatctcaaatgatcctcctgcctcagcctcctaaagtgctgggattacaggtgtgaagcaccatgcccagccaaatccactgtctttcaaagtgtgttttacaaacactgtaaacccatgagatatttgatttgctccattgtcttaaaattatgagttttggctatctgtaatagtttgatatcatagcagtataagcataaagcaaagttaaagttggtgaacaaataaaaccaactcatagaatcaaagattgttcgagttggaaggaatcctaagagttcctaagaaacagtaaaagaatgccttctactctctggtcttagaaaaaatgattttggacttacctagccaagccaggttttattgtgagaacagaaataatgatgtcatatcatatatgcaagggctttgtaaatttttctacctgtaaatttttttactttgtattttgagataatagattcacatgccgttggaagcaataacacagagagatatcatacacccttcactcagtttcccccagtggtaatatcttgcacaatcttgcacaaccttagtacagtatcacaatgaggaaattgactttggtacaacctactgacgtttttcagcttttttcagatttcaccagttttacatgcacatgtgtggtgggggaggttctgtgcaatttcagacgtacatagatttatataaccaccaccttggtcaagtacagaacagttctttctcaaagatgcctaatggtacccttttatagccacagctacctccttccctcacaactcttcctaatcctgtgcaattaccaatctgttttccatctctgtaattttatcttttcgagaatgctgtataaatggaatcatacagtatataacccctgagattggcttttttttactcagcataatgccattgatattcatccaattattgcctgtatcagtaatgtgctcctttttattgctgagtgatatttcttggtatggatgtatcacagtttataacattcacccgctgatgaacatgtgggttttttctagtttttgagtgttacaaataaagctgctgtgaacatttgtatactggcttttgcgtgagcacaggttttcatttctctgagataaatgcctgaattcaatttctatgtcatatggtaagtgcgtgttgaattttttaagaaactgccatactcttttccagagtggttgcaccattttacatttccaccagcagtggatgaatgatccatttttctccttttcctcactagcatctgctgttgtcactattttttattttagccactctggtaagtgtgtatttaagtctcttgctaaaaaattacttgagtatatgccccagaaaagctaaagataaatctaataaagcagtttggggatatagaaaagagtggtgaaaagaaagcggaaaaactcagtggttaagtttagtgcctggtgatatgcctgtgagactatgcaactgacaagattcctaagaaaaggcctgcgatacaggagtttaacgtgtgtgtttctaataataagcactcctgtgagacttcatctaaatctattctacagccattggtgttgcttcattatattgtaattacttgattacatgtttaacgtttgctactaaaaatctgctctgtgggaactgtggaacctcattttcccagtcttagctcactcgagagttcttacacagcatttctcttggtgtcaatcttctgatgaagcctaggaaatagcaacagcaaacattcttggaatagtgaatcttacctagtcaatgcacataataaaagcaggttttagtaataacctacacatggtttgtctggaaagaaccaaggtaaatcatgtcaacattgtgaatttgtggattaattgtttggagtacatttgtattgctcatttgtccaaggtctgttaaaggccagtgaattactaaattgcaactgtgttgacctcttcatcctctcagtttttatttaggtggcaactggtgtcgccattgaagaccatccatacaccacaactgttcagtagtcttgggagggggctggtgtttgtctaggcttttgccgcttgctgcagcttagttctgctgaaagtagggaatggaaatgagctgctggcagcaacagaaggaacacaataatccatgcaagatagtgtcagggtagctacaaaaatcaaaataactctatgctgttgttcatgcctgactttctactaagtaagacaattcccaaattttacagaatatgctcttctgggttttggtggagagagggttccatcttggatataacctatagataccaaagtaacttaacatgtaaaacaaatcatatgtaatatgtaatcatcaaatacgtatatacaatacaatacataatactttattgcatggacaataaggatgcatttccaaggcttactttatctgtgggttggttcaggtaacatttatttaaactttgagccagacaatctattacatataggttctctcattcatcttcacaacagccatgtgaagtgagtggtatgattaccttttgacagataaagaagtgaatcctcaggagaggttcagcttccgcaggtccacagagctcacagtgctgcatccagaatttatacccaggtctctctgactccaaacccatgttctttcatcattacactctccttaaggagcttgtgtgtaatggtggtaaggccactgaaatgaaaacattaagtaataacatggacagatataggcagcatgggctagaagtgctcaatgactggtcacctaactctgacaaggagatacaggggcagatgctgtaggagtcaggaaagggctcaatcctagtggagagcttggtttggacaggacaatgagttcatgaaatcttgcagcctatttcaaggaaggaacacagtgccaagtgactaaggaacacaaagtaaaataaataatccaaacatttaattttaaaaatttaatgaaaagcataatcaagcccattgacatttgccaactgttaccaatgtgcatgcacacgaaatcctattaagttaaaagcgaggcttccttctgagcaatgcagcggttacaggggggttgattgtttttgaaatcttgcaggggaggagattagggactcaatgtgtgacgttgaatcctgtgtgagcagcttttgagaattctgattcactacagaaacggaaggattatcaagtcagtagtttgcttttttttttttaaactctcactgcaaaccaaagtattatcaaaatttctatagaaagaatgaaaatgggagactgaaggtaatttcctcggctctaagaaataaactccttttcctttcttcctaaaagagatattacctaaagattggagagttgaagcatttcctgagtttgttgttatgtgtctagcaagttttcattttaagtaacttgtcccacagaaatttatatatgcaataattcaagttaaggagagctaaaatctttgggcttatgaaatagaacaatgttatatctactacttagagtttctggcttttttgtaaaaagaacctactggtctctgattagatgaccctaagtgtaggagtaaggtcaatataggccccaagcggaaagacccacaaagtatttgggggagggagcaaagggaaggaaatgcccccaaggacccctcttctcctccctgttgagaatcctgggagtgcagagaggaaagctatggcaggaaggggaagtggccacacggggcctgatggtagcaactctggctttgaagatgtatctggaaaggctttgaggttggctgctgtggatctggttgtggattctgacgtaagccagtcatacagatcatgatgcaaaacagggcagagttgccaacagccaatccaaaagagatgttaggggcagcaaaccctggtgatttacaaaatggaattgaggctccataccttgggaggaacttctggaagctagtgagggactgagttacagagatttaaggcatatttgagagtttccaaggtctaggaaaatattacaaagtttaaaaaatggttcagaaatgtgccttgtgatacattacccagtgcattgtgtacctgtcagacatgaccttgtcttcctcccagaagctttcaacttaggcttaaagaataaagagtaaaatcagtttgattttatagggcttaattttattcattcaacatccagggcacatttatggagtaccgatggtgctgtaggaccagggcctgcacgattaccttgtgaaaagtaaagtactttggacatccagtggttctgaacctttcagaaaagatcaccccatactggcttctgagaggtttggggccacgtatatggctcttcatccctgtcagtatcagtccacactctttacatgcccttctaccctgcaactgagtgtccctttgatatcaccagtgttcttccttcaaagacatttttcaatttagtgtttttttaaattttgagacagagtctcattctgttgcccaggctggagcttggtggcatgctcatggctcacttgcaaccttctctcctgggctcaagcgatcctcccaacttagcctcacaagtagctgggactacaagcacatgccaccacacttggctaatttttgtattttttgtagagaaaggatttcaccatgttgcctaatttggtctggaactcctgggctcaagcaatccacctgccttggcctgccaaagtgctgggattacaggtgtgagccgctgtactcggccaaatttagtgttttgatcgagcaaggataactcttctctcctcatttttgtcccttcaaatactgcatttctaagtgacaaggtagaaaatgtccgtggggggaatgtctccctccatgagaatgaaatggccaaggacaatctgttattcatgaattgatatataacattcaacttttcataaaaaggatacatctgcgaactttctacatgtatacatcagaaatgtgttttaaaagggatatgtacttcactggacagatcaattgtccatagctactcaggctacagagaagttaaaactgaacgtttatttaaaatatcttcatccagccttaatgcgagcctggctggaatgattctacatctcgttaacttcctctcttcatttctccacacaaagacctcatttgtaaactttgcccatattcagccagctccagatgttccaaggacaaaccattatcacgaccaactcagtgtttgctgcattttcataagcacttggtgatctctcttcaaatgatgacgggagttctttagacacagagattctccatcctctgatattcctcattctgaattggctatccaacttttttttctagtttgttagcaatttcagaaaaaggtctacaatcaaattttcaaagaccagaaaaagcagtgattccagattgcagatttactctctgtccactcagatgtgcggggaaaatgtagttacttaattatctatgaatccttttccctactagcatccacttcctcaaactgaaacttatcagttagtaatattgcagtctcttctggtttagacagtcacccctccagttaaatattctgtttattcaaagttgaactctctcagggtaggtgtgaactgtccctgttttatcctccattttttaggtgagcaccattggaaacatagggtccttgtcccatgtggacacacagagctgagaacattgccacaggcctctccatactcacgcattccagctctgccttaactgtcaccttcatgctaagtgtggctttcaactgtgtcatgttgagccactcttgtaccttctttagttttgatcatgtgcatatattaaaataaatatttaaaaaaatattaaaataaatattaaaaagtaaataagactccaaatgatttttttttctaatgataattctcagaacctggattttccatcacttcttttaaaactcactctgtaggtacttgctgttcttagatattgtttctcaataccgatggtgactttcccgggcctcagatttttcctgctctatgaaagcttcaacaatcctagagcatggatcagccagttttctttagccttaaacaaccacaggaatctcagttgataaattctgccttaccttcctgccgaattaattacatgttgttcagcaaacagttccgaattttctctctgtagaaggctctgtgctaagacctgtgggaggtacaaaaaatgaataggatgtagtcctttttctaagaagcttagagtttaaacactaagtctaaaccatcaaggtcttatttatcacggacagattcttccattcttcttctctttctttgtccatagagtaatatgaaaggtgaagggtaagtacttttttctttttaccaagaaaggcagtttaccagagttggtgggctgtagcagacagtggtgagggttccagaattttacctcacacatggacgtggatgtgggtgcttggaccaagtgtggcctctgagtctcacaagacagctggcctatgcctgggctctctgctgacgtaccagttaagccacaatgaagtaaatcattcatagtaaagccaacaagaagatatatcatataatgagaaggatgtgacattttaacataaaatattacttttaaacctgtttacaaaataatttatgaagacatctttatttgaagaaatgaagtgtttataaagaaaacaaaccaaattcatccagcataggaagctggtgaatatatatatatatatacatacacacacacatacacacacattatatatatacatgtatatgaaatctttttaaatgatggatggctatttttaagtgtggaaaaaaaaaaagccttggtacaggttaatccagtacagcccaagttctaaatcacggcatacacaccatgaaaaacacattattgccaaaacaaggatttaatatttatttcattctgctttgccagccaaaattgtatggcttgtcacagcctgtattttctcattatgacattagcaaagaacactgagctttactgaagaaatttaattaaattgaaaagaaagtgtttggctctaactaaactggcacaatacaaggaattctagaactgtattctgaggggtctactttgtgaggaatggcaggcccttggattcatttttccctaaaccagtattttcagaaatgtctatttgcataaaatctccaggacactattttgaattttctgacattattgaattaacaaaaatgtatttgccaatcattaactccttgttcaggaactagattctaggccaactggaaacattactcaggacccttgatacatcttcctgtcagctccacattttgttaatttggttattttgcagatcttccatcaaagattgatcaagtgagatggaacatagcaagttttctgctttaaccactttagttaagatcccaaattattaatttctgtttttttctctgccatctctagctcatcattggcaaagggtaagttaatgctaaacaggtatagacgtgcattttatctaagcatttcaaaatagcacgctaaactttaattttgaaaagtttatacaataaaaatatgtaaaagtagaccaaatattgtaatgaatccacatatactctgtgctctatttttaactcatggccaatctaggtttttttgtttgtttgtttgtttgtttaactgcctctcttcccatataatttgaaacacatccaagacatcacatcattttactcatatgtactttagtaggaatccctaaaagctaaggactctttaaaaaaaaaaaaaactacaataccattataatggattaaaaatattaataattcttactaatcatcaaatgtcagtgttcaaatttctaattgtttcagaaacaactttttgtggtttggatcaggatttaaatagaatctacttgctaagttccttgtcactctgattttttcattttgaaagtatttgttgaagatattggtttgtttatcccagagcatctggattttgctgattacaccacattgtttcatttaacacactcctctcttgtgcgttttttctgtaaatggattgtaggatcctacaggttgagtcagtcagatttaggtctgacttcatatttgatgtctcccctcatcaggaggcacatcatgtcagaatgcctttctttctgcaatgttagtacctgttgatgaccactgattagactcattcattcatcaggagtggtaaaatggggatgttctaattttattatatgtctgctagactgcacaaaggaattttaaacaaaagagtacctgtcacatagtaggtgcgcaataaaatacgtattgaatgggttaatttccataagaacccctatgacaagggagcagaggacaggaaaactaagaaggccttgagatgtgttccatcttagggccagcaccaagcgttcttggatgattaaagagccttcacagttgaccaagcctgtgacatgctgttcttgcaaaggcttcctaaagaaaaatgtgatagtcttactagactcaaagctcagcctaatttatagcaaaacaactttgccttttatctgccatttagctgtatgcctactaaacagtaaatcaaaagaatctctataaatatcagcttgatttttgcccttgacacagtgtatataaaatacctatggtgtgggtaggtttgaaagcactgtaggcttttatctttatttttctgacaacacagagcacataatcacagtaaatgtttttagtgccaaaaatttgttcatgggcattgtaatcatgatgcacaggtatcaagttcttatatttaagatacagggtgtagtgttttacattctttattgctgaatattttggttttcacttacttatacatgtggaaagcagtataacaaatattcattcctactgtgttcagagcacacagcaaaatgcactaagtcaaaccagtctttgttgagaaatgaagtcttgtgtgtatgatacaaagaatataggtgtaacctgaggtagaattttatatgacagagggacactaataatgtgcttgggtcttcagaggggagacatatcccaatagtttgttgaaatcattagtaaatttgcatggagtggggacaggctttgaaaaaacagtaggatttgaaaagatggtaaggaccatctagaagaaacgacatgagcagaagcatcagagtttacatcttcagagcacattcaggggtaaagagctccagttagactagcctggcaaatgtctctagccaggcattaagtaacaaaaagacattggctagggccatattagtgaggactttctatgtcaaattgaagcactggcaccaagcagtggtgagagactgaaggctttgagtagggatgtgatgtgacctggtcaagcacagatgtcaggaatgggtttgtgaggaaagaatgggaaactgggccaggcatggtggctcacgcctgtaatcccagcactttgggaggctgaggtaggtggatcacttgaggtcaggagttcgagaccagcctgaccaacatggagaaaccttgtctctattaaaaatacaaaattaactggtcatggcggcacacgcctgtaatcccagctacttgggaggctgaggcaggaacattgcttgaacccgggaagcggaggttgcagtgagccgagaacatgccattgcactccagcctgggcaacaagagcaaaactccatctcaaataaaaaaaaaaaaaaaaagaatgggaaactgaaattaattcattatcattagagagaaggaacgttttgataatagaagctgcaggattgggtgactcagtgaaggaaaagtagccatgaagtatgaaatcgcattagaatgatttcaaataaaagagggaagtgaggaaaaagaactgctttggagtgaggtaagaatttagggttatagcatggccatgtgtagacatttagatggtcatggtggctcatgcctgtaatcccagcactttaggaggccgaggtggttggatcgcttgagcccaggagttcaagaccagcctgggcagcaaggcaaaaccccatctccacaaaaaattagtcaggtgtggtggcatgtgcctgtagttccagccactcgggaggctgagatgagaggatcacttgagcccaaaaggtcaaggctgcagtgagtcatgtttgcaccactgcctccagcctgggtgatggagtgagactctgtttcaaaaaaatatttttttaatttaaaaaagaagtttagagatgttctgaaggaaatatattgggctgcagcttaggaatgaagtcagattaaatgcaacaatttaggaattttctgtagaaagatggtaattggaatctacctttaagaagatctcaaatctatccacttctccctcgagctccccagctgcccctactcattcaagtattaccctctcttacctggactgctgaaataccccccagtcgaaagtaggtacttcctgtgggatcttcccacagctctctgatttttccctccaggccttattacaatgtgtaattcgggcttgtttaatgttgagtatggaataattatctgttgttttatccctgaagatccatcaacttccacagtgcgtggcactcaaacatttttttttccaacaaaagagtcaatgaatgtaagtactagaaagtagaaaaaacagagagctttgggtgaacatctttagggcacaggaagaaaaagtggaaaagtcaaatagacaaagaaccaagagaagccagggcacaatagctaagggagaggggagattcaaggtgggctggtcatagggatcgattctgcaggtggaggaataacatgaatagctgacattaattgagtgctttttgtgtgcctaagacttggcacggattaactcagttaatcttcacagtaactttggtaggaattatttggtaggaatccctattatagagataatacaggtgagaatagataccagaaatgttaaatactttgcccaaaaacaagcaagtgggggagccatgagtcaaaccaggccatctggttccagagcaaggagactgaaccaccctgcagccacaccagctcctgctagcagtaagacagaagatagtttgcagtgtgatgtggtgttaaagatgtaaaagcaaaaggaggaccagctgctctttgtagcctttagtcatgaagagaggatggcaatgcctatgattctgagttaggatatttccacattaggtccccaaatctacagaagttacaggaacactcatgcatcaccagtcatgaaaacctgaggaatatgctctcatttcaagaacaggtagtttttgattgtgtcttcagggtactctagcagctgctttgacattgactttgacattgacttttttactacattccaatgttgttattgacttaaattagtccttgagagagaaggaagaaagaatctgactttggcaatagaaagccttgcagtattccaacttgctttcagttttaaatagttctgtgaatcattcctgtttcctttttttacaagtagggaagtaaagtcctgccagagctagacggaaaggcacctgtatttgcattgtaacctgagttttgaatagtaaatgcacaggtacagaatatactagcaacagtaaggtcaggcagacattctggaaatgtgcacctgagtgatgaactggactaactggtgtctgtcatgttgcagaatgttgctaactcttaaagctcacacatgttaagttgttggcagatttatcaattcttttaattaaaggactgggatgatatgagtaacggaactattttgttcctaattgatgcaaatcttaaaagtacgtgactaaaatctgttcccagagtttctcattacagaagccttttaatttgttttaaaatatatgcatatacatttctctttttgttccttcagatttcttaatcgatggtgatttttcccaacccaaactctaactgcaatggccagctttccacatatggggatagaatttctttttttaagccttccacactgaaagtaggggtcttggcctcacgaggacaactcagcacccttcccagatgctggcaatccaaaagaagagtacagaggagatgaagctctttttaatattttttatcactttttcaaaagttaattctctcttggaatttattctttaaaaaaaaaaatcggaccccttacaggatcaggatagtgtcttactttatccaatagttcagtttggaccacacagcctgactttgtctcacctgtaaaattgcacagttctcttaggcctgttcatgggccgggaaaaaagactgcaagtacaaaacacatggttcaggttgaatattgcaggaaaaatataagaaaaagtatttcatttttaaaaaaatcttcttaacaattaattcatggatgctttgctgaggaaaatgctttgcagaggttgaatattgcatgacaatataaaaaaagcatttttttaaaaaaaacaaaggtttttaacaagcagaattcattcatggatactctgtggaggaaaatcatggtgtccggaatgtttttaagcttgaccactcctaacttgagtaaatgattctgggtgccttttgggaacatccacagtattgtcagagtcttcttaggacctgcttttgaagccagcttactgctttggaggatgctttgggctgtgcagggcagaagactgtgtttttgccaattgaaaattcctggccaggcacagtggctcacgcctgtaatcccagcactttgggaggctgaggcgggcagatcacgaggtcgggagattgagaccttcctggctaacatggtgaaaccccgtctctactaaaaatacaaaaaattagcaaggcgtggtggcaggcgcctgtagtcccagctactcgggaggctgaggcaggagaatggtgtgaacccgggaggtggagcttgcagtgagccgagattgcaccactgcactccagcctgggcaacagagcaagactccatctcaataaaaaaaataaacaaataaataaataaataaaaagaaaaagacaagagaaaattcctgtgttgtcagccatccaggccataccccttggtatccacaaacccagagcttctaaaggaattaggatttgccagaatgacactggtaagcaggccagcaatacagttctatttttgttggctaatttagtgacatttgttttcagaagtgtaattctaggaatgtttacttcaagcgaacacctgttgtctcttgagctagtgtgagggatgagtcaccgtgaattataatcatagtgataagagctagcaattaattaagcactttatgctagagacttttctaagcacttgacttgcattgtcacatttaatttttacaagcaccctatatgatatgtaatagtgtcagcattttacagatgaggaaactgagacacaaggagatgatgtgacctgcctaaggtcacagagtccatgctcttcatccctcatcccccatgtccttatccaagtctctccgagaaaggaagcgctagcactgataaatatgagtagggaagttagcatctgcaaatggtcattcattgtgaagagttgttgaagctgtctcggggggtactgttgccaagccatcatttcagtatggttgagaattagaaaggttaaggcccttctaccacttgtttctgtctgaagaaagcatctaatatctgttagtgttttcttttaagagtctggcccttggtgcttctgacataaaacagtctttctttctcccatggtctgtgctactgtatggtgcagtgaggcactgataacacctccatggagaaccagccaaagggtctggtactcaagcattggatcagtggtaagaaggatttcctatcacccctcccttcctcctccaacttgacatcactcctccttccattaggaaggctggttccacattgttatcaagccattcttagatcacttgggttaggaaatcccacagcccaaacctcttaagtgataagattctactctgagctcctgcctgactcccttctgaacttgactttttgaaagatgaagtgtgaaccctctggaataattgatacccatttgcagcccactctcagttctcattgatggcaaagatgcctgtaatacagaataacctatttcttgaaggccatatgccatacttcacaaagccttttctcaggtggcatccatgaagtggcagccacaggtaactgaatcttcaggcctgatcccctctttactatatcataaatatcaaaaggcagttgggctgaacaagaacaagaagcacaagaaattctggattattttatccctaaacaattatctataggctatgatccttcagggtgtttcctagctaaagtataggaacagcttctcatgttggttcagagacagccgttctgacaaccagggttgtcttgcttttctgagcagctttgtgtgagaaataccaggtattaagaagtctgttgtaggggagaatcatatacagactagtagaaaaagaactttatcatagaggaaaacacccagtttgcaggcattcttcctgaacactgctcttccgtctgaaaaggtcctgagtgtcaaagccccacctataccctgaagccatctcaacagactcggacccagacctttgtctcctgtcattttcttttcagagcattgccatctcttttgtctggctgcatccaactatttttaattcccttgcctccccactgtctgctgagtggataattaaacatgaagtactatgctttgttgagattatatttttaaaggacttgctacagggaactgaacggcaccttcgaaagacagactttgagggctgggtgcggtggctcacacctgtaatcccagcactttgggaggccgaggcaggcagatcatggggtcatgggttcgagaccagcctggccaacatggtgaaaccctgtctctactaaaaatacaaaaattagctgggtgtggtggcgggcacctgtaataccagctacttgggaggctgaggcagtagaatcgtttgaacccgggaggcagaggttgcagtgagctgagattgcgctagtgcactccagcctgggcgacagggcgagactctgtctcaaaaataaaaaaaaaaaagaggttttgagaagaagaccactaacttccaagaagtttatgagaacagaattcagacatagaaaagatacattcagctagaaaagatacattctagctgtgtcttcatgctgaggaagatacaagcgtacaaacttacaagcttgtagagactattggttgttggtttctctgctctactgcttaagagtgtggacaccggagttgactgcttgggtctctgtcacttatgtgctgtgtgatattgagcagattaccttatctctctgtgcctccagtttttcatctgtaaaatagacaatagtagtacctagcttatagagttgttgagattgaatgcaaatgagcttcctagcactggcacatggaaagtactcaatccgtgctattagtgaaactttcatggagggttgagaaaacatgtgcttgtttcagatttgcataaaattcccatcttggagccattgtgataatccttcctgcatgtggcctaataataacctcaagtgtttttattttgattcttcatctctcagccaccccgctgggaggaataacaggagctgtgtgtctgtatatctagagctctctgataatgagtagatgagacgaacaggcctttgggttgactggcttcctggttctttttctcattcaggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacgtaagtgcagccacacacctacccaccctcttgactgtggcagcccacgtcactgggtaattatagacagtcacattcaccttagggtgggactctaggaattaatttctacttggtgctaaaatgggttaaactggtctccatttctattcatctaaagataactagatgagtggcagtttctccagttattactccttcacccacttggtttctttttttaacaatggctgaaaatgtttttgtccccattaactacatattcaaaacattcaccacaagaggaaggaatagactttgaatttgaataaacatgttttattgtttatttatttattttttttttttgagacagagtctcactctgtcacccaggctagagggcagtggtgccatctcagttcactgcaacctccacctcccaggttcaagcgattctcctgcctcagcctccaaagtagctggaattacaaacatgcaccactacacctggctaatttttgtatttttagtagagatggagtttcaccatgttgcccaggctggtctcaaactcctggcctcatgtgatccacctgccttggcttcccaaagtgctgggattataggtatgagccactgcacccagcctgagtaaagatgttttaagcaaatacacaataagaatgatgttcgcaattcagagctttttgtctgcctaaggggattctgttgttctagtcctgcaccctgacagatgtggtctctcgtctcagccagatgtggtagtaactacaggattaatttgcatgtgtaaaatgcatattgactaacagaaacaactgcaaccaaagtaagttattgaaatggcagactgcatcagttatgtgtactagctgagcaaggagactgaaagaaagcaatcattttccaaggccataagtgcctgccttctagaattctccaacgatgactaaaccatgggcatatttcatttttgtaaaggaaattaacacatattaaatattttttgaaaagttctttcttgcaaatcgatctaactgtccaataatcagttaaattatcctatatcagtatggtgaaatacaataaggctattaaaaaccacgctagcattgaatataaggaaatgtttgtcatttagcaagtaaaaaaatcaggttataaaacatgataaataataccttttcttgactaataaatacatacacacacacacatactagaaaagcataccagatattaagtagttatctttgcatcctaggaataactgtttaattatattttttctttgtgtttttctgtattttatttttaaaagtaaacatacattactcttttgatcagaaaaaagtattgcattttttaaaaggaatattttataatggtctaaaaattcttgctcatagttttaaagtaggaataagttttaaattggattcttcccatccaactcttcacggttagcagctacgatattattctcctttgtagggaagtattaatacatcattctggattcccaggatgaccttaactgatggccaaaaaacaaaaacaaaaaggaacaaacaaaaaaaaaagatgaatgggagatagcccagaattcttaaaaattgtcaatttttattttcagtctatttattagaaatgattttttaacttcctattcttataatatgtaatcaaatattttctcttttgctccatcaacagaatgggaggcattccagctaaaagccataggggagaaaaactacttttatttatgggcattattgacattctgcaatcatataggtaagaagtttgaggagtggtcttttattatttcaaaatcaatctacaaaaggttctgaaaaatcaccaaatgagagtgattttacattctcatttcaatttttccatttatatttaggttaatgaagaagttagaacattcctggaaagctcttgtttatgatggggtaagtgacttattttccttattatactgtatatatttctgctttctcagagacttcagagtatgtgcaggaaactgtgttgctagactctaagaggaaatgaaacaacggtctttataaactcagaatcttaggttagtagatcagttcaaatctaagaataaggacaacataaatttgaatagctcttcaaatacatgacatccagcctagcggccagaaaaacaaaatgatatctgtgtctatgtgaaatccaaaggacctaactttgagagaggtctttttttgtagggatgatcagtagggcatttgaaatgaagttctcacacaaccaagctacagtaagtgtgagtcctgactctgatggtgaacagcctggatttgaactctgcattcactgctgaactagccatgtgaccaggcacaatgctggttatttggcctcttacccttgtttctcacctgtaccagggggatagtaatgacacctgcttggtgtgaacatgggacaaaaaaatgcatttcagtgttcaacacaatgcctaacaaatacacagagaaagtgaaaactttttaattggtatggatttctacatcaacatttatacatgctggctgcctgaggttgtcttttttttttttttttttttttttttgagatggagtcttgctctgtcacccaggctggagtgcagtggtgcaatctcagctcactgcaacctctgcctcccagggtcaagcaattctcttacctcaccctcctgagtagctgggacaacaggtgcgtgccacgacgcctggctaatttttgtacttttagtagagacaggatttcgccatgttggccaggctggtctcgaactcctgacctcaggtgatccacctgccttggcctcccaaagtgcagggattacagatgtgagccactgcgcccagccaagaatgtcttaattgatgtaactgaagaaaaaaatcagttaacaaagagcagtttctcccatctttctctctccttctttctcccattccgtctctgtctctctgtctctctctctcacacacatacacacacatacacacacacacacacacacacacacacgcagtcccatctagacattagatttctacttcctgctactaacaacatttattggcctaagttaataacttgaagtagcaattccaaagaatattttggtcaaggatttggtcacacatttccttttaagatgttagcagatactttcttttgaaagagaataaattatagatgatcttcttcttctttcttggaaaggagcccataatttctcagttctgtggaagactgttaataacctttcagcatgaaagatctacattttgtccaccgctaaggactgacttcagtcataatgcacttttaaacaacaggttcacacatttatttccaagaattaacctctaagctgggtgtaggggcatgtgctggtagtcctggctactcaagagactggggcaggatgatcacttgagcccaggagttcaagtccagtcttgaatatagcaagaccctgtctctaaaagaaaattttttaattaaaaaaaaaaagaattaacctcaatcttactgagatcaaaaattcctcctatgaaagaaggtcaatatggtaggttaatttaatgtttccttccagctgagaaaggaagggactgcatacatagtacctcgaacattgaaggggagagagtgaataccctcattccattcccctcctgttttctgagaccatttcaatttcctgttaccagatggatctgaatcgtctagtcttgtaccaaccaggtgcatctaagggccccccacctttctctatttaaaacccaacactttggggggagaccaaagcgggcggatcacttgaggtcaggagttcgagaccagcctggctaacatggtgaaaccctgtctctactaaaaatacaaaaattagccagacgtggtggcacatgcctgtaatcccagctattcgggaggctgaggcaggagaatcgcttgaacccaggaggcagacgttgcagtgagccaagatcgtgctactgcactccagcctgggcgacagagcgagactccatgtcataaataaataataaataaattaaaaaatatacctatcatctgcttttcttttctttttaatgaaaatttctgtgctggttatatatcatgaacctatttttgtttgttttcagacatggctcttacttaaacaatgtttattcatgccaaagcgaacaacaatgtaacttctctttataggcaacggctgaactttaatcctctatggatacccctcaggctcttgccttctgctgatatttctaaattactgccttgttggaagaatgtgtccacttcaggcagatactgccaggataccagaaagagtacattttaaaagatgtagcagggccaggtgcagtggctcatgcctataatcccagcattttgggaggccgaggagggcagatcacttgaggtcaggagttcgagaccagcctggccaacatggtcaaaacccctctactaaaaatacaaaaattagccaagtgtggtggtgggtgcctgtaatcgcagctactgatgatgccgatgcaggagaatcacttgaatccgggaggcggaggttgcagtgagccgagatccgccactgcactccagcctggcgacagagcaagactctgtctcaaaaaaaaagaaatttctctattggaatccataagcctgaattcaaaatgaagcattatagaagcaaatttactatgtctacaagtgtacagcttggatacatgatttggataaatgattactaaataaacatagaaaagtagctccttcatccacctcctttcccttcatctatcccctttcctggatttgtaatcaaatgacccttcagccctaaagactcctgccaagcatgagagaagaatggagttaacagtttaattcaattcaactctatgcaatcagcagataattcaatgcaaaggagtcatctgttagccttgtctcctaggaatcctcctagcatctcctcaccttgctattgggagatgaaaccagaactttttttaacttaaacgtcaatgtcactcttacattaggatagttttgtttatgtctccaatttttgttcatgattaagggagttacccttcattccagatgacatttgatgcactggttgcctgtatgtaaaaaaagaacttaaaaactcctcctgggacacaatgttatgaataagggcagctgttttgatttatgtagcacagttttttttgctgactctcctctgctcagtttggtcttgagtgtctagaatctttgttccgattgagtctgtgccctcctccctcagccccagactcctgggccccacgggctacaggacattcctgttttctatctctgggccacctttggttaagaatgttggctaacagagaaccaattgcatagatctctcttctgacttgagatgaacattaagaggtgaccctgtgatcctgggtttttgtcttttcaggacactgtttctgttcatagaccaagcttttatgcagacagatttcttaagttcatgaattccagagttttcaagaaaattcaaggtaagattcttatgaatttttttttttacttttagcagctaatttcattatgtatctttgcaagatttttattggaagaactaacacatttctctccctgcagcagtaatcacttagtaattatggttaagtaacccagtcaggtgtttattgatgccataatcattagagtcctgcttagtggtgaaaaaatttagaaggtatctaaatgtccaaccatataatatattggttaaatatattatgatacagtcaaataatggaatagtatgcacccaataaaaatgatgtgttagcacatttagtttgctaaatatagatgtatttaccttttatgtagttatcagtctgtataccttaaatgcacagcagaattctaagggaatatacaaaacagcagttattctcataggacattctctaggatggatcatatgttaggccacaaaacaagtctcagtacattttaaatgactgaaatcatacaaagtatcttttctgatcacaatggaatgaatcaataaacagtgaaaactgaaaacttctcaagtatttgaaaattaaaccacacactcttaaactagcaatgagttaaagaagaaattacaaggaaattagaaaaacctcaagatgaatgaaaaggaaaacaaacataccaaaaatttatgggatgctgtgaaggcagtgctctgaggaaaatttatagctataaactcttacctttaaaaaaaaaaaaaaaaaaaggaggccgggcgcggtaatcctagcactttgggaggctgaggcgggcagatcacttgaagtcaggcgttcaagaccaacttggccaatatggtgaaaccccatctctactaaaaatacaaaaattagccagacgtcgtggtatgcacctgtaatcctaactacttaggaggctgaggcaggagaatcgcttgaacccaggaggcggaggttgcagtgagccgagatcatgccactgtactgcagcctgggcaacagagtgacactgcgcctcaaaaaaaaaaaaaaaaaaaaaaaatgaaaaaagaaaaatctcaaatctataccctaactttaaaccttgaataactagaaacagaagagcaaactaaacccaaagctaacagtgcttattccagatcaagggagtatgtgggctcttattttcctttatattgatatttattaaattttctacaatgaatatgttgtatctgtgggaagtttttaagatatgtgaaaggagaaaataatcctatatatagttattttatcattttgctattctgtggtccaatttcataaactaaaacatgataatttagccatacacaactgaaaaagtagaatgttcatgttttatatttaaataagacaaattttcctggtaatatttattggagattttttaattaatgaaagtcaaacacttgcaatgtaaacattttggaaaatacaagaagatgaaaaaaaaatgaaaattcttgaaatgccacaacccagagatatccactgctaatactttgatgtactttctaccaatctttatttctatactttatgtatttacgttaaaatgatagcataatggtacacaattttaggtatagtcctcttttttcacataacattataacatgaatagtttataatgttatatttttcatatcattgtatattctacaaggcaccatttgaagttgcaacacattaaaattgtatgagtgtgacgtaatctaatttttttttttgccagaatctatttaaccattctttcagtattgggcatttacattgtttctcctttttctatttcttaatagtttatgaacataatttcagataaacgttgtgtccaaatttaggattatttctttagaatggattccaagaaaggggtactagggtaataaaatgcacgtaactgcgcagatagattgtgccacagaaggttcccacgaggccatgagagcccgtattctgccagcccttagccagcattgtggtttttaaattatgccactctgataagtaaaaaatgttatctgattgttttattttgcatgtaagtactggtaaggttcaacccttattcatgtttattagccatttgtagttcctttgagaattgagctttgtaacatttgaccatttatattgggtgtttgttatttttccgaattattaatatcaattccatgtattaaagatattaacccctttttaaaccttatttcactctaagggaaactttcttccacatttgactctctcagtggtatcttaaaattgctgtcaaattgacatcaccgtaaattatttgcccaaggtttctttggcctaaaatagactataagatagtgtttattgagactgcaagcctacatgaataccagcttgtggttccaattttttttttttttttttttgagacagggtctcactctaccactcaggctgcagtgcagtggcgtgatttcagctcactgcaacctctgtctcctgggtttaagcgattcttctgcctcagcctcctgagtagctgggattacaagcatgcatcaccacacccagctggtttttgcttttagtaaagatggggtttcgtcgtgttggccaggctgtcttgaactcccagcctcaagcgacccacccacctcagcctcccaaagtgctgggattacaggcttaagccaccgcgccctgctgtgtttccaatttttaagaaagatttttttcacttttcttagccctgtgccaaggttggaaaaacatgggtttcactgcagcccctggtgcgttttggaggatctagccctttaatgttctagctttggtgagcctcccttaggagactccccatcttgggaggtttttctttcttaggggcatataaattaatggtacaatcaatggcatcttcagtttcataaaatatggcatgtgtcgcagatttttccggtttggataatttttcaggtttttaatggaacaagttgtttaactcacgggtaatcaaatctattgacattttctcattttgattttattatctattttttaataatagctttattgagatataattaagatgtgtatgcttcacccttttaaagtgtacaggcctatgattcttgatttattcacagttatgcaatcatcaccattttctaattttttaaatttatttatttatttattttgagatggtgcctcactctgtcgcccaggttggagtgcaatggcgcaatcttggcttactgcaacctctgcctcctgggttcaagtgattctcctttcttagcctcccaaatagctgggattacaggcatgagccaccacacccagctaatttttgtatttttagtagagatggggtatcaccatgttggccaggctggtcttgaactgctgacctcaggtgatctacccgcctcagcctcccaaagtgctcagatacaggcatgagccaccatgcccagcgattttctaattttagaacattttcattaccccaaaaagaaaccccatacccattagcagtcactccccattccgtcctcttcccagcccctggcaactactgatttactttctgtctctatggttttgcctattctggcatttcatataaatcatataatgtgaacttttctgtttggctttttgcacttaacagaatatttttgaggtttatctgtagcctcgtagcatgtaccagtaatttattctttttattgcagaatattccattatattgatataccatagtttgtttattcatcagttgatggatatttgggatgtttccattttggccattatgaataatgctgttacgaacattcatggacaaggttttgtatgggcatgtattttcatttcttctgaatatgtacctagaagtggaattgctgggtcagatggtaactctctgataacattttgaggaactgtcaaactcctttccaaagcagctgtgtcattttacaatcccaccagcaacatatacgagttccagtttctctacatcctcactgacatatgttattgcctgtctttttttcttttggctatcctggtaggtatgaagtagtatctcactgtagttttgatttgcatttctctaatgactaatggtattaaacatcttgtatgtgcttattagcaatttatatcttctttggagaaatgctcactcaaaccctttgcccatttttagttgtctttttattattgagttgtaagagttctttgtatattctggacacaagtccgttatcagatatatgatttgcaaatattttcttccattctgtgggttgtctttttacttttttgatagtgtcttttgaagcacaaaattttttaattttgatgtccaatttttttccttttgttgctggtgtctttggtgtgatctaagaaagcattgcctaacccaaggtcatgaagatttactttcatgttttctttgaagagttttatagtcttagctcttacatttaggtttgtgattcattctgatttaatttttttgtatatgatatgaggtagagtctatcttcattcttttgcatgtgggatagccggttgtttcaccaccatttgttgaaaagcctattctttccccttattgaattatcttggcactcttattgaaaatcatgagagaacataaaccagacaaaaaaaaaaggaaaagaaagtcgattgaccacaattataataaggatttacttcttgactctcacatctgttctattgatcaatatgcctaccctcatagcagtaccatactatcctcattacttctggtttgtattgttaagtttcataatcaagaagtgtgagtctttcagctactctttttcatactgttttggctattctgggttccttgtatgtccctatgaattttataatcagtttgttaatttctgggggaaaaagggtagctggtagtttgataaagatagtgttgaatttggggagtgttgccatcttatatcttacatcccataaatgtgggattctttttagttaagccttatgcttacaaaggacttcaccattgaataatcagataaatgttcacccatatttttcttttaccttttatagattgttgtttatgttttcttttctttaatctatgttgtattcattttggtgtatgaagtgagggagatctaaccttgttttttcacaggtagttaactattgtcctaataccacttattgaataagatatttcacttcaaagcacagtcaagtactttatcacttttgtttattgcgtaggtagtagtgataatgtttatagtgctgctacagtggaaaatagtcctgctacagtgggaaaggtgattcctatctacttttcttgctttatgttttctaacatttatcatgacctataatgacctatactttaggtcctatgctataggttttacttacttaatgcctgtcccctttatttaaatgtaagctagctgggcacggtggctcacgcctataatcccaagactttgggaggccggggtgggcggatcacgaggtcaggagttcgagaccagcctgaccaacgtggtgaaaccccttctctactaaaaatacaaaaattagccagacgtgctggcacatgcctgtaatcccagctacttgggaggctgaggcaggagaatcacttgaacctgggaggcagaggttgcagtgagccaagattatgccccactacactccagcctgggtgacagagcaagactctatctaaaaaaaaaaaaaaaaaaaaaaagtaaggtgactgctgtatccccagcacttaatgaagccatgtgggtttggagggtgcacatattgtaatttttatttgttgaatggatgaatataccatgtatactgggtccgatcttctccttaaggtccaggacagatccctgtagagattatctccactacagggtaattttaaccattcactccctcttctggctccacacctcatccttctatctgctcattctcatatatcatagaaacaaacctcctcaacgatctgtctctcttcagttcctggtgtatctttttcctccttcactgtcaccctattggagatgagagttggatgtacttgctgtctcactttttttatttcttgtcactattcagtgttctccagtggcttttgatcccaccactctaccaaaatgttctttttgaagtaatcaacaatcattgctcaagccattgaacaactttcagttttttttgtttttgtttttgtttttgtttttttgagatggagtctcactctgttgcccaggctggagtacagtggcactatctcagctcactgcaacctctgcctcccaggttcaagtgattctcctgcctcagcctccagagtaactgggaccacaggcatgcgccaccacacccagctaatgtttgtatttttagtagagacagggttttgccatgttggccaggctggtcttgaactcctgacctcaagtgatccacccaccttggcctcccaaagtgctgggattacaggtgtgagccaccgcacccagcctctttcagtcttcttaaaactctccagcatgtgagaccactgatagcagttctctgtgaaataacgctcttcgcttgtctttcgtaactcaggacttccctggttgccttccagcctctcttctcctccttggtatcctttggaagcttttcatccctgcttactcttattgtggttgctcctcagggtccaggctctgactcggtctcttcttatacagcactctgggtaattccctgttctcccaagggttcagttaccatctgtgtacttgcaacttactccccacacttctagcaattccccttgcctgtccactccccaaacttaagcatccactagattccacaagctcagcatgcccaaaattgaatttagccacttaccaccccagagtctgcctctctacctgggtccacgtcttatggaagaccaccacaatccacccaattacccagccagaatgctgccatcatcccttgaccccttccttctgcttaccacccacgtgcagttactcagcaacacctatcagtcctcactctgcagtatcaggattgcagccccttctctcacagtacctctcctgattcagccactgtgttttttggtttgcaggttttattattatttttttttttgcataaagttgtggccccaaacaggtctctttgcctcccatcatgtacccattcaatccaatttccacacacacacactgcagctagaggaatcagtttaaaatataaatctgctcttgctgatttctgttaaaacccttccatgctaataataataataataataatgctaaaggaaataaacgtccatggattccctggtgcccaaagtccttaactttcacttaacacatttcctggcacacagtagacactcaatggttatttgatgaataatgcaatgaatgaatggaatttttatctaacaccaccatttcaaagggtaattaaattattagaaaagtagacacttgagttaactttaagatgttccatcaaccatggttaatttaaagcccttaatgcctaaaggcatactcccctcccaccaagaaaatagtacctggtcttcaagtttcttttttgaagtcagtgttttttaacctttttaaatcccttcatcccacccacaagtgagtcatgctgccggtgtaataatgtctacaaaatcctataatatttcctggaaatattagccaccattatgttgaaacttcactgaaattctccatacgaataatttgtctaaagtactaaagcttagtttcctgaatagaatataagagttaaattaatttgttagagaaaattaactgttctaaaacttcagaacaataatgcattcatgaacaaacactcgtgcacctattatgtatctagcactacactaagcactgatgatatagaaagctttttaaatattgattagttcctccctcaataatttaatagtctcttttgagccggagattgaaacatgtgacagatctgtaatgaaacaattgctaatatttctgcatatgctactatgggtacgcggagagaaataagagaaaaaaagaccaattcttccaaaagagagctcacagagaaaaagatatttcaactaaatcctgaaaatgtaacccagagttcattaagaagagagacaggaagggcatctcaaggagaaagaacagcatgtgcaaaggcctaagggcagaatgaacatggtaggttccaatatggcagaagggtgagctgaaaagtgaacatggaggcagtcgagtggcagaatgcaaggctagaaatggacacaggatacctactgccagccatggttgagccaaagacaaatctaggcgtttctgccacacaaaaggaagcaaccagccacccaaaccagctctcaatgttacccagtcaaaagagatcctgagaattaaatttctgcaaaatccaagctcttatctgctgagtgagatcattcctttaaggaagaaactcaccacttgagacaaaagtgaactctttgttgtggtgctatgtggtcttggcagaggtttgttttccggtcttctctgctcctcattatacgtgatgctgataaagaacaaagagttacttctttttccagtcttttggccctcactccatgaaatgccatgagtataggtctcctgagtatcttttcctcattacacggctctcaccctgatcgcatttccttggtactgccgaaaaccttttgatcattgctgtttcttcgtttagagaaataacattgacctaagaactatgatgtagaaaagcagttctcaaaccttttggtctcagggccacattacacccttaaaaattattgaggacaccaaagagcttttatttatgtgggtgatagctatctatatttcacatattagaaattaaaattgagaaaaatttaaaaatatttattaattcttaccagttaacaaaaaaaattgcgtgttaacatcagtcaatttttaacataaataattacaaaatataattatattttccacaaataatttagtgagaaaagtggaattgttttacctttttgtttgaaatccttaacgtctggcttaatagaagataagttggagtctcacatctgcttctgaattcaatatgtggtgacatcacaggtcatgtaacatctagaaaactctacacatatgagagaatgaaagtgaaaaaggcaaataatgtcttatgatgatgatgaaaataattttaacatcacagatcttctgaaagggtctcagagaccccttagtttccaccccacatctgagatcctctgatttagaagttttaaaatacagctgggcacagtggctcatgcctgtaatcctagcactttgggaggccaaggcaggcagatcacctgaggtcaggagttcgaaaccagcctgaccaacatggagaaaccccgtctctactaaaaatacaaaattagccaggcatggtggcgcatgcctgtaatcccagctactcaggaagctgaggcaggagaattgcttgaacctgggaggcggaggttgcagtgagccgagattgcgccattctctccagcctgggcaacaagagcaaaactccgtctcaaaaaaaaaaaaaagaagaagaagcagttttaaaatactatattgaaagacaggagtttattgaaggtctataaaagttagcagatagagatgataggttgataggtgtagcaaaccaccttggcacatgtatacctatgtaacaaacctgcatgttcagcacatgtatcccagaacttaaagaaaaataaaataaaataaaataaataaaagttagcagatagaatgttaaggcagaggccagtgtgacaataatggcttcttccttgtaaaacaagtgtaaccactgtttgagagagtggagaattaaggtaaacataacttattttttaaacattcaaaaatttcttcccctcaaagaaaaacaaattcaaggtttatctttttctcccctcagtttaaccagaaaacagaatgctaaagaactagaaaatgaaccacctagaaagcaacttaagaaaagaaagacacctgaaattcatgcttgctagttctgtgaccctgagcaagccacaatctttctattctcagtttctgggcctaaaaaagggccttcctcttcctcatacatgtggatggtttgagatatgcaatgtgaatgttggattccagactctaaagccctccacaaatgttatttattaggatgatgatattattatgattctaagactgctcgagggacaaataaaccttcccttctctttaagtggagagattgtcctccattcttctctcatttgtgtgtcccaaagtccttctccaattaagttcttgcaagcagcctctgggaaggccccagatgagctgtgtaatctaagctctgagattcccaaggctaaacacaattactctaatacacttactatcaggctacccctttatgcaaacttctaaaggaagagagacactgccaaaaacatattcaggggaaaacataaagaggcctcaacttccctctccccctccctccaaggaaattctcaagcaatattaagccaagaagaattattgcagcaaatagtgaatgtaaataaggatggccttgctgccgcttaagcagcttccatggacgtgtcctccatgaagtcccaggcttcagcaagcatgattgatggtgaagtacattttcattagttcaggttcccaacacacttctgaagttgtagactgctgtttagacaaagattggaagtgaattatacgtctgacataaaaccatgacctagaaaagagctaaagggtaggaaatgtcagtggaaagtcacagaaagaaaaaagcaaccagaagtaacttggctaaattgggcaacatgagtagaagattaaacattggcatgtttagaaattcccagtcccaagttaataaaaccagggtcgtgagaattctctatactttaccatctgtgcttatcaactcacccatcctcctcccagcactagaaaaacattgtttggagaggggggaatgattctttagcaataaaacatttgaattttacctcaagtaagactttattgcaaaatctggagagaaattttaacttttaatttgctctaggaaattctgatttaagtcaagtcattttggacaaataatatagccaattcatcgtattcatcagatgaaacaagttcatctccctttccatatatataaaataagcgtcttgtcttctattcaaataataactaaaatgttaataaataataaaatattcacttttaaataaaatagtaatgtgattttacagtaaatatctgtatttgtccttttcctttctgtctagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaaggtaaagatatgtaacttttttaaaaagacaaacgttcttgtgatttatttatacaagtaaatttgcagaagaaaaatttaaaaatacctgctctaagaaataaaatatattaattaagtttttaaaggatagctgcagtggccgggcgcagtggctcatgcctgtaatccttacactttgggaggcctaggtgggtggatcacttgaggtcaggagttcgaaaccagcctggccaacatggcgaaaccctgtctctactgaaaatacaaaaaattagtcaggcgtgatagcgggcgcctgtaatcccagctacttgggaagctgaggcatgagaatcacttgaacccaggaggcggaggctgcaatgagctgagattgcaccattgcattccagcctgggcaacagagcaagactctgtcccaaataaataaataaataaataggatagctacagtaagatgcagttcatgcacattttaactaccacataaaaaatacaatttatggtttacgataaaaattagacaatactaattcaaaaagaaaaatgtctgcttccactacctgatggtaacaaatactaacattttgttgcttttacttctagaccttattctgtacatgtacacatacacatatgcacgagtacacatacacacacatacactcaatgtaacaataagttgtctcttcatttaggtcttctttaatgatttattttttggtacccactggtaatactcaggaggtactacacgttctttactttgaaagcttcataaccatgagcaggtaccaagagaaggaaagaaaagaggcagaaaggaaaaatatggaacgtttcacaaatttgcatgtcatccttgcacaggggccatgctaatcttctctgtatcgttccaattttagtatatgtgctgccaaagtgagcgctttaatgaatttcaataaagttttataatatttttcttgtgtggcttgtacatataccttttgttagatttatttcttggataaatgcagagatattgatatagatttttttctggatttttaaaaacagtatcttttttaagaattgagttttctggccatttgttgctattgcatagacttcacaccctttttgtctttttttctttcttaacttgctggttaggacttcttgtacaatgataaatagaagtggtgattgtagacagccttgctttgtcctgattttaaagggagtacttctaatgtttcactgttgaaaaagaagtttgctgtatttgatacccataatcaagtcaaggaagttcctttttttattcctactttgctaaaagttttttttttaattaatcaggaaggagtactgaattttatcaaatactttatctgccaagttaatcatttgttttttcccttctaatcaaatatgggagaatgacattttagatttttctattagtatattctttggagaatctcagcatttcctgaaaatgtcttctactttctacagaagttaagacctcttctaggggttttcttttcctcagagtctttaagatgtggtgttatttctattccttcttcagcagcacttatccatatgtgctgtttggtttctttctttctcatcttcccataaaccaacttttacctggagttaatgatttcagcaagagagttacagaggtgcccttgatcctctccgaattggtgtctccaattcctagcagacattcatccctttctcctaagctcccctgcactggcatctcccacactatactacctgattttctgatagcacatgcaaaactgcaggtgcctgtagtctgggaaataggataaacttattttaaaattatattagtttattgatttgcatatgttgaaccagccttgcatcccagggatgaagccgacttgatcatggtggataagctttttgatgtgccgctagattcggtttgccagtatttcattgaggattttggcatcaatgttcatcagagatattggcctgaaattttctttttttgctgtgtctctgccagattttggtatcagggtgatgctggcctcataaaatgagttagggaggattccccctttttctattgtttggaatagtttcagaagaaatggtatcagctcttctttgtacctctggtagaattcagctgtgaatctgtctggtcctggactttttctggttggtagcctattaattactgcctcaatttcagaacttgttgttggtttattcagggattcgacttcttcctggtttagacttgggagggtccaaagaatttatcccttccttctagattttctagtgtatttgcacagaaatgttcatagtattctctgatggtagtttgtatttctgtgggatcagtggtgatatcccctatatcattttttattgcatccatttgattcttctctcttttcttctttattagtctggctagaggtctatctattttgttgatcttttcaaaaaaccagctcctggatgcattgatttttttgaagggttttttgtgtatctatctccttcagttctgctctgatcttagttatttcttgtcttccgctagattttgaatttgtttgctgttgcttctctagttcttgtaattttgatgttatggtgtcaatttcaggtctttcctgctttctcttgtgggcatttagtgctataaatttccctctacacactgctttacatgtgtcccagagactctggtacgttgtcttcattctcatggtttcaaagaacatctttatttctgccttcattttgttatttacccggtagtcattcaggagcaggttgttcagtttccatgtagttgtgcagttttgagtgagtttcttaatcctgagttctaatttgattgcactgtagtctgagagactgttatgatttccggtcttttgcatttgctgaggagtgttttacttccaattatgtgatcaattttagaataagtgcaatgaggtgctgagaagaatgtatattctgttgatttggggtagagagtactgtagctgtctattaggtccgcttggtccagagctgagttcaagtcctgaatatccttgttaattttctgtctcgttgatctgtctaatattgacagtggggtgctaaagtctcctgctattattgtgtgggagtctaagtctctttgtaggtctctcagaacttgctttatgaatctgggttctcctgtattgggtgcatgtatatttagaatagttagctcttcttgctgcattgatccctttaccactatgtaatggccttatttgtctcttttgatctttgttggtttaaagtctgttttatcagagattaggattgcaactcctgccattttttttttccatttgcttggtaaatattcctccatccctttattttgagcctatgtgagtctgcacatgagatgggtctcctgaatacagcacattgatggatcttgactctatccaatttgccagtctgtcttttaattggggcatttagcccatttatatttaaggttaatattgttatgtgtgaatttcatcccgtcattatgatgctagctggttgttttgagctgggctgagttcttatcaggaagtgctgaagacgaatcctcttccaagctcattcatgttgtcggcagaattcagctccttgtagctgttgggtggagatccctgcttctttgctgtctgacagccaagagccatgtttagccctggggtccatccacattccctaccatgctgcccctctgtcttcaaacacagaatgtcctacaagtcagccccaaacactttgtctctctgacttcttgtctctgacctctagacccagatttaaagggctcgtacaattaggtgaggctcccctgaataatcttccctttgactaactcagtgttagccaactcagggcaacctgagttacatctgcaaaatcccttttgctaggtcacatcacatagccacaggaataacagctcatcatgtctgcaggccccacaacaaagggagaatttacaagagtgtgggtcattacgggtcatcttagagttctacctacgacactggctttagaaaaaagcatatgggagcatgaggaaacacttctctccctcaaagaactgctcctcatgggttgaggggtcaccttcccaatgatgtgtgacctgagactgagtcactggacagatgtgttttgctctgtcactcaggccatgtctactttgtgaagtaaagctggtatgcccaaaacctaggtcgaagaccagctccacctaccttataaggagtggcaattcattggaatctgatatcaggttatttttgacacccagttttcaatgttatggagagttttcatgtttttctttccatttaatgagaagttgggatcaagaatattgaagattgcaagccaggtgtcacattaaagttgaagcctttctaatttttgaaggttgagcactttggttattcatggttttatatgacgatcatcttttatccatcgctgcagttttctattttgacttgaattggaggcagagctccaccaccccagtgtgtcgtctgatttcccagactagagtccagcctttcctgtgcttgcctggcttccctccatgttgcttcctaccccaccatctatacccttcacatccaaaatccaaaacctcacactcatacgagaatccctgttagggtcggtttatatttacacactaaaaatctctaattttgaatttgttgtgcctataaaggaataccaggaataccttaaagttataattgtatttattagcatctattttaggtcagtcttgggggagtgatggaaagaatccacatagactccagagagatgggcaggggttactgcccagccttgaacattcctctttcctcacaaggatgggctctcgcataagtaatttcatgggcccctaagttttaaagaaaaaataagtgttttctcatttttaaaaaaggcagctttgctgttaaaatatgtcaataagagtcctggataatgtttaaaagtatttatgggctcagatggggttaaggtagagctgactgttagtctgttgaagtatttgtttcccagctcttgaaaagcctgggttcttagatccaacctgagaatcatagatatgtgcatatcacagggagggcaaaaaggttcactgtctgtttatacacttgccagtcatccttttaatctctgccaaattgtctgctttaactcctatgagtttttttatgccatctttttgaaatagtaaatcactttattaggtttttaaaagaacattcataatgtcatttccatgagccattttgtaaattaatgcaatttccttcctgtttaacctgtttgcaagaagctattttacatttctgctgtaattcagaaaaaaaaagtgcagttaattcataattgaatttgcagcctgataggtaaaatgaatgcttttgactcatttcaattattatagatactaaagctgcatttatccttgagattcatgaatgtgtgtgttgctttcgttcctagccctgggatcccgacacaggccagacctggtccctagcactccatcactgtttgaagctgcttccttggcaaccacaatttcatcttcttccttatacgtcaatgagcactatccacacgacaggcctacactctattcaaacaggtaatacttagtgcagtcaaataacccatcaggctgttaccacatcaacatcaggcctgaaccagtatctctgaatgaggacacgtctctaacaaccaggatgtgcctgtcatctgcctcataggtcggagagagaacatgcttgatttttactgtggcaaaagaacattggagggaaaaccctcatgatttttctttacagttgatcattatgtcatgtagaaattatatacttggctcaatggaagaagacaaatctttcatcatttttattttagtaaattttttaggaatgggtttcttcagagtgagcactcttagttaatattacacaggtagctgcaaagatattgtaatattctcttttggtatgtgtgatcttagtgactatggtaaacagaataattgctcccccaaagctatccacatcctaattcctgtaacctgtgaatatgttaccttatatggcaaaagggactttacaaatgggattaaattaaagatcctgaaatgggatgattatcctgaattatccagataggcccaatataatcacagggttcttgtaaggggaagacagaagaaaggtgagaatcagagaaggagacacaacatcagaagcagaaggcaggatactccatttgccctgatatgattattattcattgcatgcctgtaatcaaaatatctcatgtaacctataagatttttggaaattgtatgctctctagcaactttgtgtgaatttttatataagcactgttttataagttctatgaagtgttataaaaatagaaacaaattttaaaaaataagtaaaataacaattatctgttaaatgttagactagttcttgttgaaacctagctctcaataatcaagatcagatttatgcaggtgaagaattccttacgctttaagtcattttccatctccaggctagcagttcagttgatttccaggaagaggaatcaataaggtagatttatttttaatatatggatatccatagagtctagcttagtcttttggtaagttaaagtttgctagtcggacctgctataggaattcttttttgttgctgtttcctcctccctcagctagatacaagattaggtaggcaggaggttaggcggccagtctaggtccagaaaagtagatcaagtgggtagcaaggtgagccgcaaatcttagctgggcctgagtttgcactgttctgctctaagggccaacaaataaggctctattaaaaattatttaactcatctaaactatacaaagttatttgatttggtcagtttccttggattggagaaatttaaaatgacttaaattaatgtgtaatacttagtagtaatgtcaaatgtttaaacctggtatgtaaattagtcaagcaacggcctttcctgtctgtttggtgcagctgaacacatgggtctatataaagttcttttgctctcaaatataaatagcagctcaaaagatagctggaaggttgcaggaagttcttagcaaggtcaaaaacaattctcatgtgaagccatggtgatttcttaccgtttgctgtcatgataattattggggcatataatcggatgtgctcttcaatcatttcgtgagattttcagccaacaataaaagggttttgttttgttttgtgttttggtagcagtggtggtggtggtggtggtggtggtaagtatccagtctcttgaccaggggtgttagactcttgggtattcataaggttttcccggggcctggcagggcctcctcctgactcccaatcgttcctggccatcctggaagctacctctgcatgttccacctccgcatgctcccagagctgtgctgtcattcttgatgcttttatttacaccgatactgactagcatatagatttggagggggaaaataaaaagttatctatgatatttttcctttcttttaaatatttatttaaaacaagtgcattgttttaatcttctttggcactgtatctccaaaatgcaatttgatatcttatatttcactatcaatcaaggttcacttgcaagaacaagaaaccacttaatcttaaccagaaaggaatttaatctagggaattgggtgcctacaaagtctgtggaaaggcagtgggcatgggctccaggctggcaccaggaaatccatcctggaacatgccaccaaactgagccaccagcagcactgtagcaggacccacagtcaagttggtgcctgccaatgagatgcaacccagacaaacgcatttcagtgagcctagaatgttgtttcaatgagccaccctttaaaaaccaaacaacttcgctaaaatacccagattcttttgcaatatcagtgtcttcgtcaccatataattttggctctgtttcctcctggcatttatcagctggaggggaaaacctgagaccaccccaggtgaccaccctcttcctcattcatctgtgctgtcacctgcctgctcctgtaggtatgtctgcttttagccttgatgtgtacaagaagctgacagaagggcctcgggtcttaatcacagacttagggaaatcataaggaaaagaggcatgaaggtgctaaaaaaatcttaaagacaacagtttgagaactcccaggagtcaatatccctatttccctgacccactgtgcccaaccctcattattcaactggcaaacttcaccaacaaaccaaaacaaaagaaaaaattgtcatatttttgtttctatcattttttcctttagagcccacctagtcctatgtggcaataaatagacactactctaaatctcatctggccaactgagtttcaaaacctaatccagagagcctggaaagaaaatgcattgaaaagaaaaaaaaaagaaagaaaaagaaaatatgttgaatattgatgttataatttacatgtgagatttttctctttatgaatcatttttctgttcaggcaaagtggtctgttttccgattttgacattatgttatatgtatctgtgctaaaataagctgcaaatacttcaactagcagttgtcattctgtcagtctttttagaatccttaagttggcaaggtattgattagtgcctggatgcctccacacctaaattatatactgcagtgggaaactgctgtctcttagaattattcctttttttaaaggattattctttgtaacttcaaaaactctgatagcaacccattctttttttaatgtactccaaaaattggctaggaaggaaagaaaaaaaaatagtatcatcttaaaagtatgtatctaacctactgattgggagtacatattttcacaagttgcactgtgcagtcttgtgttagagcatgcagatcataggaataaagagaaactgtcatgggcattgcttcctagttaactagcaacatttaagttctgaatttttgatacttgcatttttatttactagtaagaagtctgttcttttaaaaagaggtataaattgagcactaagaaatatagaggcaaatgtgttttacctcaaagttaagaacaatttcatttaatgttgtagaaataggttacacttatgaatattttcatgatttcctgcgtagttggtagcaaagccaaagctctggttatgcataaggaattgaaagtcacacttcattccagtgcacctatgctttccccatcaaagatgtcttaccagtgtcaccactctatccagtctcaggtttggttggtggctatttctaacagttgggctcaccctgcagacatttgcagtattgtgagaagggcaaaaatgtcagagaaaaagccactggtcatttacacgtagagggaaaattggcaaaggctccctaaatgatgagtccaacattctagatctcagaggctaatccatcagatctaacagtcttgtgccctcttcttcctgccattacagtgtcataaacctagaacaggggtggaaacactctaaccagaagcccttccccacaaattgcttaccactaaggtttatagacatgcaagtagagccatcccagtggttagagatctttctttagatttgtctaaaatatcagaaaatggaaatgcagaaaccttacatggtatatccgagcgtgttagtaggacttcagttgaacacaggtctctagggtctaagcctcttgtcttttccactgtaccactcctgcatcatagcctccaaaaacatacaaggttggttggttggtttttttcctaacatgagttctggtcctgtgtttgagaccttttttttttttttgctgcttaataactaaaatatttctagcaggcaaagttgtgggcttatgttttggtttttgggttttggttttttgggtttttttgagagagtctcgcgctgtggcccaggctggagtgcagtggtgccatctcagctcactgtaagctccgcctccagggtacaagtgattcccctgccacagcctcctgagtagctgggattacaggcacccgccaccactcctggctagttattgtatttttagtagaggcggagtttcaccatgttggccaggctggtctcgaactcctgacctcaagtgatccaccctgctcagcctcccaaagtgcagggattacaggtgtgagccaccgcacccagccaatgggcttacgttaatgtctacctatagtatttgttctaccagctattggtgaattttgcttattaaaaacagcattgcaaaggcaacttttctatcataatattagtcctacttcaaaccaccaataataatcgaatacaatagcagctaattattggaccttattaagggccatgttaagccctttatacatatcaagtgatttaattctcacagcaattctgtaaagttattatatttacggtctccatcttacacatgaggaaattgatgcttagcaacatgaggtaactttctcaagaccacatggctaaaaagtggaggcatgacttccagctacagcactgatatagaatatacagtttcagatgataagttttagatgatgcttttaatggaaatttggtgacatccatacaagttctcgtcttcatctttttgccttttctttttccatgggattttgagtgaggattttcatcttcaaagatgttagagacagaatgttcaaacactttaaaaatttaacattaatttaaatttataagaaacctaaaatagctatttcctcaagttgttatttccaactctccaggtggactccaaatcactacgtaatcatcgagaaaagacttttattagatatgttcctgctgggtttagaaaatcctatatcttctgttgatacagcaaggtcagcaggaatctttaatatttacaaaatgaaaggagaacagctagttgcaaaaacttcctagtgattccattcccctaaccctaatctcaagggaaagacagcacaactgtgttacctgctgtgaactttgcagctacctgccatacctagacaccagtctagggctacacagcccctagtaggatgatgcactcgttgatgctaaacattgaagacgacctctccagactctttgttcttttatggttttttgttttttgttttttttttgagacagagtctctgtcacccaggctggagtacagtggcgtgatctcagttcactgcaacctccacctcccgggttcaagcaattcccctacctcagcctcccgagtagctgggactacaggtgcgtgccaccacgcccggctaatttttttttagtagagacggggtttggggtttcaacgtgttagccaggatggtctcgatctcctgacctcttggtctgcccgcctcagcctccaaaagtgctgggattacaggcatgagccaccacgcccagcctgttcttttatgtttcttaatctgctgactcctgccttgcaaacagaccttcctacccccaccacctcagatggtggtgggtaaagatgctcatgcgtcttgctaaatcatcccttaggacattagctctcaaactgccacttctagtgatctaacattgggcaagttacttgctcgtcatgtgcctcagtttcctcatttgtaaagtgtgaattactatactactgcccccagagttgttataaagattaaatgaaataacaattagaaagcatttataccttgtggcacatagtaagccccataaaacatttgttgaaataaaataaccaagtgatttgagacactaataccttgcagctgccgcataagtctcactgtaaagggcatgatgtttttgacaaaaagccatcatggagtgctttgttagagtcctttcaggaaatggaaaacacacttggaatttcaaagggaattggttacagaatgtggggaggctggaagactgaagggggaaattccagaaactcaggtaaataactgcaggaggcagctcccaccatgagctctgccacgatacctgctgccgccttggagaagggacagtggcggaggatgctacctgaagagctgggatagtgcaagaacatagccacctccagagacactgccctgaaatggaagaaagataaatgagagcagaaagccagcagcttctgtcctcctgccaccttctcatccaactcctgcaatgccttgactgacaggacctagtcaagaggcctatgggatatcgtttgcaactctgggccccagcattgcaaagtagagttgagataggataaaaacaaccacaacacatggagcaaaagctagatagacacaggatcttttttaaaagagagagagaggaaagggtcaaagctttacaaaggtagtgtgagtgcaagaacaggaatcaatttaggcttttatagaagtaatcatggaaccaatttattctcatgccattgtaatagtactatgtaaagtagccataaattttttaatgatctgtgcaattagagactccagtatttaccaataagtctgtctgacaatcagtaatgcattccctggtactgtgctggttgtaaatactcatagaaatgtcttagctaattctagacacatgggatagatctttagtttgagaattcctcaaagaggcttgtaagcttgaggaacccaagtgagactccctctgataaggcaggtgacacagtttgggagcagatagccatcacccatgcccttacaaaacatttctgctttattaccaatacatcatttgtgaacccaccacccctgcaacatcttatctgaatctttcttagtctggagcaaacacagaatgaggggaaaatgtggtcacattctttcattcttagtaaagaaaggatttagtcaccttttcccaagtgtcaagaaatgaagtcatcaagcaaatgataccacatgtttagagaagcaaaaaccttccttattcttcagtctcttgaaagaaggatattccattttaaaaatcaaaaccattatagcattaccagtgaacctgagtggtgtcacatctctctccagttgtggctgaggcacatgctgaaaaagttggaacctggctgcgagtgatggctcatgcctctaatcccagcactgtgggaggtgaggcaggaagatctcttgagcccaggagttcgagaccaacctgggcagcttagcaagacctcatttctacaacaacaacagcaacaacaacaaaaaacacatctgagcatggtggcacgtgcctgtagtcccagctacttgggaggctaagatgggaggattgcttgaatccaggagttccaggtttcagtgagctgtgatcatgccactgcactccagcctgggcaacagaggcgagaccttgcctcaaaaaaaaaaaggaacctgcagaagttttataatatgcctgttagtttagtttttcctccccacccccagaaaaaaaaaaaatagaagaaaaaacatggatttacatcacattagtctgcacctggattttgccagatgtcttttttcctttttgacaaattatagaattacttctgaagtgattagcttttcaaatgatccctcatatatttctgccagggcaggaaattgaagtgaatttttcagatatctgacattatatgaagaataatttaggattcagcattaattcaaagaacattcacattttttgaggaattcatgtgagataatatttctgggtactttttgtgtgttactaagatttttaaatcgatttagtttatggataaatcatattgccaaaaaaagtgggaaaactgttggccaatttttgaatattttaactgacaaaaaaaaaaagacttctttatccattctttgcctcttaattctggaactaaaacactacatctttatttcccttgacttaaaacactagtgctatgtctctggaagaatggtttgctggtagtggatgtacctttgtagacactcttcaattctctgccctccttcgtggagcctctagagaaatgcttctcagtgtgactagctcctacatcagggtacctacctctagaaatggagccctgaagtctgcattttggcaagctccttaagaaattcttacccacactaggatataaaagttctttggaaataaactcttctcccctctctgttctttctgagtagtgaaacagcacctgtctgtggttcagctgagacacagctggactctctgaagaaattaagaggacataacatgtaatgccagaaatataaaaccatagcaaagtggatatgttttcagattctagtaaggagaacaggacctcagttcctttctcatacttcagacatgcctggacaggccctaagcaaaagtgactttttgccttaaaggtgttaaaagaaaaagttcagctgaattaaattgaaaggagtttacttgagcagtgaacaatatgtgaatcgggcagcccccagaatcatatagcagattcagagagactccagcgccgacacgtggtggaagaagatttatggacggcaaaaggaaagtggcgtgcagaaaaccgaagtgaggcacagaaactactggcttggtcagagctcggcgtttgccttatttgaacacggtccgaacagttggctacatctgattggccaagactcagtggttggcacaaatgtaaactatggttggtttacacttccgcttgttgtatagttatcgatgtacagaaaaacctttaggccaaacttaaatatgtaaggaggcagctttaggctaaacttcatttaacaaaggtattttaggttagcaacacctctgggaaatgcttcagccagccccaaacctgcttcccagtgtggttcctctgacctgaagccaacatacatttctgcccagcagctattcgtgacctccctgagtctacagagatccttggttctgtagtcaagcagggtaattctctttcagattccttggcctccactgactccccctctttgcttaaaggtcagtttggtccttctgagccttgagagtccccctctccaccctgaccatttcactctgctgtttgctttgtccacgtgacagttgcactcttgggtgaagctggccttatgcaaatttcgtctcaccctagagagcccctggccagcagcctcacacagggcagcacccttcccaggagcttgtccatacccattcagctgccttccctgccatggcctctcttcgagacgtttccctttggcccaaccactgtatttccatttgccttctgagcctagctcttgtgttgtgtacaaagtagtgttccctgtgtgggcctgggatctgtaacaggtgaacttccaggttcatgttaccagttctggccatgtctcctccacccagaggtcctctagctggggggtctgcaagaatcccaagattcatttttgtttctctgatatgcttcaaacatacaggaagagtaacaaacaatttcttccaaggcaagtagaaagttggtcccgacatcctctgtttaatccttctgttacctgtggagtcatcaccacagtagtgagccttatctcctgtaatttaaatgacttgttgatttgggagggaaggaatttcactggggaagtccactaacataaacctgctgctgaggactcattcacttcacagcaccaagctggcccagcctccccacagacagaccaaacgcctctaccacaacctgcctttgcatttagttcatgatagttatgggtgcaggagaattaggtaagtgtaaggagggaactaggagacaatgttaaactctccattcagaataatattaatctaaaatggaatcatttaataacctgttttcaaggataaagtaataaaggtgacatgtgtaatgaagtaatggagctcattatttttccagccagccctattaaaaattagtgtgtggaaggtcacaaataacttaaaaatgaccagatttgttttcaaaatgaaggatttggctataatgcaaatttcatcctgaaggctacatggggaaaaaaataatggtagagtttctctgtcttttctttcattgcttctcatcacactggaagaatggttcagactaagcactttgtctgggagaagattttttgtcttttatttatgtatgagtgcatttcagttggtgtcctcctaattccaaccaccctcacctgctgctttctgtgtggtcactgagttgtgacaggagagaggccaggtattcgaaggccaggtcaaagctcatttagggaaccggtcgagccttcgccttttccctgttcaccctcctgcctttccaacctaagtggtaaaactcatcctgaaagaatcacggagctttggagatgagagggaactttggccatcatgtcatccagcccttttatttattaaaaaaggtattgattgattttaaaatttataaattatttttgtaacaaaactctatgcccagagtttaacaaatagtcgtgtaacatgtgttaagaaaaagagcaagccgtagtccacctccccctacgtcttcatgtgcaatcaccttcaactctttgagctgattcctttggcaattactttggtttttctaaataacatgcttatattgttattgcttgatctattgggtgtaggcattagctaataactgcccactatagaagacgaagatttagctgtcttttctccacccgacacataccacgtatgtgtactgttcccaccccctcctcctacacccttccagtttccctgtatagttacatcttgactgtagtccgatcgatattgagtgttttattatggctttgtgaatagtgtcatatactatgtttcagtttcctttcctgtgtgactttttgtttttattgtaataaatgactgccttgttcttcggtttgcttagttttctgtgtatttttccttaatagaaccctaagctttccaccagtgtcttcatttcttctcaaaccatttaagtgcatgaggttctgttccttttattgtcttgcagaagtttccgccagacacttctgaccagcctggactgaactggttgccctctaggacctgatgtacaaatgttactttggggcctctctgctccatcattctggggattctagtaacctcttgtctgtatcagttccgttgtttgtcatctcctacatcttcctctttgcttcttcctctttcttggtttactccctcattttggtggaacacattttccagaagaaaatcctccagtatgaaaaatattcattgcaggcaaaatatttgagatcttgcatgtcttaagtctttattctaaccctaacacttgattgatagattaactagtatagaattctagattgcaaatattttggattttttttttcaacatggtgaaggcttggctccattgtcttctagtttccaattaccattgagaaatccagtgctgttctgatttctgatcttctgtaaatggcttgctttctttgcctgcctgtctgcctgtctgcctgcctgcctgcctgccttccttccttccttcctttcttccttcctttctttctttcttcctattattattattattattgcagaaacctgtaaactctttgattttctctcagagtctcagtatttcatgatgctaggccttggtgcaggtctattttcagccagcatgctaagcactcaggggaccttttcaacctgcaaactcatgttttgagtttggggaaattttctaaactattttcttatttcctcctctctattttctttttcctttttgtaattccttttatgcatacagaatatcctggatttgtcttccaattttctctacttttctgtcttcagtcccatctatttatgtttctgtcctagtttctgagagatttcctcaacttcatctcctaatccttccactgagtttttaatttccattaccatgttttataagaattctttttttgttcgctgagattttattttttagcaatctttccttttttcatgattgtaatttctcttttttcctgaagatattaggattatgttttttgttttgccctgaattttgtttcttctccctttttagtctcggttttcatccaggctgcctttttctctttgtagtctacatgttctatactggaggttttcctcagatttttggaaatcttcatttgtctgctcaactaaggcttgagtgggagactagaaaactgattagaggccaggtgtggtggttcacacctataatcccagcatatttggaggccgaggtaggaggactgttggagcccaggagttcgagaccagcctgggcaatactagtgagaccccatccctacaaaaaaaattaaaattagccaagtgcagtgacacacctgtagtcccagctactcagaggctcagatggcttgagcctgggtggttgaggctgcagtgagctgttattgcaccattgtactccagcctgggcaacagagcaagactctgtcttaaaaaaaaaaaaaaaaaaaaaaaaatccctgactggaaacttaagcacttgagcagagcttgttgaccagcaagctattgagctggtcagactccctataggagatgcttccagtttcttgcttggaggagaaaggcctggctgtcagccttctgggacatctggcaggaacaggtgtcttagcatctagtatatacatatttacttcctctctttcttttacctcaattgcttctggtgtccctgggtccacacatcctgttctgtgttttccgcagggagaaaaaaaataaaatcctccagtcttctgttggaatggggagaggtttttgcctggctatatatttctttgcttttcccagtggtagctcaggattttcctctcaagtttgctaaattgattactacctgttcatatgcctttcagactcctaaattttgtctctcttagcttcttccaatcttctcccctctttataggtttatgtccttttttaaccctttattgtagtgtagagggttgagcgtgtctgcaaaattagatgagatgtgtttcatctgcctctgtttcttcgtctacagattaagagaggcccagagaactgctcagcgaagattctaaggtttgcagcataacttaatagcaaaagtggagctaagacctacaattcctgactccttgttcagggcagcctctttcaaaatagacaaaatcattaataatgagttaatccaaaatcagtatgtttctgattgtgtgtggacaagttgaaaaggctatttttcaaagagttctttgtatcttagctttgattggtatctcatcatgagacagtaaatcaggaaatgaggacttcccaatgccaacatgccccatagacaagccccacatgagagaggactagcgaaaaatgttgatacgacagcagtggctgtgctgttatactgctccaagtaactggagttgcaccagatctcctctacatgtgggaacaaacagggttgcagtcaaatacccaaatttcactggctcttgccccatctgctggggggcaggtccatggtcaagtgctgtccaagtagatctgtaagtccccagaggtgtctccttggtgctcacaaacaagtccaaacaagatgctagaaaggatggaaaagatggaaaatcattgcccttgagagactataatatttgtataaatagtcacaatagaaagcaaatggtattcaatgaaaaatctacacaaagtgagttaggcagacagagttaggaaaaatgacttgcctggagctgtgtatgatgcctgcagtaaaggaagagtgctacagggtgaaaactgcacatccctgatcatattgctcattgtccttggcataagtgctcagaaaatgtttcataattatccacatgcaacatttgagatgcccatgcttgactgaaccaagaaggcattccaaaagtgacaatgttgcttcataaagggtttaatttcaggaagatgtacattgatcacttttatttgtgtttgtaacaataattagtacatctgacttttcaagtgcaaacagatgtgttgaactcatcagcccaggcactgtgagagagagcagagctccccagtttgctcttgtcatttgtcccgtgtgtcattctgtggttaagacagatttaaaattcatttcctggcctcccgtgacatagaaacagttcttaataaacaagggactcccacataaagccctctcagtgcgatctctggaaaagtggggaactggatatttttgtttaagaatacacagctctcagatgtaaccagagcatggcacttctttgccaaaacaggaaggtgggtcacctgagagctggcctcgggttaaaataattacatgagttctggggagtggtgagagcttcatatttttatagcacttttatagtaatatttatgtagtattttactgtatccatatggaagatattttgtatccaatgagttatgactaccattaattcatgcacattctttttacatttttgtttataataatcctaagaactatgtctttgatgtgtactgtatgcaatgtagtcagccaagagctttacagatattattttatttaatgcacccatcaaccctctacggtaagcaccagtggagctgacaaaagggacttgcttagaaacattaatgtcaggctcatagaaaaatcaattattgccaaggtcattgtgtacccaaacctaagaccatataaaaaacataataacttgacccataagatgaacttctagataaaatgaaacttttttccctaaaatctataattcttcaaccattatgaatgtactctcaaatgcatcgtttgaaacattcctataggccgggcaaggtggctcatgcctgtaatcccagcattttggaaggctgaggcaggaggatcacttgagcccaggagttcaagaccagtctagtcaacatgggaaaaccccatctctagaaaaatacaaaaattggctgggcatgatggcaagtgcctgtattcccagctactcaggaagctgaggcaggagaatcacttgaaccccggaggcagaggttgcatcagccaaaatcgtgccactgcactccagcctgggcgactgaggagactctgtctcagaaaaaaaaagaaagaaaaatttctatgtttggatctcatgaaatgtgcctgtagttaatcaggaagtggccccattactgacaagaaagaacacgagttaaatagcaaatagttctgtcagtagaatcatatgatgtgatttgggctaagatcagtattttttgcatattcatatgttgctagagaatgtatgatatcttataaatctcatcactttccattgacaagcagcattgagtccaagttttacttagaagtgcattcagccaagtaacaggtaagtatggcttaaactagaacttttcaacgtgtatggtgaggcccattgatgagccacaaagagatgtgcagagagatatgtatcccctcaggcttcaaggtagggaggagtcctggggcagctgaagcccccagcatagttcacctcaggtgccagcagtctcctctgtgttccccagagggcagtacaaatattaccgcccactgtgattgtcatgacacaaaaaagatgaagaagcaatggcttgagatagaataaaggatatttgtcatttacttaaagtccaggtatatgcagtctagggtgggtacagctgcacagtgacactcttatgtatccaggttctttccatctttctgctctgccatgcttcactctggtttttgcttttcttgtttgtggcctcatagttacaagatggctgccatagcttcagacatcacgtcctctctccagggacttctgcaggaaggaaatagaaaaagaaaaaaaaaaaggtggggagggagaaattcctcattgcaaggctttttatgggggaggttgcccagttgtgcccccagcagcatcctctcagcagctcatggccagaagtggatcgcatgactctagctgcaaaggaggctgggaagaggcctacctcccctgagactacttcagaggagagaaagatatctttttttcacccatcactaggttcatgcctataacccttataaaagaagacatattaacaagagaaaggcatacaaatgcatttaatgttttatacgacagaggagctttcagaaatgaagacccaaaaaaacaggcaaacctgtgtagttttatgctagagttgatgaagaagtggaaagtaagattggctgaagggggtatgatctaatggtaaaagactggtgaaacttagcaaggcttctttgtttagattggtcaccatgtccctgtgtcttcagagataagtatatttccttcctccagttatagggagggcacctcttaagtggggtcttacagcctactacagaggcaggccagaggattcttttattgcctgcttcagggaagaagggtgagagaaggtcagagagtgaccttcctaggtttattacctgttttcttttcttttttttttttctctttagacaaggtctggctctgttgcccaggctggagtgcagtggtgcaatctcagctcactgcatcctctgcctcctggctcaagcgattctcccacctcagcctcctgagtagctgggactacaggcatgcaccaccatgcccggctaatttttgtgttttttgtagagactggatctcaccatgttgcccaggctggtcttgaactcatgagttcaagcgatccacccgccttggcctcccaaagtgctgggattacaggcacgagccatcacaactggccaaggagctgttttctcaaatgctaagttgccatataatgggtagaatatcctgaatcccatcactacagatctccacctactacctaaaatcaaaacctagggttctgttagcaaagacaggacactatggcttttgtacaggcaccagtgattgtgccaaacacagactgtaagggaaaagccagaatgattttttttaatgaaacatattttctgcttcttaagtaattgtttagactctttaaaataccacccaccagatcatttacccctcaaactaaaagcctgttctggaaatggatttgaaacagagcatcctacggacaagagagcggtttgtgcaaatcttagagaaatttttctcagtattcatttttattgagacatccaagcagcattcatgattttgtagctcttgagttataaactagatataattctttgctttttttctcctattcaatcgcatacttagacattaatatttttaattattttttaaattagatgggctctgtggaatgttgcatgagatgcctcaagaatcaggccacagtgttggaaagttatcataatgcaaacgtctcacaccacaaattttaaaaggttaattttttttggttcaagcagtattaactttggatatttagaaggatttttttcacatttcctcagaattggtgacagagaaaagtattttatggtattgcaaatattatatcagaaatgtatggcactgagaggagaaactaagtataatcgtcacctttgatcaatttataatttttagaaagttggttcatagtactcccaatattgacgtgtaggaaagaaagaataagaaagaaagaaaccaccatttccttgataacttgaaaaatcatagatttgaatgacagaaataattgtgaaccaagttccagtctataatgaggaataaactttttctgctttgtgaattcattttctgattatgaaaattatacaggaactttatgatagaggaaatttggaaaagacaatggttattcttaattccactaccttaatacaatcattaatgcctctgtaaaccccatcagacattttcagatgtgtgtcattcattatatgattgtaatcacagtgtgattgccattttacattatacatatttctatggaacaaaatactatattctcttcatatttcttttcatatttttctaggttttatttttatgaaagtcaaatagttcttccaggactattattaaaaccaccaaccccattccattccccacccctatttcctcctcaccaaaggcaaccacctttttcatctgatttttttagttatttctctcaacaaaatacttgagttgctatttccagtttttttgttctcactttggaagaggatgatatagctcccttttatcaccccaccttcacagtaacccttctcatcctctctattctccaagtagagttgcatcataattcctattagattgtaatttaccttatgtcataaacatattcgcaactgtgccctgttgtaaagtttcattatatttccttatacttttccccaaaatgatgttccattctgttttctttagttgtctacatatttattaataattgaatctcaaactctttaaaatgtctaattggttcagacgcgtcggatatttcagcagagttactcaactgaataatctctccccagagtcttctgaccttgtctagtctgctaagtttggtgcacagatgttatcctgggaacttctttcacctttgttctgggaattcactttgtctctaaagttggctccactgcttcatagtgtttatatttccctcttcttggtttagtcctttgtttctgcagagcacatcccccagtatctttttgagaaaaggactcatgggaagttaattttttgagatcttgcaagtctgaaaatgtctttatgctaacgtcactcataagaaatagtttagcaaagtatagaattttatttcagaagtggttttcaaaggcattattccattgtcttcaggctccctaagttgctgttcagaagttcagatttatccgtttcctgatcatctgcatgttatctattttctccccatctctgaaagtttaaagatgtctttttcttaattgtcttggagttggtcttattttcatctgtagtaaagcattgtattcagtggaccttttcaatctgcatactcaagtctttcaggtctagaaaattttcttttttcctttttggtctttttttcttaggtctaggaaattttcttgatgatttcattgcctctgttttttcttttctctgtgtatctcctcatttgaaaattgaagccgctagactagtcttctacgtttctgttgttttttctctgtctcccatctgtttgtctttttactctattttttgtgggatttcctcaaattttcatacagccctctaattcaatcaattctactgttacgtttttactttccaggacctcttcttgtcctgataatttcttcctttagtatcccgttcttttatttcatagttgctgtaacttatctgaggaagtaaataatagttggggtctaagggttttttggcattttctaatccctgcataatcttaggttattctagttagcttttttcgatattttcgatctcttttacaatagtagcttctctcagatttctcataatcgttggttgtctgttcgtacttaaaagcgtgtcaccggccgggcgcggtggctcacgcctgtaatcccagcactttgggaggccgaggcgggtggatcatgaggtcaggagatcgagaccatcctggctaacaaggtgaaaccccgtctctactaaaaatacaaaatattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaagcgtgtcaccacaaatctatcaagacagaaagtaagttagcagttacctagtgctggggattttggggaaatggagtaactattaatgagcacaattttcttctcgaggtgatgaaaatattctaaaattggttatggtgatagttgcacaactctgaatataccaaaagccattgaataatatactttaaagcaactaattatatggtatacatatgatatatcaataaaactatttcaaacaagaagtggggcactaacaaaatgattaaaagttcaaagtgcgtggctggggcttgtcatctgtgggtttcactgtagggcgatttggctgggctgtgtagttggggaaacctggtatttgtctttcttcttgggttgattagatccccagaaaaggctctaccaatctttccagcctggatgataaaggctggctgtcagcttgatggaagccgagttggggaagagaccgtctctgaatctggcaggctagtaccctccttatctccttattttcagttggtcccttatccttgtgctgtgactaatgatccccaatctagagaccttctgttccacccactccggagaataaacctccattcttaaaatagggttgagaaaaggcagttgcatgttggtagaagttttgggagatgatttacctgctgcttaaccagactttcaaccacagatacttaacttagctgcctcctcttaccccgacacatgctatttcatggattcccaatgcttctaattcttcagccttttgagagttttgtgaatcaagtgtgttctaggcttttccctcatttttatgagtttttagaaaagaagcaaagtgggaagcatgtgttcacaccatttttacctgaacagaaatacatattttgctctctccaattattcaaggtcattacagtatgaactatcaagatcatttttttaatttaaaatactgatttgggaaaaaaaagacattaaataaacatttccttgtacacagaatactcctgttttgtgtaaaatcaaaagatttgagcacatttatcccctaactaaaggcagaaatgttatttttcatatgcaagtagaaaaatcaatcctctctgaattcagagaactggttaaatgcattcaaaatcataagacttatgattagctgttttaagatgaataggtaaagtaagcttctggccaagtcatgaagcatttctttccctttgcaaatgatttaaagtcctcaaattctgactgcctcataaagaacagatagattttattgttgttacttgctgtagaaaaattagaggtttactaattgctttacctactcttctcacatggttctttgattttaagggagtcattcagtccatctagactgaatttggaactcagagaattaaaattatgggcagggggacagtggccaagcttactattctttatgatacttgatcttgcagctgacttaattcctgttttcatttctggtccctagagctgcaccgatattcatttcatatttcttaaaggtttatcaggtaaataagagagagaaccattcatagttaacagcacaattgtcatatatattgacaacttcaaggcaattctaaattgtctccttctctaatgaaaacatttcaatatgacaaaaaccttgatccaaattctgcttgttaattaccatgatttctaagatctccagtctctaaaaccttatgattctgtttctttctcaacttaaaatgccacccttcttttacttttgaaaagaacctttatctcattgcatcgatgaaagaaacttatatttgatttagattattactcataataacttgacctttccaaagcatcacagccattcagaacaagctacatttgcagcatctcaaataaaattgtgaggactaatgtgcaaaaattattaacaggttcaagatggcaacatcagagcattaaactaagcaagcagtcctgtgtgtggctcacacctgtaatcccagcactttgcgaggccgaggcagactgatctcttgagtccggaagttcaagaccagcctgggcaatatggtgaaaccccatctctactaaaaatacaaacattagctgggcgtggtggtgcatgcctgtaaccccagctactcgagaggctgaggcaggagaatcacttgaacccaggaggtggaggttgcagtgagctgagattatgccattgcactccatcctgggtgacagagcaagactctgtctcagaaaaaaaaaaaaacaaaacctaagaaaggaaccattctaagcccaggaatccatgcagttgcataggtcacatgaccctgtagtcagccctgaaattatctgtagaaggaagacacgtttgatgtccctgccaatgataatttgctttggttcagctgttacggtgactaacacttccccagatcagggacctttacaatggtagtgggggcattcattatacagtcattgcctgaaattccacatttcaggtatatcctgagttaaatcacacagctattacactttagacaatagatccttcaaccgtgggtggtcagtattgggtggtggtgacttcaggtgctttcttcctgctctgacagtagctttcaatgggtcaaattcttcaagccaaattaaatgaaagcttgagttctgatccacagagaaaaagaacttgaataaatatatatctcctatttctaagctcccgacgttttgtaaagctacttaattttcccccatctcacttgtttttcagctcaatccatctgagcacctgttattcatatcagaaggaaatgaaatcaatagcattttcttccccagtggcagtctttaaacttccttctcttttgccagtaagtcatcattcttctttaagactgctgttgtatccaggcatgtccaagatttccttatttgttttgaactttgaacctgatagacacttagaaattcacgtggttccaccctcacccatagagcatgttatactatcacagtggactgaaatgtttcttaagggtttataaaaggatgattatgatgccattaagagaagtaaaggcccctaagggaagtaaagagctaatatttattcatcatgagtaaacatccgatcttagctatctcagaacaggacatgtattaatacattgaactttgaataaattggcatctcacttctgtggttgccttgctgtgaagggtactctcctgggtctgccacaaaataagcagaatccgacccaggctgacctgactccccatatagcccaggaagctgatgagcctggcatgtcagctcaggctgagaattcttctccccaagaaagcagaatcaaaacccatgcatggaagttacaaagaaaggattgttctatataaggaagagtttaataatgtggttaaagaagaaataggctaccctgaaaatgctaagcctctcactgtagctgagcagccatctgggaagactaccgtagaggggagagaaatagcacagagctttttaaactagaatgcctgtaggtttccttgtaaacgctgcaattctggaattctcttagctcccaagaggaggttgattgatcacaataaatacagagcctgatagacggaaaaataagcctgttatatgtgtacaaaccttctctccctttccttatgagcaaagtgaaaccagacctgcaggcatgtggccttatgtaggcctgagccttaagctgccaccatttggcaggatgtgcatcctttgaggaaattgtaaggttatatggccatggttttcagcttggacaggtaacctagcatagaagctttcgaattagaatgccactctgctgttgaccagctacactactttacctccctgcaccttaatcacctcatctacaaataatatcgacttcacaagattattgtgaggatgagataagaaaatatatatgactagtacaatgaatagaatatatataagatacatattctatgactcaattagttctgtgatttaatttgaaagtctaaggtgaagatgggggcagagggtgtccctggaaaggctaacgttctaatagagtttaactcaccattgccacttctgatggatagtctagttctgcaagaccaagcctttctgcctgaactctagtacctcaatcacaggctgggaatgacttaaggaaacgaagccagttccaaacgctaacacacagctgtcatacagattttgtcccacaaatgaacaatgatataaatgtagtcaatcttaaacttctgaattaactgtaaagtgatacaagagctttgtgtttaaggatgagaaggttcagcctagttcttcagtggttccatacttaaaccatccaaaaatacaggtatgtatccttatctattgaaaagaagaaaaggcagcggggcgcagcggttcacacctgcaatcccagcgctttgggaggccaaggcaggtggatcacctgaggtcaggggttcgagaccagcctggccaacatgatgaaactccgtgtctactaaaaatacaaaaattcgccaggcatgatgcatacctggcacatacctgtaataccagctattcaggaggctgaagcaggagaatcgcttgaacccaggaggcggaagttgtagtgagctgagattgtgccactgcactccaacctgggtgacagagtgagactccatctcaaaaaaaaaaaaaaaaaaagctatttgtattcaaaaaacaaaacagtgggggtgtgtcagagggcacaggagctgactgaaagagctctcaatagctaaaattggaacaatttgagcaataaaataacacagttttgagttataacccaaagaataaatatccaagaggccatactaatattaatatatgattgaataaataaataaatggaggagaggagacaaaattcccatacagaagaattccaaatactgtatgtagctactccaccctgaaggaagtggaacacaacaccccatcccttaagcgttggccacacttagtggcttgcttccaaaaagtacagcatggaaagggaggtgggggtacctttgcagtagagaagcctggtaaacactacctcagccaggtaatcaaggtaaacattatcaatgataagtcatgttaatagtgcataaccttgacttaatatggtacttgacctctgtgatcttccttccaaaaacttacaaataccgtgtctaaccatgagaaaaacatcaagcaacccaaatcatgtgggacattctgcagtatacctgatgagtactcttcagaactgtcaaggtcatcaaaaacaagaagtctaaaaaaccatcacagtctatgagagcctaaggagatgtgacacctaaatgtcacatggtatccagagtgggactctggaacggaaaaaggcattaaggaaaatgaacaaaatctggatatagtatggaggttagttataaacaaaaaggcatgggtgcttcctctttcaaaatgacattacagaaacctgtaccacaatcatgcattatagtaacactttgttataatgtaaatgttgggggattgtgttctaaaactgtctcttgaggctttacttgaaatgatgggaaactcagtatacagctgtatgcagagaagatgaataagtaatctgtcaaatattaataccatgggtctttttgcagctgggtttaactatgattgatttattatgcagatcacattttcacctgccatagaatcccaatccatataaggttgaatatgtacaattttgaattttatagttcaaatgtcccagtttccagaatttggggttgggtaaaagttgtttttcatgcatatgtgccatttttggatacctgtggtagttgtttcaacctatgaatgaatcaagggcactgtgggaataaactacttccccacatattgtagctggacttttttgtggggacctttatgcaacctaataaatgatctctcataacagattgtagttccttgatgctccaactgaggagttttctagagcttccttccttgggtgagaatagtaggtgaaggtcattgctatagacaaacagaactccatcaggctgggtcctcaaatattttggcatatgtaacaactctgtggaaataataggtatcagatagagttctctgcttacaagcaagagaaactgaagtagcaaaggaaatcatgaggaagctaagaattagttcacataatctaaagaaaaacctcaactaccaagccaagggaagaatatgaaatacagcagctcagaggattcaaccattcattgagtaatatttatcgagcctctaccctctcccagacactgctacagggtgagaatccagcagttcagggaatctgtcacgccatgctttcatcaagcttgcttctagacaatctcagactcagggacagcatcttctagaagacattctcttcctctgggaagcctgagactcatggacatactggtgttattacttagctcctaccacttgacattcttcatcacactgcccaaggttcagatttctctgagagtatgatgagcctacattgatgagtcaaaggctcacccccatgggggtgaggtgctctgatgtgcattcccaacaggactacacagaataccagaaggattgctccccaaaacccagtgagctgctcttaccaacagaagaaaggagtgctgagtgggcaaaaagttcactataatttgtattaatagtgtgaagaaagaaaagagaagactcagatctggctcagaattctgattaaagctatttatgttagtataaccttgggcatgcttccacaatttctctaaaagtccctttcctcatctatataaagtggaatcataatccccataccatagaatcgttttgatgtttaaatcaaggatcaaactagctatttaaggacctgttctggggccaggcatggtggctcacacctgtaatccccgcattttgggaggccgaggcaggtggatcacttgaggtcaggagttcgagaccaaccttgccaacatggcaaaaccctgtctctactaaaaatacaaaaattagccaggtgtggtggtgcatgcctgtaatcccagctactcgggaggctgaggcaggagaatcgtttcaatctggaggcagaggttgcagtgaaccgtaatcagcctgagtgagagagcaagactctgtctcaaaaaaaaaaaaaaaaacctgttctaataactgcttaataaaaattagttgtattttcacacagttgtgaaacatagtatctacagattattttccatgcatttctagcacatgatatttcaatacattctgctcttttttttatcttagcatgaaaatacttgtagggtggacagtgtgttaggatccttgtttatatatatatatatatattttttttttgcatgtgttgactataaagttttgcttagtaaatgtcacatcagccacttcaaaagaggcatcctatctcagctcccagttatgtctcatgaaagactttaagagtgaaatctccaagcactgaacctctccaagattctctactggatttcactctgcctgtcttgcctgtgtcatgctgggggttttatttgtagagggaggcattgtaagggaggttatatatttactatccagacaaacctgggttggaaacctgtgtctttgggcacagtgcgtagcttctgagggcctcatgtgcttcatgtgtgcaactgggatgttaatacctaccctgatgggttgttaaaactgtaaatgaggccgggcgcggtggctcatgcctgtaatcccagcactttgggaggccgaggagggcagatcacgaggccaggagatcgagaccatcctggctaacacagtgaaaccccgtctctactaaaaacacaaaaaattagccgggcatggtggcgggcacctgtagtcccggctactcgggaggctgaggcaggagaatggcgtgaacccaggagccggggcttgcagtgagccgagatcacgccactgcactccagcctgggcaacagagcgagactccacctcaaaaaaaaaaaaaaaaaaaaaactgtaaatgagataatgtatgtggcaggctcagagcctcaatcaagggaagctattactattattaggggtgctgattgtgtcatcatttgatcgcaggcacagtatgcttggaaatgtagaattttttattcaacagtactaggggaagaaaaaaaaacacagactcagatttttaaaacaagactttgccatttataagaaattgctagaaggcagaagaaaaatgctcaccagcccagagtctaggaccacccattttcttaataggtcaacattgtgagatatcttctgtacctgagcacatcctcccacccgaggcccttccgggaattgctttatgatctaccggaaagagagccctgttctcataagtaaacaaacttcagtggggaagactgataataaacattgaagaaaggtcaaatatacatttggaaacaaggggaatcagtgtttgttcagaagaacaaaagagaa

SEQ ID NO: 171 - DNA, 76423 bp, Homo sapiens
tggggttctaattcatggtctagcattgcactattaaataaccactaatgacaagtagttttacatgcattcacgtgaaatctttctgtttgtttgtttgagatagggtctgcctctgtcacccacgctggagtgcagtggcaagatcttggctcactgcaacttctgcctcctgggctcaagtgatcctcccacctcagcctcccaagtacttgggaccacaggtgcacaccaacacacccagctaatttttgtagaggaagggtttcaccatgtttccctggtgggctttgaacacctgagctcaaacgatgccttgacctctcaaagtgctgggattacaagtgtcagccactgcacctggccgacattttttatttgtttagagacaaggattccctgtaaagctgcaggggcacaatcgtggctctcactgcagcctcgaattcctgggctcagtgatcctcttgtcccagccacctgagtagctaggactacaggtgcaccccaccatgcctcctattttttgtgtttgtgtggagatgaagtgtgttgtctaggctggtctcaagtgatccttcagcctcagcctcctaaactgctgagattacaggcataagcttttttgataaaggaaaaactagtgagcatttcacattgtagaatccaaaaacatgaaagttaatcttttcctgtcaatttacagttttgtaaatgtacccaggtgaagagactggtctgttactgtagatagaaaagtaccaaaacaaagttttactttgttcagtatactgtcgaggcaactttctaaatgagagggtccaggttcttggttaaagaaggaacttagaattaacaaaatagtgacaaacatttgcggcagcgcgcctcagggcaccagctgcaggggtctgcccacagaccctgaccctgcgacagatgaataaagtacactgacacacagatagtctgttttgccagtccagctgagggtgtcccactgcttacagactccctggagagttctgaaaacagttgcaactaggcctcagtcagctagtgagacttgcatttattcaaaaagattaaggatggcttgagtcaacaccattagagggtaattgatattgtggacttcccaagtaaaaagcacttaaccccccgtggtacatccaagattagtcttaagatcatatgactaaacaaactaggtaaactactctgccttcctttattactactttaatttgtttaaaagtaaagatcaggttgccttcaaccatatctatcaccgaagctatgcaaacttctcggccttccaagaattgtatctgtctctgtaacaatctttaatgtttttcccaccagcctgattgaatcccaacacatattcagaacttaaggctagaacaagatgaggaagatatgacagcccgtgattttaagcaatctaaggaaacccatgcttgcaaagaattcaaatgacgtgagagctactaagataaaatgtggccatgcaccaagccttgacggcaatatttaatctcataacaattcttctttcctcctatataagaagcatggcagcgacactgtgcataaattaaggcaaactgttgttatgtgaaaatgttaatgaggtagattcctttggaatcattagtgtgaagagctggtttttgttttcccattgcctaggccctgactttagtagtgactgatgcagcttttctagtctaacaaccctctcccccaagtaattctttgatgccctgcccttcagcttcatcttttaccacttactattgggttttgccaccatttattttatcattcacttatctgttcctcttcctaagttacaaacgtttctgaagcaaaagaaaatgtatcactgtagagagtctaggacctttagtgttatttggtcgtttacttttcatacactgcagcttttactgttttgaaccttcattgctatagtaggtattgaaaaatactgaacgaccagaagtgatttgatttctcccttatctggtaaataattttttttttttttgagatggagttttgctcttgtcgcccaggctggagtgcaatggtgtgatctcagctcactgcaagcaccgcctcccgggttcaagtgattcttctgcctcagcctcccgagtagctgtgattacaggtgcacgccaccacacccagctaatttttttaaattttttattatatatatatatagttttttgagacagagtctcactttgtcaccaaggctggagtgcagtgacgagatctcagctcactgcaacctccgtttcctgggttcaaacgattcttcttagcctcccgagtagctgggattacaggtgcacacaaccacacccagctaatttttttattttttattttatgtatgtatatatatatattttttttttttgagacagagtcttgctctgtcaccaaggctggagtgcagtgacgagatttcagctcactgtaacctccatttcctgggttcaaacgattctcctgcttcagcctcctgagtagctgggattacaggcacacgccagcatgcctggctaatttgtgtatttttagtagaggcagggtttcaccatgttagttaggctggtctcgaactcctgactgtgatctgcccgcctcagcctcccaaagtgctgggattacaggtgtgagccaccgcgtccggcctaatttttgcattattagtagaaatggggtttcaccatgttggccaggcaggtctcaaactcctgacctcagatgatccactctcctcggcctcccaaagtgctgggattacaggcgtgagccaccgcacccggcaaataatcctttcttttcttttttctttttcttttttttaatttaaaaaaacaattattaggcaccttctcttcagtttatgacagaatacaccttacccctgtttttgtaagcagacgtactctatgcatcccaatctagaagaccctctcccccatggcactgttttctaactacattctacagtttcttgaatgttgctcaggtatttcctttatctgctttctccctcgggtctggaacatggaggaacaacacaaaaaatttatcttagatcctatctcctttccattatactatcaagattacagaaatagtattttatatatgccctccaaatttcttgagtttcactcaacctattccagtttgtacttcaccattcctctgatggctggtgacagcctgtgtgagaaactgggcatgtaagaggtataaaaagaaaatcttggggaccccaaatcactaagctaaagggaaaagtctaggtgggaactgcttatggccaacctgcctcccattctattcagagttaccccgctgctcactgacatggatgcatatctgattgcctcccttcaaaaggctaatcagaaactcaaaagaatgcaaccttcatctctcacctatctgtgacctggaagccccctcccagcttggagtctttctgcctttgcttcaagttgtcccacttttccagactgaaccaatgtacttcttacatatgttgattgatgtctcatgtctccctaaaatgtataaaactaagctgtgccccgaccaccttgggcacatgtgaggacttcctgaggctgtgtcatgggcacatgtcctcaaccttggcaaaataaactttctaaattaactgagacctgtctaaaattttcaggattcacagaggctattccttagtttgtcttttagcaccatgtacatttcctgtcttcttgggactcttacttggtgtctaggatatcactttttacttgttcctgtagtctgtttttcccagtgtcttgctggctttcccctgggtgttcatatttataaaaagatgaaggtaaacagggcaacatagcaggaccttgtgtctacaaaaaaaacaaaaacaaaaacaaaaaaagccgggcaaggtggcatgtgcctgtagtcctagctacttggaaggctgaggcgggaggatcgctggaggcaaggaactcaaagctgctgcagtgagctttgattgtaccaccaccctccagactgggcaacagagtgagatcttgtctctaaaaagagtaacaaaaattttttaaaaatgtaagtttcatgcacgtccgtgtaaggagagtccaccagcaggctttttgtgagcaacaaggctgtttatttcacttgggtgcaagtgggctgagtcgggaaagagtcagcaaagggagataggggtggggcagttttataggatttgggtaggtagtggaaaattatagttaaaggggattgttctcttgcaggcaggggcaggggtcacaaggttcttggtggggagccccagagacttatccaggagaaggaatgtcacaaggtaatgtcatcagtgaaggcaggaacctgccatttttacttcttttgtggttcttctgttgcctgaggccatctggatatatacatgcagccttgggctcagaggcctgacattcctgtcttctcatattaataagaaaatcaaaacaaaatagtggtgaagtgttggggcggcaaaaatttttggggatggtatggagagataatgggcgatgtttctcagggctgcttcgagagagattaggggtggcatgggaacctagagtgggagagattaaactgaaggaagattttggggtaaggggtgatattgtggggttgttagaaggagcatttgtcatatagaatgattggtgatggcctggatgcggttttgtatgaattgagaaactaaacggaagacacaaggtccaaataagaggagaaaaaaggtattaaaggagtaagaattgagaggacctaggacatccagttggagaatgtccaagcgggttcagtgtaattatttgcttggttggcgagtttttgggctctatccttgagttttttttatgttgtcacataccaggccagattgatttaggtaaaaacaacgttcttcatttagaaatatgcagtcttcctttttcagcagtgagtaagttgaggcctattcctgcctttttatattaataataagaaaaacaaaactagtagtgaagtgttcgtgtcatgaggagaacaggaagctgtttggtcccattcgcaaattgaattttgggagtaaggaaaactagtgtgcatgtgcctgtccatttagcaggtaaacacatgtaggtagaggagccacagagcgataagagaccttgtgcaaggcaaaactggaaatgcaaagtgaaaagatgagaaagagtactaaaagtggtgtcttgtacccagactcctagggatccagctacggcggcagctgtcagaggttgtaatggggattgatggtgtaactgcgtagagggggaggttcgattttcatggtgtatgagaaagcaccgagtgtctatgagcaacctttcactgttatttatggggctgggcataagatgtggttcaggacttgtgttgggtgctaagtgagaagctgggttgaaatcaggcccatgggcaatagttactgttggagtttcaataaagagtgaatagagctggaggagttgaggggcagacagtaagtgtgaaaggtgtgagcaggatattaatgcttgaaggttgtgagaactgttgagggtaagtggagcatagcttgtgcttttgagggcttccagaggtattaaagcggcagctgctgccgcatgcaaacatgagggcaccccagaattgtgaggtcaagttgtttggacaaaaaaggctacagggcgcagtcctggttcttgtgtaagaattccgaccacacagttcagtacttcagctgtgtgtaatgaaaagggttgggatgagttagggagagctagtgtggggagcagcttctagggctgtttttaaagaatggaaagaggagtggggaaaggatttaggatctatggggtcagctaggtttccttttgtgagtttatataatggtttagtcaggataggaaaaccaggtatccaaaggcgaaagtatctaaccatgcctaggaaggaaaggagttgttgctttgtagaagggattggggttagggagattagctggacacgattagcagggagagcacgtgtgtttttatgaagaattaagccgagataggtaatggatgaagaagaaatttgggctttggagggggatacacgatattcctttgagaacagatgttggaggagcaggaggatgtcctgttgggaagatttgtaggaggggctctaaagtagaaggtcgtcagaatattgaataaggtgagaagcagatggacagaaagaaagtaaatcatgagaaagggcttgactgaagtaatgggggctgtccttgaagccttgtggcagtgcagcccagataagttgctgaggctaatgggtgtcagggtcagtccaattgaaagcgaagagaggccgggatgaagggtgcaaaggaatagtaaaggaagcatgtttgagatccagaacagaataatgggttgtggagggaggtattgagcataggagagtatatgggcttggcaccattgggtggataggcaagacaatttggttgataaggcgaagatcttggaacagcctgtaagacttgtctggtttttggacaggtaggataggagagttgtaaggagagtttatagactttaagaggccatgttgtaacaggcaggtgataacaggctttaacttttttaaagcctgctgtgggatgggatattggcgttgagcagggtaagggtgattaggttttaatgggatggaaaggggtgcatgattggtcactgaggaggaagcagaggtatcccatacttgtggattaaggtagggagacacaaggggaggatgcgaaggaggctttgaactggggaaaagggtggcaatgaggtgtggctgtagcccaggaatagtcagggaagcagataatttattaaaatgtctcaacctaataagggagctgggcaggtggggataactaaaaaggagtgcataaaagaatgttgtccaagttggcaccagagtgggggagttttaaggggtctagcagcctggctgtcaatacccacaacagttatggaggcaagggaaacaggcccttgaaaaaaaggtaatgtggagtgggtagcctccgtattgatgaagaaggggatggacttaccctccactgtaagagttacctaaagcatctgtgatggtccaggaggcttctgaggcgatcgggcagcgtcagtcttcagccactaagctgagtgggtctgggaaggagtcggccaaggaacattgggtttgagctccaggacctttaggagcagtggcgatgtgagtcggacagtctgacctccagtgggggcccgcacagacagggcatggcttaggaggaatctcgggctgtgggcattccaaggcccagtggccaggcttttggcatttgaagcaaggtccacgaggaggttttgaaggagcccctgggagctgtggcttggatgttatgaagtttttgtatgctggagacgtggttgtgggttgtcttacagcagaggcaagtagctgtaactcagagatgcgttgtcacttggctgcctcttctctattattgtacaccttgaaggcgaggttaattaagtcctgttgtgaggttgagggctggaatccaattttttggagttttttttttaatgttgggagcagataaaatgcatattgagaataagatggccttagggctgggcgcggtggcttacacctgtaatcccagcactttgggaggccaaggcgggcagatcacctgaggtcaggagttcgagaccagcctgaccaacatggagaaaccccgtctctactaaaaatacaaaactagcctggcgtggtggtgcatggctgtaaccccagcttctcgggaggctgaggcaggagaatcgcttgaacccgggaggcggaggttgcagtgagctgagatcgggccattgcaccccaatctgggcaaaaagagtgaaactccatctcaaaaaaaaaaaaaaaaaaaaagaataagatggccttctggcccttctgggtctagggcagtaaagcatctaagagttgttgccaaatgggccatgaactgggctgggtttttatatttgatgaaaaggagcctaagcactaactgatttgggagaggtcagataaagaaaaaggagcattaaccttgactgtgccttcagctccagccacctctttaggaggaaattgttgggcaggtgggggagggctagtcacgaaacaaaactgtaagccagaccaggtatgaggaggggaggtgatagaaggattatagggtgggggagtggaggccgaggaagaattgggacctggctcggcctggtgaggagcagcctggggagaaggggagaggtcagatgggtccgtagaaaaggaggatttaaaggactcagagcttggggtggagactgaaggaacacacaggagagaaagaagaaagatttggaacgagttgcattgggagcagagactagggagggaccaatgtgtgaaagaatgcctggatgtcaggcacctcagaccatttgcccatttttcgacaaaaattatctagatcttgtaggatggagaaatcaaaagtgccgttttctggctatttgggaccattgtcgaatttgtactggggccaagcagggttgtagaagaaaataaggtgttttggtcttaggtcaagtgtaagttgaagaggttttaagttcttgagaacacaggctaagggagaaaggggaatggagggtggaagtttgcccatagtgaaggaggcaagcccagagaaaagagagggtagagacttggagtgggtggtggtacttgccacccaggggaggaggtacttgccaccaaggggaggtggtacttgccaccaaggtgaaggatcaaggcaggcatccccgtggtgatcagacacctctgaaatgtgagtgaataatcaagcaggcgttcctgcagtgattggacaccaagggaaaactgtcttcccgagtctgtgaccaatgccagagttttgggtgcacagataaaatgtgtctcctttgtctctactagagaggaaaaaactggaattggaaggacagggagattaaagggtagtgagaaggctggagaagagagtgaaaaggccgcttacccaattttaaattggtgagatgttccttgggctgattgatgggaggacgcgaggtcataggtggatctcctcatgcagtgagggtgaggacaggggaccagtttcccgaaggagtcctcctgtcctgggtcttcagcaccaaatgacacacacgtccgtgtgaagagagtccaccaacaggctttgtgtgagcaacaaggctgtttatttcacttgggtgcaagtgggttgagtccgaaaagagagtcagcaaagggaaatgggggtggggcagttttataggatttgggtaggtagtggaaaattacagttaaagggggttgtgctcttgtgggcaggggcgggggtcacaaggtgtttggtggggagctccagagacattatccaggagaaggaatgtcacaaggtaatgtcatcagttaaggcaggaactggccattttcacttcttttgtggtccttcagttgcctcaggccatccggatgtatacgtgaaggcttgggctcagaggcctaacagtaggacataaagaaaatgagaagaaaattatctgaaggctggttattcaatgttagggtttgctatttttttaaaatcttactgcctttttgttgcaggacttttttttttttttgggaaaaacagagtctcactgtgtctcccaggctggagtgcagtggtgcaaactcggctcactgcaaactttccttctcagattcaagcctcagccacctgagtagctgagattacaggcccacaccaccatgccgggctaatttttgtatttttaatagagacggggtttcaccatgttgtccaggctggtcttgtactcccaacctcaagtgatcctcctgccttggcctcccaaagtgctgggattacaggcatgagccaccgtgaccaggcgttcatgaaaaattttcatgacattctgtgaggtgggtggaccataatttattgtaccacatttatttatttatttatttatttatttatttatttatttatttatttttattttttgagacatagtttcgctcttgttgcccaggctggaatgcaatggcgcaatctcggttcactgcaacctctgccttccaggctcaagcaattctgcctcagcctcccaagtagctgggattacaggcatgcgccaccacgcctggctaactttttttgtatttttagtagagacggggtttctccatgttgatcaggctggtctcgaactcctgacctcagatgagccgcccaccttggcctcccaaagtgctggaattacaggcgtgagccaccgcaccctgcctattgtaccatatttagtttcccaattttttgctatataatattccatgaatatctttgcccaaaatttttgtagattgtttctaagaatagttcatcagcattttaagacatcctattaatattagcggactgcaatcagattgaagtagttcacaaatagatgggttttagcctgtatttgttcaatactgaactattgtatgtatcaggcactgttatgtatcaggcactgttctcagcacttgtaaaatgtatatgtgctgctgacaagcatgagcacttgtaaatgaacaaactaaaatccctactcttgttaaagtgggggaggtgaagaattttaaaaacatcttttttcgttcaaccttctcccacaacttatctttcattctgctaatggaaaatattacttttgttcttaaatatgaagcttttgtgtgtaaaaagtattagaatctcatgtttttgaacaaggttggcagtgggttgggaggagggattggagattgatgcgataggaatgtgaagggatagcttggggtggattttattttttaattttaatttttattttttgagatggagtcttgctctgtctcccaggctggagtgcagtggtgtgatctcagctcacgggttcaagcgattctcctgctgcagcctcccgagtagctgggattacaggagcgcgccaccacacccggctaatttttttgtatttttagtagagacggggtttcaccatgttggttaggctggtctagaactcccaacctcatgatccgcctgcttcggcctcccaaagtgccggaattacaggcgtgagcgactgcacccggccgcttgggggtggatttttaaagaaactttagaagaatgtaacttgcccagataccatgtaccgttaatttcattttcggttttttgaatacccatgtttgacatttctccgttcaccttgattaaataaggtagtattcattttttagttttagcttttggatatatgtgtaagtgtggtatgctgtctaatgaattagacattggtactgtctttaccaaaactggacaaagagcaggcagatgcaaaaatcaagtgacccagcaaaccagacacattttctgctctcagctagcttgccacctagaaagactggttgtcaaagttggagtccaagaatcgcggaggatgtttaaaatgcagtttctcaggttctcgccacccaccagaagttttgattcattgagtggtgggagagggcagagatatttgcgattttaacagcattctcttgattgtgatgcagctggttcgcaaataggtaccctaaagaaatgacaggtgttaaatttaggatggccatcgcttgtatgccgggagaagcacacgctgggcccaatttatataggggctttcgtcctcagctcgagcagcctcagaaccccgacaacccacgccagcgctctgggcggattccgtcaggtggggaaggccaggtggagctctgggttctccccgcaatcgtttctccaggccggaggccccgcccccttcctcctggctcctcccctcctccgtgggccggccgccaacgacgccagagccggaaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtatgtgcgtgatggggagtccgggcaagccaggaaggcaccgcggacatgggcggccgcgggcagggcccggccctttgtggccgcccgggccgcgaagccggtgtcctaaaagatgaggggcggggcgcggccggttggggctggggaaccccgtgtgggaaaccaggaggggcggcccgtttctcgggcttcgggcgcggccgggtggagagagattccggggagccttggtccggaaatgctgtttgctcgaagacgtctcagggcgcaggtgccttgggccgggattagtagccgtctgaactggagtggagtaggagaaagaggaagcgtcttgggctgggtctgcttgagcaactggtgaaactccgcgcctcacgccccgggtgtgtccttgtccaggggcgacgagcattctgggcgaagtccgcacgcctcttgttcgaggcggaagacggggtctgatgctttctccttggtcgggactgtctcgaggcatgcatgtccagtgactcttgtgtttgctgctgcttccctctcagattcttctcaccgttgtggtcagctctgctttaggcatattaatccatagtggaggctgggatgggtgagagaattgaggtgacttttccataattcaggtgagatgtgattagagttcgatctgcggtggtggcagaggcttacaagaaacactaacgggacatgggaaccaattgaggatcagggaataaagtgtgaagttgactaggaggttttcagtttagaacatggcagagacattctcagaaataaggaagttaggaagaaagacctggtttagagaggagggcgaggaagtggtttggaagtgtcactttggaagtgccagcaggtgaaaatgccctgtgaacaggactggagctgaaaacaggaatcaattccatagatttccagttgatgttggagcagtggagaagtctaagctaaggaaggggaagaggaggccaaggcaaacacttaggaacacttgcaacgagggggtggaagaagagcaaggagccagctgaggagaatgagtgtggttggagaaccaccacagcgcagggtcgccagagctgaggaaggggagggaagcttcaggaaggaaaaggttggcagggattttgagtgttaggcctggtgtagcagaaggaacagaagatttagagcagcgctagccaatagaaataaaatgtgaggcccggggcggtggctcacgcctgtaatcccagcactttgggaggccgcggggcggatccttgagctgaggagttcgagaccagacaacacggcgaaaccccggctctacaaaaaattagctgggcgtgggggcgcgcgcctgtagtcccagctgctcccaagcgaggctgaggcaggagaatcacttgaacccgggagaaggaggttgcagtaagccaagattatgccactgcactgcagcctgggcaaaagagtgagactgtctcaaaaaaaaaaaaaacctgttttgtttttcttttggagaaaaggcatacaaatttattagcatgcagactgggagaaccacaaggtgattatccctattttaaattttctaataaacatactattatttatttatttatttatttatttatttatttatttattttttgagacggagtctggctctgtcgcccaggctggagtgcagtggcgcgatctcagctcactgcaagctccgcctcccgggttcacgccattctcctgcctcatcctccccagcagctgggactacaggcgtccgccaccacgcccggctaatttttttgtatttttagtagacacggggtttcaccgtgttagccagtatggtctcgatctcctgacctcgtgatccgcccgcctcggcctcccagagtgctgcgattacaggcgtgagccaccctgcccggccggctatttatttttttagagatgggagcctcactatgttgcccaggctggtcttgaactcctggagtcaagtgatcctcccgccttggcctcccagagtggtgggatacaggcacaagccactgtgcctagccataaacacatttttaaaggtaaaaaaaggccgagcgcggtggctcacccctgtaatcccagcactttgggaggccgtggcgggcggatcatgaggtcaggagatcgagacatcctggctaacacggtgaaaccccatctctactaaaaaatacaaaaaaaaaaaaattagccgggcgtgatggcgggcgcctgtagtcccagctactcgggaggctgaggcaggagaatggcgtgaacccgggaggcggagcttgcagtgagcggagatcgcgccactgcactccagcctgggcgacagagccagactctgtcaagaaaaaaagaaaaaaaatgtaaaaagaggctgggtggccgggcgcagcggctcacgcctgtaaacccagcactttgggaggccgaggcgggtggataaccagatcaggagatggagaccatcctggctcacgcggtgaaaccccgtctctactaaaagtacaaaaaattagccagacatggtgccaggcacttgtagtcccagctactcgggaggctgaggcaggacaatggcgtgaacccaggaggcggagcttgcagtgagccgagatcgcgccactgcactccagcctgggcaacagagtgagacttcgttttttttttaaaaaaaggctgggcacagtggctcacacctgtaatctgccagcactttgggaggccgaggcaggtagatcacctgaggtcaggagttcgagaccagcctcgccaaaatggtgagaccctgtgtctactaaaaatacaaaaaattagccgggtgtgttggcgtgtacctgttatcccagctactcgggaggtgaggcaggagaatcgcttgaacccagaaggtggaggttgcagtgagccgagatcatgccactgcactccagactgggctacagagcgagactccataagaaaaaaagaaaaaaaaggggggcaaaaagaaacagatgaaaccaatgtgaataatttattttaacacaatatacctaacatatttttatttcaatatctaaccagtataaaaatttacttgttttgccctctagagatagtaagctccttaagtaaacagaagtaatacctgattaattagaattcccaaccctcatcaagtgtgtgcttatatagaagaaacccagtaaatgtttgttgattgaaagatattaatactcttgcttggatgagagtgaggaaaaaggtattagtattggcttttcacaacgccttgtacggtttcttgtttaagttgatcaaagcaaaagaaagactgcaggcaatgctaaatataacaagtgatttacaaattaattagacgtaaataatcatttttcattaaaaattagttgtattctgtccatttcctcagaattttagacaatgattttgaataatcatatctcccttatagagttattgaaattaaataacttattgggaaagattctttataattatacaaaggtatataggaccatagtctcatatccagagttctgaaatccgaaaactaaaaggtttttctttttttgctattcttttttttttttttttttttttttttgagacagagtctccctctgtcgcccaggctggagtgcagtggcacaatctcagctcactgcaacgtccgcctcccaggttcaagtgattcttctgcctcagcctcccgagtagctgggactacaggcgtgtgccaccacactgggctaatttttgtatttttagtagaggtggggtgtcaccatattggccaggctggtctcgaactcctgacctcgtgatccacccgcctcagcctcccaaagtgctgggattacaggtgcgagccactgcacctggccaaggttttttataactaatttaacagcaaaatctggcctagttatcgtctttattttctttttttaatgtgatttaaaactattcatttgtttcactatagcttaataatttgtttgcttttctgcttctaagaccctgtaggggcattatataacttctggcatttgcatagtacctttacaaaatccaaaaaaatctgaattctaaacacatttagtcctaaaagttacagataagggattctggacttgcgattctaagtctttgttcgtttttattgcattttctgagccaacataaccattatttaaaaacaagttgctatagtaactctacattacagacctcccccaaactcagcagttcagagcatgtattctcactcagggctctgcttccttgtaggtagatgtgtggatcggtgagggcagttcttatttgtatgccttattctggggcccaggctgaaggggcagtggctatccatgataagcttttctcaaggcaccagcagaagtacaagaagtcaaggccaactgcataagcatagttcaaatgtctggttatgccacatctgctaagattgcattgaccaaagcaagtcacatgatcatgcccaaagacttaggagtgggtagtagactgcaaccaccatgcagccaagcaaactacagagccaagcctataacatcactggagagaggtgtattcctcccttggccaggctgggggagggagtgaatattggctgaataataatctaatctaccacagatggttaacagaggtggagtgggatggaaggagaaaaaaaaaaaatcaccaaatgggatgtatcactacccttgctctttttagcgtctgctgctttcacaaagccttttatagggctggagaaatgatttgctcctagtctcttaaaaaccagaggagtcttttgaggatgtattcctaaagtttttaaattagtttaaaaattttttttattaatttcaattataggctgagcacagtggctcacgcctgtaatcccagctaaggtggtggatcacctgaggtcaggagttcgagaccagcctggccaacatgctaaatgaaacccccatctctactaaaaatacaaaaattagctgggcatggtggtgggcgtctgtaatcctagctactcaggaggctgaggcaggagaattgcttgaacccaggaggtggaagttgcagtgagccatgatcgtggcattgcattccagcctgggcgacaagagtgaaactacatcttggccgggtgccgtggctcacgcctgtaatcccagcactttgggaggcagaggctggcagatcacgaggtcaggagatcgagaccatcctggctaacacagtgaaaccccgtctctactaaaaatacaaaaaattagccaggcgtggtggcgggcacctgtagtcccagctacttgggaggctgaggcaggagaatggcctgaacctgggaggcggagcttgcagtgagctgagattgtgccactgcactccagcctgggcgacagagggagactccgtctcaaaaaaaaaaaaaagaaaagaaactacatctcaataataataataatttcaattataggttggaatttagagttcggttacatttactattggatgtgatcctttaaaaactcaagtagaggcttttccagcccattcataacattagaagttgggccgcctgtccagggagaagctttcaaagtaacactgaggctgattaaatacttttgtaaaataaagaataaatcacaagctcattggcacttgaaacttagcattgcagtgcagatgcagcagaaaatacttgtagcagttttctcagtgaaagagaaactagtcaagtagcttagagacattaaaacaagccacaagccctttgtgctagagatcatggttaaaagtcccctgaagatgtttttccacagtagaaattttgtttatatttatgtctgagagtgaaaaaagaaaatggaatcaataagtaaccatgttctgcaggagtttgaggttttgttgttacattgggatgtagtgagagaagaaaacgtattaattcttttctgttggtactttcttgaattacatttttaataaacttattgtgagattctgaacattgctcctgtgataatttctgaagtgctgatgagtagaaggttttctggttagacttctgttcagcacatctgagcttcgagattatttgtagttctcctggggcttttaaaatctctttgtatataatagataaatgctagtttcccatcagagaaggatttctttttccttttgtctgattgagcaagtgtcttgagattaagaaaatggatgtcagtgaattcaagtgttgtgctctgtcagtttgcagcaggtgaccagagagcaaaaacaccagagtagattctgtccctactcccacctactcctcaattcgggtcccatgaaagatcctcagatctgggtaactgttgttgtttttgttgttcacagggctaagaatgttcatggctaagaatgttaaaaagtctcctagtgtcttttgccacgctgcctgaacagtggggtcattgaccgccatgcaatcctcaattgttttcagctgatactggaccgaaatcaaatctagctttgcctgcccctttctttgtaccagtagcgcttgtttgttcaccaggcctgactgaagacctagccctgttgcctgcctctgcttcctaccgagccccctgtaaagagcagctctcccagggaggctcaccttgtagcattgtgatctttggaagcatcaagggaggcacaagatttctctgggtgaactggaaaagacttgggctgggcatcagaagacttgggttctgcaactggcattgtttacactctctctgtaactctgtgcaggcaaaatctttcaccttttctgagtttttttttacatgtcagtacagattcctttcctcatgaggtttctttaagactcaaatggaagaatagatgtgaaaagaactttgaagatagtattggaaaatgctaaagtgactgctgtgttattgatgatttttatgggatttgtctgagaaagctccagtgtgaccagtttgtaccagcttgtatggtttcttgtaataaccgaacagatcctgttagcatagggtaaaaatggaaactacttcttttaaaatgaccagtggctgcagtggctcaggcctgtaatcctggctagttgggagactgaagtggtagggttgcttgaggccaggcaagaccagcctgggcgatacagcaagaccctttctctaaataaaaaactagccacccatgtagtcccacctgcttgggaggctgaggtgggaggatcgactgaggccaggagttcaaggctgcagtgagctatgattgccactgtactccagcctgggtgacagagtgagaccttgtctcttaaaaaaaaaaaaaaaaaaaaaaaaaaagatttgcattatagcttatctttttttttttttttttttttttgagatggagtctcactctgtcacccaggcaggaatgcagtggcgtaatctcagctgactgcaacctctgcctcctgggttcaagcaattgtcctgcctcagcctcccgagtagctgggactacaggtgcacgtcaccatgcctggctaatttttgtattttttggtagagatcgggtttcaccatgttggccaggctggtctggaactcctgaccttgtgatctgcccaccttggcctcccaaagtgctgggattacaggcgtgagccactgcgcccagccagcttatccttttttaaaaaaacataaatactaggatattgagattattgaaaatgcttttggtgcttcagttttgaatttatacttagagcagtttttgaagtttaagatctcatttacttctaagtaatagatttactagtaatcaaaatcgcttcaaaataccgtaatcctcattgctgtaaactcctacggggcaggtttggagttttataaagaggcaatatagtgtactctgtgaattccaactcctcacttgccagatgtgaccttaagcaagtgaacttctgtgtgccacactgttttcatctgtaaaaggataaagggaatatcataaattagtttgttaagccttagtttaataatgtctctaagttttacatataagtagacagtgtctttcttgtttagtgaataatcattcttattatttaatagtatctctactaaatttattgtgtaagattatactaatcttgtttagtgcgtggtaatcacttctgctcatatttaacctataagcataatatagtttatttatataccatttatttattttattttattttttgagatgcagtcttgctctgtcacccaggctgcggtgcagtggcgcaatcttgcttcactgcaacctccacctcccaggttcaagcgattctcctgcctcagcctccttagtagctgggattacaggcacgagctaccatgcccagctaatttttgtatatttagtatggacagggcttcaccatgttggccaggctggtctcgaactcctggcctcaaatgatctgtgtgcctcagcctcccatagtgctgggattacaggcatgagccactgcgtccggcctacttaccttttatttttgcttgcattaccctttctttgccttgtttcatttggctaagactgtcttgtttacttgctttgcttctgagggattatatgagagttctatgggtttttccataatggagtgtacttttattattttattatttgtttttttgagacagggtctcactctgtcactcaggctggagtgtagtgatgcagtcactgctcactgcagctttgactttcttggctccagtgatccttccacctcagcctcctgagtagctggaaccacaggcacccaccacccacacccagccaattttttttgtatttttagtagaaacagggtttcaccatgttggccaggctagtcacgaactcctggcctcaagtagtaacacccatctcagcctcccacagtgctgggattacaggcatgagccaccgagcccggcctcatgcaatttattgactacttcactgaaagtgaacttgtatggatactcaaaaagtacagtttgtattgaatacatattgtttttgcatcatactaaagctgaacagttctaaactgaactgtcatcagggaccgtctgtattgtgaaatcttaattttgtccatattaaaagacaggaacagggctggttcgtggtggctcacacctgtaatcctagcactttgggaggctgaggtgggtggatcacttgtggtcaggagtttgagaccagcctggccaacatggtgaaacccagtctctactaaaaatacaaaaattagctggacatggtggtgcacacctgtaatcccagttattcggggggctgagacacgaaaattacttaaacccaggagttagaggttccagtgagcgagatcgtgccactacattgcagcctgggtgacagagcaagactgtgtctcaaaataaagacaggaacaaaggtatcgataactcttaagtataggttaaattcccacaaaaatctagttttaaaaaatctttttttttttttttttttttaaaaacagagtctcactctgttgcccaggctgagtacagtgacgagatcttggctcactgcagcctctaattcctggactcaagccatccccccacctcagcctcctgagcatttgggactacagatgcatcccacctgcacccagctaattatttttttgtagagatagtgttttcctatgttgcccaggctggagactgatctgcaactcctggccttaagctctttattttttaagcaaatttgcactgttttcaattaatatgaatttgcatttcgctgatctcatgctagctgacaatgggctgaaggtgaggggaggagaaagatggacatggtacataaaagcatgtatgataaagtggaatgtcaccttggttaaaaatgtgtaatgatttgaatgatacaaatataagtagttaagggttattttgaacttgatacctttgctggaggaaaaattactttatgcatttttgatgaaaaatcattagaagaaaaaaaatggaatatttagaggaaagagtatcctgatgttaaaagtgaaaatgaaataggacattgagaaaatttttttatgtaaatgtgtatatggtaatgtattaattagcgttaggtatgtacacggatttttgccttctatatttctgaaaaccttctgtgaaaaggaagagttgaaatcataaagaattggctgatggaaattaaggtagacaggcaaatgggaatgtggcccccctaggagggtgaactctgagagacacagtcatccctgtaaataaggctgcgccaagatcaaaggagaggtctgaggctgggagtcaggagtcagccattcttttttttttttttttctgcaacctccacctcctgggttcaagcttttctcctgcctcagcctcctgagtagctgggattacagatgcgcgccaccacacccggctaatttttgtatttttagtagagatggggtttcgccatgttggtcaggctggtttcgaactcctgacctcgtgatccgcccgccttggcctcccaaagtgctgggattacaggcatgagccaccgctcctggctgagtctgcgatttcttgccagctctacccagttgtgtcatcttaagcaagtcactgaacttctctggattcccttctccttttgtaaaataagcatgttatctgtccgtcctgccttgggcattgtgataaggataagatgacattatagaattttgcaaaattaaaagcgctagacaaatgattttatgaaaatataaagattaggttgaatttggtcagcatagaaaaaggaatgttgagaacattccttaagattactcagctccctttgctggaaatcagaagtcattaagtatctttgtggttgaaaatgtttggtgtctcaggcggttctacttattgctaaagaggtctaccttgagcttatagtaaatttgtcagttagttgaaagtcgtgacaaattaatacattcctggtttacaaattggtcttataagtatttgattggtttaaatgaatttactaggatttaactaacaatggatgacctggtgaaatcctatttcagacctaatctgggagcctgcaagtgacaacagcctttgcggtccttagacagcttggcctggaggagaacacatgaaagaaaggtttgtttctgcttaatgtaatctatgaaagtgttttttataacagtataattgtagtgcacaaagttctgtttttctttcccttttcagaacctcaagaggctttgttttctgtgaaacagtatttctatacagttgctccaatgacagagttacctgcaccgttgtcctacttccagaatgcacagatgtctgaggacaaccacctgagcaatactgtacgtagccaggtacagtgtcagtctctgaaactgcctttgccagactggattcacttatcatctcccctcacctctgagaaatgctgagggggctaggcaggctttctctactttaccacatttataatatatttggtgaacttcagctgattgctggaggacacagggctgtttaacacataggtgttgatacagttcctacctaattcacatatcaccacctcagttgaagccttctccagcttcccaaggtgtgcagcgcctcatagttcatgttgtttattattttacctatcttgctcttattcttctacggctgagtccattttatttactgtattcattacctaacagttccttttagtgctcagtaaatattcattatgattgtacaatgcaaggataagtgtagaagttctaagggttcaaaggagggattcaggaaaagaacgtaatctgtgctgtcggacaaagagattcctcaccagctacatacacagacatgaaatttgactgcaactctactagctaatcatcataaagtgagagcagaggccaggcacggtggctcatgcctgtaatcccagcactttgggaggctgaggcgggcagatcacctgaggttaggagttcaataccagcttggccaacatggagaaaccccatctctactaacaatacaaaaattagccgggcttggtggcaggtgcctgtaatcccagctactcaggaggctgagccaggagaatcgctggaacccaggaggtggaggttacagtgagctgacgtcgcgccattgcactccagcctgggcgacgagcgaaactccatctcaaaaataaataaataaacaataaataaatagagaaaaagaaagaaaagaaaagagagagagcatggatgtcctgtgagacagttggagtatctataggatttttagaggtggacccagaatagaggaaaacacaaggccaactataagctatccagttgcactaggtgtggggtcagattttcctctgttaggaccagagagcagagctaggaacagtggtggaagttaccaggcaataaggtctggatcaataaaaagaactttctcatagcctggcatggtggtgcatgcttgtagtcccagctactcaggaactcaggaggctgaggtacgaggattgcttgtctaagagtttgagtccagcatgggcaacatagagaggttctgtgtttttttttttttaattttcccacagttatggtacatctgggctgccttgtaggcttgtgtgtacatttcactacaaacagtcacaaaaggctgaaaggccactccagcaagatctgtagaggattagtccgtgaattccgcagttgaactagagcactgaatggcgtggaacttccttttacactctgaagatttaggattcttcacttttcccatcagtaaaattaggtaatttactagataatttgaaaattctttcccagctgggaagttttgatgtgcccagaagctaggatgggcagttgtccaggtttgtttaaaactagaggttctagaacacaggactttcagttttaaaattgggacagtcctgagcagtaggatcaagtcagttgtctaccagagtataatcaaattgaaataattttggatctgactaaccaagtcttattcaattagttgacattgttgtttaacttcgagtactattacagttctatattgttatagttcaaatagaagataacatctaaagcatttctcattccaaaggttaaatcttgcctttagcttcatttcttcaactctaagcaaatactgtgacgagctgctatagcctggaaaatagttttccttttgtgggctgctgtgcataatctcattcatagtaaagggatttgaagtttgatgacagaatagtcagagagctgaagttgtgtttgtttttttagcccaaatatttatttctcaagtttttgttgtgaaatgtttctagcacatacagaaagtatggcacataatgtaataggcacccatgtacctatcacccagctttattaaaccttaacatcttatttgctgtttttttgataagctttttttgcttctattgcttattgatcctacactaaatgaaatcctaactaaacaaaacaagattttgcatttaatttgaaaagagactagttatatgacaaaaaattgcagataaaattgaagtgctcctcccccattctttttcctcttttctcaggatagttactgtcctgaattgggtatttaccatgtttaataaaattgagtattaggcttactataatatttatgtacataaatcgtatcgcattatgtaatacacttggcatgttttaaaactttaggctgggtgtggtggctcacgcctgtaatcccagcaatttgggaggccgaggctggtggatcacaaggtcaggagttcaagaccagcctggccaacatggtgaaaccctgtctctactaaaaaaaaatgcaaaatttagccaggcgtgatggcaggcacctgtaatcccagctactccagaaactgaggcagagaattgcttgaactctggaggtggaggttgcagtgagccaagattgcaccactgcactccagcttgggcaacagagtaagactctgtctcaaaaaaaaaaaaaaaaaaaaaaaagccaggtgcggtggctcacgcctgtaatcccaacactttgggaggccgaggagggcggatcacgaggtcaagagacagaccatcctggtcaacatggtgaaaccccgtctctactaaaaaaatacaaaaattagctgggcgtggtgacacgcgcctgtagtcccagctacttgggaggctgaggcaggagaatggcatgaacctgggaggcggagcttgcagtgagccgagattgcaccactgcactccagcctgggcgacagagtgagactccatctaaaaaaaaaaacaaaaaaaaactttatgtggtttatgtctgaaagttgaagagaatttccacatatatgttagtatatgttgcaaaagagacattcctatgtagaattttgggcattcatgtatatgtagatgcatgtagctctagcatttgttttctcttgtgaatatataaaaataattctgtttacaaacatttggtaggttccagtttttcacaataactgacagtgctgcagtgacatactaattcattagtctgtgtgcacttgtgtgagtttctcaaagatagttgctgtgattggatatatggatcttagaactattttagagattgctaggattcttccaaagtgtatattgcaggccaggcatggtggttcacggctgtattacatctatctcagaaaaataagagaagaaaagcatgggtgatcttggtgatttccccctttcattttctaaatgttctataatacagttatttaataatttaaaaagctattttgaaaaagtaatctcacgctgtcaccaaagctggagtgcagtggtgcaatctaaactcactgcaacctcgacctccttgagaccagggtggtctcaagtgatcctgccacctcagcctcccaagtagctgggaccacaggctcatgccaccacacctggctaatttcttgtatttttggcagaaatgaggtttcaccgtgttgcacagtctggtcctgaactcctgagctcaagtgatccacatgtcttggcctcccaaagtgctgggattacaggtgtgagctactgcgcccaacctaaaatattttatatatatatatatatttttttttttttttttttttttttttttttttttgagacggagtctcgctctgttgcccaggctggagtgcagtggcacgatctcggctcactgcaagttctgcatcccgggttcacgccattctcctgcctcagcctcccaagtagctgggactacaggcgcccgccaccatgcctggctaattttttgtatttttcatagaggcggggtttcaccgtgttagccaggatggtctcggatctcctgacctcgtgattcgcccgtctcggcctcccaaagtttttttatattttttaatgtgaggaaaggtcacaaaagaatagtatgctacctgaggaatatctctggaaagggatcaagcattcgaggttttctgtgatgactgactaaagtcatggagttagaacagctgatacaaaagaaaccaaaaaaggccaggcatggtggctcacacatgtaatcccagcactttgggaggccgaggcaggtggtcaggagtttgagaccagcctggccaacatggtgaaaccccatttctactaagaaaaaaaaaaaaaaaaagtcaatgggtgtggtggcatgtacctgtagtcccagctactcaggagactgaagcacgagaattgcttgaacccaggactcagaggttgcagtgagctgagattgtgccactgcaccccagtgcagtgtgacagagtgaggctgtctcaaaaaaagaaaaaaaaaacccacaaaagctcggtagcatgagatctttgagagcattcttatgttcttattggtaattggagtttatattatgcccttgtcatcaataatagcttcagttatgtttcttagtctccatttgaaaaaagaaatattcgctgggcatggtggctcacgcctgtaatcccagcactttgggaggccaaggtgggtggattacttgaggccaggagttccagaccagcctggccatcacggtgaaaccctgtctctattaaaaatacaaaaattagccaggtgtggtggtgcgcccttgtaatcccagctacctgggaggctgaagcaagaggattggtttcaaggttcacctgggaggtcaaagctgcattcagccaagatcacaccattgtactccagcctaggtgacaaagtgataccctgtctcaaataaatacatagacaaaaagcaaacctatgagctatttaaaggaccttgaggagaaaaaaaataaatgaaatgggtgatctaaatttaaatagaatctgcagctctggttagcctttgacagtgttgttgtatcattatagttatgaatttgttttctcagttgtgttaaagtggagtaaggcaaaaaagaacttgaaatctcaacgacctccagagaaacatgctagcttttgcatgagtaaaatctcttaggcacaaatattaataatatgttaagaaactttaggcttaagcctaacataacagccccataagtgttcagtattatctctaaccagttatgtcaactgtttgtggaaatgacagcctttcttggcattagaggaatggttaaacctctgactccagggaatcacaaagcttggtcagatgctgaatggaattatgtgtgttgttggaagcatgttccctatgattaataaatgttttcaagttttccacttaacttgccagttctttggttaagccactcttctagtcctgtcctacagagcaggcttagagccccacatttgtcattgtagaaattcaaacaatatccattaagtcattttttttttttttgcccattaagtcttaaaggattaatacattttctttccttttttttttttttttgaaacggagcctccctctgtcgcccaggctggagttcagttgtgcgatctcggctcactgcagcctctgcctcccaggttcaagcgattctcctgccttagtctcccgagtagttgggattaacagggttgtgccaccacacctggctaattttagtattttagatagagatggggtttcaccatgttggtcaggctggtctcgaactcctgacctcaagtgatctgaccacctaggcctctcaaagtgttgggattacaggcatgaaccaccgtgcctgccaatacattttcttacaaatattaattattgaaaaaatgtattttaagtaaatattcagactataaatatatcagcataattgaatacattataaccacgtaggcatgttaactgcttacatgcgtgcatgaaatattaagggaaaagggcagaatataatatttgtaaacacaactatgtatacctgtgtgtatatattgaaaaacgttagcatttggggtgtcgtaaaaataagtttctgttttctttataaaattacctaaattcatattcaactacacacaattataaacttaattgcagagctaggtgtggtggctcatgtctgtattcctagtactttgggaggctgaggcaggaggatcccttgaggccaggagtttgagactagcttgggtaacatagcacgatcttgtctctacaaaaaaaaaagtgaaaattagtggggtgtggtagtgtgcttctatggtcccagctacttgggaagctgaggcaggaggattgcttgagactaggaggtcgaggctgcagtgagctgtaatcatgccactgcacttcaacctgggcagcaaagtgagaccctgcctcaaaaaaagaaaaaaatgtgtggcaaaaactgccatgaacaaagtccaaaacaaactaggacaaaggcttgaaatatatgacagatatatcccaatatacatagaattcttatgaaattaaaaggaacatgaacaacttaactcagtagcaaaggttacaagcaatatttatggagtaagaaatagaaatggcaataaatatatgaaaagcctagttgatcagccttactaatagggataaaaattaaaacttcacttcttacctatcagtgagttaaaattgatacactgctgctgaggttgtagggaaataggctttcttgtatgctgtgttctttggagttaagttagtatttatttggaggcaagctcttaattgaatctacagatacacatgccttttggaaataatttagcaattaaatctaacctaatctgatctcacctagcatttcacttctgaaagtttatcctataaaaatattaccatagaagtgccaagaatttttattgaagttttatttataacagtgagaatgtggcagtaatctcaatctttatcattaattgcttatggtttacccagttagtagtgtaaaggtactagttaacagtagggtctcttgactaaacagttggactttgaatctccattctagaacttcttagcattatgatctttggcaaattaactggcctcgctaaacttcagtttctttatctgttaaatgaagtttatagcaattaacttagagttttatttaaattaaatgagataaactgaatgattagtacactacctagcacatacttgttcaataaatattaacatttcttatcaaaattgccatatttaagaatgaggtatatttatatgtctagcatagaatcaaatatatattatcattattattttttttttgagacagggtctccttctatcacccaggctggagtatagtggtgtgatcatagctcagtgcagcctgtaagtcctgggctcaagtgattctcccatctcagccttgtgaatagctgggagtacaggtgtgtgccaccatgcctggctaattttttttgctgttagtttcactttttttgtagagctggggtctcgttatgttgcccaggccggtcttgaactcctgggctcaagcgattctcccgtctcggcctcctgaagcatacagattttttagggcagtgaatctattctgtatgatactgtaatcatggaaacctgtcattatctgtttatacaaacccatagactgtataacaccaaaaagtgaaccctaaggtaaactgtggactgtcaatgtaggttcatctgttgtaacggtttaccacagtggtgcaggatgttgatagaggctgttggaggggttatgtgggaactctgtgtactttctgctcagttttgctgtggatctaagtttgcatttaaaaatattttatggcttggtggctcatacttgtaatcctagcactttggaaggctgaggcgggtggatcacttgagttcaggagtttgagaccagcctgggcaacatggtgaaaccccatctctatgaaataaaaaaaaaagtaaataatactaatagtaattaactgggtgtggtggcatgtgcctatagtcccaggtacttgggaggctgaggtcggaggatgacttgagcctgtgaagtggaagttgcagtgagcagtgatcatgccactgcactccagcctgggcaacacagccagactcggtctcaaaaaataataataataaaataaataatataaataaaaataatattttgaaagaaaagagctatcaagccacaaatgcaaaaggcttcaagttcctatcttttagaaatacatactaaaatatttatgaaggaaatgatatatctaagatttgcctcaaaataatactggagtggcaaagtgagcgggggagtagatgaaacaagattagcatgagttcataattattgaagttgaataaattgcacatgggcttcattgtacatttctgacagtatttgtttgaactttttccataataaaaagttttgtttgtttttttttttgagatggagtcttgctctgtcacccaggctggagtgcagtggcatgatctcggctcactgcaagctccgcctcccaggttcacgccattctcctgcctcagcctccagagtagctgcgactacaggcgtccgccaccatgcccagctaattttttgtaattttagtagagatggggtttcactgtgttagccaggatgatctcgatctcctgaccttgtgatccgcccgcctgggactcccaaagtgctgggattacaggcatgagccaccacgcctggccttttttttaaaatggtcttacaggtaataccatgcatgcttaagtcatcattctcatatttagctaccaagatttttcctttcggaaatccctcagtattctagtaccactttcctctcatttgacacttttcaaagcacctacacactcccttgagaaagatacctttttttttttttgcgagggagtttcactcttttgttgcccaggctggagtgcagtggcatgatcttggctcactgcaacgtctgcctcctgggttcaagcgattctcctgcctcagcctcctgagtagctgggattacaggcacgcaccaccacacccagctaatttttttgtatacttttttttttttaagtacagatggggtttcaccgtgttggccaggctgggctcaaacttctgacttcagatgatccgcctgcctcgatctcccaaagtgctgggattacaggcgtgagtcaccacgcccagcccaagaaagatacatttttaaaaacagctttattgtggtataattgacgtaaaatgtacatacttaaagtatacagtgtgatgttttgatatatatgtatactcttgaaaccaccaccacagttaaaataatgaaaatgtccattacctccagaagtttcttcatgttttgttgtaatctctccttctcctccctgattcctccccatccccaggcaaccatgttttgtcaccgcgcgcagccatttactattatgatactattttatataaatagtatcatacaggccgggcacggtggctcatgcctgtaatcccagcactttgggaggtcgaggtgggcgatgacttgaggccacctggccaacatgaaaccccttctctattaaaaatgcaaaaattagccaggggtggtggcgtgcacctgtaatctcagctcctcaggaggctgagacatgaggattgcttgaacccaggaggcagaggttgcagtgagctgagattgtgccactgcactccagcctgggcaacagagtgagtctctgtctaaaaaaaaaacaaaacatacagactcttgtctggcttctttctttcagcataattattttgaaattcgtccatgttatgtggttcctttttattgctgagttgtataccacagtttttgatctatttacttgttggtagatatttggattttcagttctgaagcattacagatagtggctgttacggatattcatgtacagatctttctttgtatgggcatatgctttaatttatcttgggcaaatacctaggagtagaatatgatccaatatggtaggtgtatatttaacttttttttctatctatctatctatctatctatctatctatctatctatctatctatctatttttaagacggagttttgctccatctggagcaaaggctggagtgcagtggcatgatcttggctcactgcaacctctgcctcctgggttcaagtgattctcctgtcccagcctccccagtagctgggattacaggcgcctgccaccacacccagctaatttttgtatttgtagtagaggctaggtttcttcatgttggccaggctggtcttgaactactgatctcaagtgatctgcctcggccccccaaagtgttgggattacaggcgtgagccatcacacctggccagtttttatttatattttttatagaagatggagtcttcctatgtttcacaggctgatcttgaactccaggcctcaagtgatcctcccgccttggcttcccaaagtgctgggattataggcatgagcctctatgcccagccttatatttaactttttaaggtactaccaaagaactttccaaactggttgtataattttacatttctaccagcagtatgagttccagttcctccacatcctgtcagtacttgatactgtcagtcttttaaattttttagctcttataaaaaggtatatagttacatctcattttggttttaatttacatttctctattgagtaatgatgttgagtttcttttcatgtgcttgtcatcctgatatctttggtgacttgtctgttcaaatctcttgcccatttaaaaattgctttcttaatggattttaagaattatttacatagtctggatacaagtcctctgtaatatatataatttgcaagtgttttctcccagactgtggcttttctttttattaacagtgctttttgaagggcagatttttttttttttttttaaagagacagagtcttgccctgtcacccaggctggagtatagtggtgtgattatagctcactgcagcctcaaactcctgagctcaaagaattcttctgcctcattcttccaaacagctaggactacagatgtgtgccactgcacccagctaattccgtttgtatttcattgattgtgtttttggtgtcacatcttaagaaactttggcctacttcaagttctcaggagttttttcctgcattttcttctggaagctttatagtttcatgttttacattaggtctgtgatccttttgaagttgattgttatacgtggtccaaggtatggatcaaagttcatttttctgcatatggatattcaattgtttcagcactgttttttaaaaaagactattttctccactgaagtgcctttgtacctttgcaaaaatcagttgtccatatatgtgtcaatctgttccatcagtcatgggtcaaaggctgttctcatggggaggcttttgaatttgaaaaactgaaactctatactcattggacaactttatacccattgaacaactccccattttccatttctctcagcccgtggcaatatgctttctgtttctataacatggactacttgagtttttttcttttttttgatgacaagatctcactccgttgcccaggctagagtgcagtggcatgatcttggctcatggcagccttcacctcctgggctcaagctgtcttcccacctcagcctcctgagtaactggaactacaggtgcactctatcatgcctcgctaattttttaatttttttgtagagacgagttctcgccatattggccaggctgatctcaaactcctgggctcaagtaatcctcccactttggcctcccaaaatacagagattatgggtgtgagccatcatgcccagctggctagatatttcatgtaagtggaatcatacattatttctcttttagtgacttgcttattttgcttagcataatgtcctcaaggttcatctatattgtagcatgtgacaagatttcctttttaagggctgaataatattctgtgttatgtatataccacatatctgtgagtagacatttgggttacttccacttcgtggctatactgaataatgctatggtgaaagtggctatgcacatatctgtttgaggtcttgtttgtaattcagttcgtttttatatatactcattggtatttatataaatgggattgctgggtcatatggtagtttaattttttgaggaacctccatattgttttccatggtggctgcaccattttacattcccaccaacaatgcatagtggttccaatttcttcacaactttaccaccgcttgttactttctgttttttggtagtggccatcctaacgggtgtagtttttttttgcatttttctaatgattagtgatgttgagcatcttttcttttttccccccatattacacagatgtagagcatcttttcatgtgcttgttggctatttgtatatcttctttgaagaaatatctgttcaagtcctttgcccatctaaaaaaatctgatgatttgtttttttccaattgtttaattgtaggacttttttttttttttttttttttgagatggagtctcgctctgtcgcccatcctggaatgcagtggcgcgatcttggctcactgcaagctccacctgccgggttcatgctattgtaggactttttaatgtattctggatattaatctcttaccagatatatgatttgctttttttttttttttttttcgatacaaggttttactgtgtcacccaggctggagtaaagtagtgatgtaatctgggctcactgcaacttccgcctcccaggctcaagcagtccttccacctcagcctcctgagtagctggaactataggcactcgccaccatacccacctaatttttgtattttttgtagagacggagtttcaccatgttgcccaggctggccttgaactcccaggctcaagcaatccacctgccttagcctcccaaactgctggggttgtagatgtgagctaccacacccagcctgatttgcagatattttctccagttctgtaggttgccttttcactctgatgactgcttcctgtggtgtgtagaaatttggtgtaggcccatttgtctatttttgtttttgttctttaatttctcttagcaatattttgtaagtttcattgtacaggatatttggggatctgtaagacaaccctcaggttcagtaatttgctagaaagactcaactcagagaatgttttatactcaaattatagtttagtacattgaaatgatatggattaaatttagcaacagaaaaagacacatagggcagggtccaggagacaccccaggctcaagctgtcaatagtcctctcccagtggagttgtgcacacagtgcttaatttttccagcaacagtgtatgacaacacacgtggaatattggcaaccagggaagctggctgagccttggtgtccgggtcacacatggctgacctcagttctctggccccttcagaggccaagctgatactgtgtgacacaaggccctcaccgtagatcacattattagcggaaacttgttggcatgacccaatgcctcatgtaaacagcgcagtggctgtttataggccgggcgcagtggctcacgcctgtaatcccagcactttgggaggctgaggcgggcggatcacctgaggtcaggagtttgagaccagcctggctaacatggcgaaaccccgtttccactaaaaaaaaaaaaaaaaaaaaaaaatagaaaaagaaaccaaaccaggtgtggtgataagtgcctgtaatcccagctactcgggagactgaggcaggagaatcactctaacctgggaggccaaggttgcagtgagccaagattgcgccactgcactccagcctgggcaacaggagcaaaactccatctcaaaaaaaaaaaaaagttaaatagaaaaaggacataaatgaaaaagcactcaaccatcctgataataagagaaatagatattaaatttatgccaagattccatatttctcccatcagattggtaaaaatctaagcacttgctaacataaggtgttagcaacagtgtggtaaagtaggcaatctcttgcattgctgattctctaaattggtgcaatccacagggagggcaatttggcatgctctcgttctctctctcgctcgctcgcgcgctctctctctctctctccatgagaaggagagagagagagagagagagcacgcgaacaagcgattgagtgagagagagagcacgtatctgcagtctcagctgctcaggaggctgaggtgggaggattgcttgagcctaggaggtcaacgctgtggtaagctgttgactatgccactgcactgcagcctagtgacagagaatctgtctcaaagataagaagaatgaggatattctttatgtactgatgtgtagaaaaatctctaagatacatagttaagtggagaaaacaaaatgctgcatggtgcatttactgtactaccatttgtgtgaaaagggggagtaagagtatgtgtttgtatttgcttgcatatgtagaaagaaactttgaaaggattcaccaaataacagtagtaagcagggggattaggaaactaggtatatattaagagggagcttttgtactctataccttttaatactttctttgagaccatgtgaatgttttacctatgtatttatttatttttaatttttgctttgcctgcttttaaacaaataaattgtactttttttgaagagctctatttttatttcctttcgattatcatctgtagattcttatgtcacattttactttaacagcacatttagacagaatacagtctttaaatggaagccgacaattgatttccctggaaaatttttgaagtacaataacatttgattgattgaactttatttagtaagaattcttagcaaaattccctcccaggcacacctacatggtgcttcattttcagtgaactacaaatctctgaaacccaaaactgcaatctaaaagtacaagatggctggactcgatggctcatgcctgtaatcccagcacttcgggaggccaaggcaggaggattgcttgagcccagaagttcaagaccagcttgggcaacatggtgaaactttgtctctacaaaaaattagccgagcttcacaaacaatcttacaggagtcattcattaattaactcaacaaatatttatagagtacaggagacactagagatccagcaaaggtcaataacatgtgctgtcttagagaaaacttatattctaagaatagtcaagtgacaaacaggagctacatcaaataatcacaagtacacttcagagaattaaaaccagatcaacgtagagaaaggcttccttacattcgatagtcaggaaattctctctctaccaggagggaactgagtgacaaggaacagtcaggtgggagaagggcattccagatgaaccagccctgagcggggaactagaaggccagtttgagaaaaggaatggagagaggaggaacagtttgtggtcagagcaaggaccaaaccattttagacttcatgagcctaagaagttttgattttgttatgagcatgacaagaagccattgtaatcgagttttaaacaaaggaatgacatgatctcattttgtttaaaaaaaaaaaatcatcctggctgtagtgtggagaatggactaggggagcataaaagcagaaagaccaattggaagcctattaacagtaatccaaatgatagataatagtggtttgaaccacaaagattatggacatagaaagaagcagatagatccaggagatgttttggaggtattctggcagaatttgctggctgactagacagaggtactaaggaaaagaatcaagaataattcctagattcgggacttcctagaaactgggagaatggtgctgctgtttattgagataaatggagaagacagaggagaagcttagaatagagttctaggagaggtcagagatggagatcaacatttgggagacagaattttctaattccatagtgccgacgattttctattgatagactaaaaatgtctggaattttatatgcagtttcatctggacaataccctaagaggagatcagttataccttggcacctgctaatagccataggaatatgtatatgtagaataaatggtaaaactactgaatgcttaatatgtgccagacaccgtgagatacgtctttgaagtactatcccagtagaatttacaacaaccctatcaggagatactttttttatcaccattttacagatgaagacactgaagttcaaagaggttaaataactcgccccaaatcacactatatagaagagaaatctaaatcctggtagtctgaccccagaacttgggctaattaccactatataatacagtgtcactggggtaaacccaagatatgataacataagttagagacttttaaattccaaatttcacacactatgatttcacccataaaatgtagtgattcagccatagtcttctgattagttggagtaccctatgcaatactttaggaacttgcttcttttattttcatatatatatatgttcattcataaattaaatctggacagccagtgaatctgccatttttgtctctaaccaacacttctgtcacaaaattgtacttttttttgtttttttttgagacggagtctcattctgtcacccaggttggagtacagtggcacgatcttggctcactgcaacctctgcttcccgggttcaaacgattcgcctgcctcagcctcccaagtagctgagattacaggtgcccgccaccacactggctaatttttgtatttttaatagagacagggtttcaccatgttggccaggctggtcttgaactcctgacctcgggtgatccgcccgcctcagcctcccagagtgctgggattacaggcatgagccaccacgcccggcccaaactgtgctttttttaaataaagaaattaaaacagtatttttttccttaaagatggtgtctcactacattccctggctcaaacgattctggctcaaacgaattcctaggctcaaacgattctcctgcgttagcctcctgagtacctgggactataggtatgtgccactattcctgaaaacataatcagttttgaaggtagtgtctgggctgggcgcagtggctcacgccttcaatcccagcactttgggaggccgaggtgggcggatcacctgaggtcaggagttcgagaccagcctgaccaacatggataagactccatctctactaaaaatacaaaaaattagccaggcatggtggcgcatgcctgtaatcccagctactcaggaggctgaggcaggagaattgcttgaacctaggaagcagaggctgtggtgagccgagatcgcaccattgcactccagcctgggcaacaagagtgaaactccgtcttaaaaaaaaaaaaaaaaaggtagtgtgtggccgggcgcggtggctcacgcctgtaatcccagcattttgtgaggccaaggtgggcggatcatgaggtcaggagttcgagaccagcctggccaacatggtgaaaccctgtctctactaaaaatacaaacattaagccggcgcagtggtggatgccgataatcccagctcctcgggaggctgacgcgggagaattgcttgaacctgagaggcagaggttgcagtgagccaagattgtgccactactaggcgacagaatgagactctgtctccaaaataataataataataataataaaataaaaataaaagtagtatccagcgtactacaaagaggaagagtttgtgaatgtgtatgttactgttaagttaaacagtgttctagtatccatctcattatcagccttgggcagggcagggttgagttggctaatgttcattataaaccagatcatccagttggggactctgaatgagcatatgattgcccctttcatgctagacttagctaattaaactgttcatatgacctaaaaggatggctgtggtgccatagaaagaaaacaagttttgaggcaagagactttagtttgattcctacctctgctgttttctggttgtgagatttttggatcagttgcttttgtgttcatttaccaaaacttctcaagacaaaaagaataaatgagataatgtgacagtgccttgtaaataccaaatactatatagagatagctattattacttgtatgtttattgtgaacattaatcagccaatcaagttgttcagacttgtactgctgaacatcaattgcagatataacattcttggcagatgacttagtcacctccttctgtggaagaatagaagatagacagctccttgctgtctatcacagtatgttctggtcccgttggcctcaccttccatataatcatttccattctactgggctttagccactctggtgacttgagttcagcaaaaataatctttcttgatgggtggtatatatatttctaccttttatgctttagaatagtttcctttccatttctcatagggtttggatcttcataactgtttgaagagaaatcctgacctccagactgaaggaaagcacaccatgcctttataacgccagcctcggtcttttttttgttcccctctgtcttagttccttttgtattgctataacagaataccgcagactgggtgatttatttatttatttattttgttgttgtcatttgttttcttcttttttgtatcttttgaaattcttttcattgttgttgttgttttgagactgggtgatttgtttattcagctcatggttcttgaggctggaaagcccaagagtatatggtaccagcagcacctgattatgccatggtggatagacagaacggcaagagagagcttgcttttgtaacaaagtcactcccatgataactaacctactcctgtgataacgacattgcaggttcagtatccctgatttgaaagtctgaaattcaaagtgctcccaaatctgaagctttctgagtatcaatgtgatgctcaaaggaaatgcttattggagtgttttagattttggatttttagatttggtatgttcaacctgtaagtataatggaaatattccaaaatgcaaaatctgaaacacttctggtcccaaacatttcagataaaggatactgaacctttaatccattcatgaaggcagagtcctcatgacccagtcacctcctaaaggcctcacctcttgatactaccacaatggcaaccaggtttccagtacatgaatttttagggggatcattcaaactatagcaccctcctttatcccttaccctattccattagttttaatccccactttgtctcttcctctaatcttcagtctacactgtgacatgataggtatgctcaagtctctaacagctctaaaataacgttttctgtttttttttttgtcttcatttctggtggggttggataagaaaagtttttcaagttaaatcactctctattgcaagcctcttccaccttttttttttttttttttgcttcgaagaatgattgcctttaccttctcagttctcagttattttccagcacattatgattttatgaccttgatacagaagggctgggctcctggctaaattccacccttaaacctggaactgcaaccctaagtgaaaacagctaaccccattttttttcccacccaaatgttgcctctttggcctgccatgcccctatcctgtgctcataaaaatatttcagctgggctgggtgcggtggctcactcctataatcccagcactttgggagaccgaggcaggtggatcacctggggtcaggagttcaagaccagcctggccaacatggcaaaaccgtatctctactaaaaatacaaaaattagttgggcatggtggtgggcaccataatcccagctacttgggaggatgaggcaggagaattgcttgaacctgggcggcggaggttacagtgagcccagattgtgccagtgcactccagcctgggcaaccgagtgagactctgtctcaaaaaaaaaaaaacaaaaacaaaaaagatttcagcagctgggagaacaatataagcagctgacgtcagggatataaatggctgtgtgttgggaatacaagcagctgattgtcggaaatacaagccactgagtgttggtgatacaagtggctgagcagcgagcagagaatcaggtgagcgttggagactatggatgggacgtggctaacttcagatggtgcagctttggagaataggcccagccggagatggcctggcttcagggaaagatcaccttcttcccataccatccctttttcaactccccattctgctgagaaccacttccatcgtgcaatacaatcttctgcatatactacccttcaatctgttcatgtgatctgattattcctggacactggaagagaacctgggtgccaagaggagagggcaggggctgccaccctgaccctccactgagctggctggcacctggccatccccgaatggccgcgttgaaggagcattgattgtaacacacttggatgctgctgcggggccgcatagagcctgcgcctgccagagaggagcaactggctggttcccgcattcgtttgctctgattcccacactcactcactcgcttgcacactgcctcttgcaaggggtttgagtgtgtggtggccgagtaaacgagccacgctccgagccatgagggggtcaagggaattatccagtctcatctcaatccgacttccctcttcactgttttacttttgtaaaacccttgatgaacttcccattgtcaattcagggtctttttagctctcatcctgccagactgttgataacacctctgatttgtgctccacttttggcttctgtgtcatattgattcctgagttttcttccttctcctctattctcttaatctcgttttctggttttctcccatcacctgctggttaagcttaggggttatttacacttctctccttggtcatctttttactgtatttttccctccacagctatttcatccatttctgaggcctgagatttcatccatttctgaggctatagagaccagtgacttcctctgactcttctgagcttgaaattcctattggtaactgccattggacttaactgcctggttatatctctaactaaagtacttctctcttccagcctgtttatcttattgtgttccattgtgttccttatctctaccaatgctagttccttatgctagaaatctcattcattgccactcaatcaagtttgctaaaaacgaaacatctgattgtgtcacttattcaaccttaccaatttttttttttttttgagccttgctttgtcacccatagtggcacgatctctgctcactgcagcctccaccacccaggttcaggtgattctcctgccgtagcctcatgagtagctgggattacaggcatgtgccaccatgcccgactaatttttatatttttagtagagacggggtttcaccatgttggccaggctggtctcaaactcctgacctcaagtgatctgcccaccttggcctcccaaagtgctgggatttcaggcgcctggcctgttacttgattatatgctaaacaaggggtggattattcatgagttttctgggaaagaggtgggcaattcccggaactgaggatccctcccctttttagaccatacaaggtaacttccggacgttgccatggcatctgtaaactgtcatggtgttggcggggagtgtcttttagcatgctaatgtattataattagcgtatagtgagcagtgaggataaccagaggtcactctcctcaccatcttggttttggtgggttttggccagcttctttattgcaaccagttttatcagcaagatctttatgagctgtatcttgtgctgacttcctatctcatcccgtaactaagagtacctaacctcctgcaaatgcagcccagtaggtcttggccttattttacccagcccctattcaagatagagttgctctggtccaaacgcctctgacacaaggattttaaagtcttattaattaaggtaagatagttccttgcatatgtggtctgaaatcacagaaagctgaatttgaaaaaggtgcttggagctgcagccagtaaacaagttttcatgcaggtgtcagtatttaaggtacatctcaaaggataagtacaattgtgtatgttgggatgaacagagagaatggagcaagccaagacccaggtaaaagagaggacctgaatgccttcagtgaacaatgatagataatctagacttttaaactgcatacttcctgtacattgttttttcttgcttcaggtttttagaactcatagtgacgggtctgttgttaatcccaggtctaaccgttaccttgattctgctgagaatctgatttactgaaaatgtttttcttgtgcttatagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctgtacgtatgagttttgttttattattctcaaagccagtgtggcttttctttacagcatgtcatcatcaccttgaaggcctctgcattgaaggggcatgacttagctggagagcccatcctctgtgatggtcaggagcagttgagagagcgaggggttattacttcatgttttaagtggagaaaaggaacactgcagaagtatgtttcctgtatggtattactggatagggctgaagttatgctgaattgaacacataaattcttttccacctcagggccattgggcgcccattgctcttctgcctagaatattctttccttttctaactttggtggattaaattcctgtcatccccctcctcttggtgttatatataaagttttggtgccgcaaaagaagtagcactcgaatataaaattttccttttaattctcagcaaggcaagttacttctatatagaagggtgcacccttacagatggaacaatggcaagcgcacatttggacaagggaggggaaagggttcttatccctgacacacgtggtccctgctgctgtgttcttcccctactgactagggttagactgcacaggctaaactaattccaattggctaatttaaagagaatgatggggtgagtgctttggcaggagtcagggaagagcaggtagcaggtaactggaatgagggtggagcaggtaatggaaaaacattgctttacgaggaagttaagtttaaaagtagaaggcaaagaattgaacatactggcgtattaattctttgaaatttagaactcacatctaacattggcttaaatgttaaatcctcaaagataacattcctgtttctcctaacacgattaagtccttcttggtatcttttctcatagcaacttgtcctttctcacttgtcacaatttgcaaatatatatttatttacattgtttatttaatgcctaatttccttctttattgcaaggcctgtgagggtactgagtctccagggtgaggtgtataataaatggccaaacgaattgttaattgaaaggatgaacaactaattcaagccagcactctctagactcctggggggctatcatgtgggttccctggtgctgctgatgtcagcccttggcctccaagaaaaatgcttgattcaaatgtcatctagttccatctctacgactctcatggggtccaaagaagagttttaattgagttttagaatttgaagttgtgaagtgtctgaaaaactacatggtgttctgaaagccaaacttttagccttttgggagagcatctaagacagcaggtgaagggcaggggttagaactagagggattgaagaatattatccatataggttagggttaggtttggcaacgtattatagaacaaacattggcaagctacagccacaggccagatctgtctgctacctttccacaaaggtgtaataacaaagttattcacaaatttgtgaataaactttcattggaaagtgaccacgctccttggtttatacattgtctgtggctgctttcacactacagtagcacagttgagtgtttgcactggagaccatatgacccatagagcttaaaatattcagtctggctttttacagagatgtttctgactttgttaatagaaaatcaaaacaactggtttaaataatgcacatactttctctctcatagagtagtgcagaggtaggcagtccagattagtacggtggcttcacgttcatcaaggactcaatctccttctttcttctttagcttctaacctctagcttacttcagggtccaggctggagccctagccttcattctgacagtaggaaggagtaggggagaaaagaacataggacatgtcagcagaattctctccttagaagttccatacacaacacatctccctagaagtcattgcccttacttgttctcatagccatcctaaatataagggagtcagaagtaaagtctttttggctgggaatattggcacctggaataaaaatgtttttctgtgaatgagaaacaaggggaagatggatatgtgacattatcttaagacaactccagttgcaattactctgcagatgagaggcactaattataagccatattacctttcttctgacaaccacttgtcagcccacgtggtttctgtggcagaatctggttctataacaagttcctaataagctgtagccaaaaaaatttgatgaggtattataattatttcaatataaagcacccactagatggagccagtgtctgcttcacatgttaagtccttctttccatatgttagacattttctttgaagcaattttagagtgtagctgtttttctcaggttaaaaattcttagctagattggtgagttggggaaaagtgacttataagatacgaattgaattaagaaaaagaaaattctgtgttggaggtggtaatgtggttggtgatctccattaacactgacctagggcttttgtgtttgttttattgtagaatctataccccattcacagaagataccgagactgtgggccagagagccctgcactcaattctgaatgctgccatcatgatcagtgtcattgttgtcatgactatcctcctggtggttctgtataaatacaggtgctataaggtgagcatgagacacagatctttgctttccaccctgttcttcttatggttgggtattcttgtcacagtaacttaactgatctaggaaagaaaaaatgttttgtcttctagagataagttaatttttagttttcttcctcctcactgtggaacattcaaaaaatacaaaaaggaagccaggtgcatgtgtaatgccaggctcagaggctgaggcaggaggatcacttgggcccaggagttcacaagcagcttgggcaacgtagcaagaccctgcctctattaaagaaaacaaaaaacaaatattggaagtattttatatgcatggaatctatatgtcatgaaaaaattagtgtaaaatatatatattatgattagttatcaagatttagtgataatttatgttattttggatttcaatgcctttttaggccattgtctcaaaaaataaaagcagaaaacaaaaaaagttgtaactgaaaaataaacatttccatataatagcacaatctaagtgggtttttgtttgtttgtttgtttgttgaagcagggccttgccctgtcacccaggctggagtgaagtgcagtggcacgattttggctcactgcagactcaacccaccagtttcaagcgattctcctgcctctgcctcccaaatagctgggattacaggtgtgtgccaccacactcggctaatttttgtatttttagtagagacagggtttcaccatgttgaccacactggtctcgaactcctggcctcaagtgatctgcccaccttggtctcccaaagtgctgggattacaggcatgagccactgcgcccggccctaagtggttttaatattttgattgacagtatactgaagaaatatactctaagacctttatgaatctcctcattcacaaataacactgtaggatataatggtccctataaaatacggtataactaaaatcagatttttatattggagtacagaacaataaagccatcttcagatgctggtattaaactcactggtgactggtcacaccttgcctaaactggtagccaccatgcatcctctcaccatctccactgtactacttccttccttgggaagtcgggcgctgggaggttgtacaggaaagatacagacccacccttctcagcctctcctcccctagctcgctcttttgccaaagtgacctactgctgagtttcaaagtgacctactgctgagtttcagccaactagcacgtttcagattcataccttagaaaaaattacacattatcacaagtcatgcaccttttaaggtcattttcaaataatagaaattataagtgttcggccaggcatggtggctcatgcctgtaatcccagcactttgggaggccaaggcaggaggattgcttgaggtcaggagttttttttgtttttttgtttttttccccgagacgaagtctcgctcttgtcccgcaggctggagtgtgacagcgcgatcttggctcactgcaagctgtgcctcctgggttcaagcgattcttctgcctcagccccccgagtagctgggattacaggcgcctgccaccacacccggctaatttttgtatttttagtagagactgggttttaccgtgttggccaggctggtctagaactcctgacctcaggtgatccacccacctcggcctcgcaagggctgggattacaggcgtgagccaccatacctggccgaggtcaggggtttgagaccagcctgagcaacatagtaagacctatctctaccaaaaaaaaaaaaaattaactttccaaatgtaggagtctactctgtttccttctagtatttatttctgtatacttttctaacatggttaaaatgtgtaatcaatatgtgtccttttactttggtgtgaacattttttctattataaattcttagaaaatatttctatggctatgagatatttgattcaagtgccttgtaatttacttctcaaatgtccctgatgttggacatttgtttctagtgtttcactattttaaaaaacagtaatatctgtctttatgcttagagctttttcagtttttcaaattatttccttagggtaaaatcctagaagtagaatttttggggcaaattatctacatatttataactgtcttggtattcaaaatctcgttttcaaaaagcttatatcaatttgtacttaacaccagtagtgaatgagagtatctgtcgtaccccaccagtgctgaatttcttttttaaaactgtgctggtttttataggtaaagaaaatgtcttaatttgcatttagttggttactagtaatatcacataccttttcaatgcttgtgaactttaagcttatacagagtttaaccttgcatgttgaacatttgagtgagtggaagtgttaagtgatggccatctgtataatctattagtaatgtatggagaccattaaagatgacaggtatgtgtgatgatgacaggttgttaccaacactcagaaggccaaaaagcaagtgatataaacccatgctgggaagcattcacctcccccactttaaaaatgctagtttcttaattccttttctttatccctttttttgtctgcacgtgtttacttgcctttagtttccctgctttagtaggctgaccttgtgacttttaccaggatcccattatacttttgttcttctgtttatttctcagattttattggagggtggaattctactttttctttcttataatctagaatttacattcagatttcctgcctttcccttacaaaatacctgtgtagttggataggtggagctctggactcagagttctttcttctagtaatcttaggaaattatttaatttttctgtgttttcatattttcacacataaaagagaaaacaccatttctaaactacctcttcttttctctgcttttaagcatgtaaaggttttcccaatcttgggcagtgacatgtacaggacagtatagctttacatctgccttgttttaattaaacactagttctttgaggtaacccctactattatcccagttttatggatgaggcactgaggcaggggtcacacagctagtgtgggtcagaacctaatgggtcagaatggacatttgagtccagagtttggcctggattgacacacatagctattacgtaagattcctctcaaattcagtcctcagctccctgaagtgtgggttctcttttcatgcctccatggaaactgcgtatcatgtggttaccagtttttcctttggtcgtatctgctgacctttttgaacctaattttttctggaccttattgccatttgacttatttattgcctcccacttgacactgattctggcttttgcttttcttcctactttggtcctttttgcagttttctaaagctaaccagccatgactctcagatgatggactttttcgtctctcccattacttcttgggaaattatattttaatctcatggtttaaattttcatccttaaatataacttttaatgtagtatttttagcccagaagggcccatggttggtttgttttctcctttgcatatctcttctactcagatacctggtagcatataaatcaaatgaattatccttcataccatttcattatcatcagtaggactgctttgctggggtttttttgtgtgtgtgtttttgtttttgtttttgtttttgttttgagataaagtcttgctttgtcacctaggcaagagtgctaggattacaggcgtgagccgctatgccaggacagccgttttcttctagtattatttgccctctgtctgaacatcttcctttagtaatgcttttagagcaaggcagctggcctcaatttgttttaatttttcttccccttaggatgttttaattttacctttattactgaaggatattgttactgggcagaaaattgtcttgatattccccttttcagcatttaaaaaatgctcttctgctttctttcagcctccatggtttctcataaaaatcagtcattcgaatcactgttcttctaaaagtaatacattgttttgttctggtcactttcaaaattttctttttcttttcagcagtttaattatgggactgtgtgaggatttctttgttcattctgtttggagttcactgagctttttgaatctctaggtttatgtcttttaccaaatttggaaaatttttcaaccattatttcttcaaaatttttctgtaccacattctttactctttttttttttgaaacagagtggcgcactgcaacctctgccttcccggttcaagtgattctcctgcctcagcctcccaaagtgctgggattacgggtgcctgccaccatgcctggctgattttgttaatttttagtagagacggggttttaccacattgaccaggctggtcttgaactcctggccttaagtattccgcctgcctgggcctcccaaagtgctgggttacaggtgtgagccaccacacccggcccttttttttttttttttttgagaccgagtctcgctttgtcacccaggctggagtgcagtgatgtgattttggctcactgcagcctcagcctcccaagtacctgggattacagagatgtgccaccatgcccagctaatttttgtatttttattagagatggggtttcaccatgttggccaggctggtcttaaacccctggcctcaagtgatccgtctgcctcagcctcccaaagtgctgggattacagacgtgagccaccatgcctggctctttaccctcttctgggagtgacaacacaaataactttttattccacaggtttctgaggctctgtttattttccaatttttttcactattgttctggttagataatttctattgatctgtcttcaagtttcctgaaatttgcattttgttggtaaacctattcagtaaaatgtttttggttattttatttttagttctaaaattcctatatagcccgtctttacatttttttattctgaaacttaaaactttcctttcattttaagagtgtttgcccttacttcttggagcatttttatgctccaaggattttgatatttttgttttattggccaattgatctgattgggctaggtccagccagccttgtcaaagcctttgcagtgttgctcagatctgccccatgtatatgccacccagtcaccagtctgggactggtatagtggtgttctatttgtaattcggttgtcagggtcggtgtgtactgttgaggatcatatccatactcactcaccttgggaatggacccacaagtttataaacagctttaagagattgctttcatgagtttctttctttctgtgatctccatgtggtttcttgggcttcccttttccattcctgcagccaaaagtggactttatcttcctaaagtcagggccaaaatgtgggaggagagagagaaataaagcaagggctatttgccccactctctcgggactgacattcttccagtcagagtaaggattccctccctctgaattttaggcttctgccacccacattaccatcaccacaggattgtgtgaggactgggcatacgagaatggagaaaagcggaaaagaatgccgggtgtggtggctcacgcctgtaatcctaacactttgggaggccaaggcgggcagattgcctgagctcatgagtttatgaccagcctgggcaacacagtgaaaacctgtctctactaaaatacaaaaaattagccaggcatggtggtgggcacctgtagttccagttactcaggaggctgaggcaggagtattgcttgaacccgggaggcagaggttgcagtgagccaagatcgtgccactgcactccagcctgagctacagtgcgagactctgtctccaaaaaaaaggaagaaaaactggatttttacactgtctgggtgttaggagacctctttcctgatcctcaagccagaactagaggtcttctggagctcccattgtcttgctaatgcccactcatgttgtaatgagcacaggtggaggaaaaaaagtggtcagctcactgctagtacttctaattccccagcccacctacctctcattacttttcatcttttgcaaccagctgctgcctgctttctgcccaggttttgtaactgtattcagtgggatagagagagtggaaggtacttactccatcttatctggaacctttcttaatatattttttgtcgcatttgtacatcttttatccatccttcattttattttatttttttttttgagacggagtctcagtctctcgcccaggctggagtgtagtggcatgatcttggctcactgcaacctccgcctcctgggttcaagtgattctcctgcctcagcctcccaagtagttgggattactgggacacgccaccatgcctgggtaatttttgcatttttagtagagatgagggttccccatgttgcccaggctggtctcgaacttctgacctcaggtgatccactggtttcggcctcccaaagtgctgggactacaggcctgagccaccacgcccagccttatccttcattttagacagtttaagaggtttgtattcagccagatctccacatttacttgttcatttgtgttgtgatgttttttaatgttcaagtcttagcacacacaaacaattatatagaaacaagttgtttactttgacacccagtataactaaaaggatcttttgagtcagagattgagtaacttgccagagcctgtttggaaataaaccctgaggatttttcatatcagtggttggttatgcaatgtctgtggcaagccctagaaactaaaagaccaaaccttaaaatgttaaaaacaggaaaggcagttaattattatacataatttgttataaaaggaactataacttattaaagtcagatgatttctggccttgatagtttagggtttagagaagatactgttgtgtactataaaacagcagggctgttttctttcataccctttagcacaggaaagctgaactagggatttttgcaagatgagaaaggcctgttgaaatgtgtgtgtataacatagtaataaaagaaatgcatatgaaaataacaaattaacatatttgacatattgactttgtcaagattagtcttttttgtcaagtaactaagccagtgtgtattaattaaatcagtaattagaaaaagtttgtacactttgatttagtaattttgcttttatgatatattctaaagaaggaattagaaatgcagaaaaatatttgtgaagtaggatgttcattttaatgtaaattaaaattggggaaagaaagggaaaacaatacagattccatgcataaggcaaaggttcaattgtgggtttatccgtatgagtagactattattttgtcatttaaaaatcatagtttcagctgggcgtggtggctcacgcatgtaatcccagcactttaggaggctgaggtgggcggatcacctgaggtcagaagatcgagaccagcctgaccaacatggagaaatcctgtctctactaaaaatacaaaaaaattagctgggcgtggtggcgagtgcctgtaatcccagctactcaggaggctgaggcaggagaatcgcttgaatctggggagtggaggttgcggtgagattgcgccattgccctccagcctgggcaacaagagcaaaactccatctcaaaatcaatcaatcaatcagtcaatcaatcatagtttcacgccaggtgcagtggcacggacctgtagacccagttacttgggaccctgagacgagatgattgcttgagcccaggttttccagtctagcctgggaaacatagtgagaccccagtctcttaaaaaaaaatcatattttcaaataatatttggtggcatgagaatatgtttgtaataaaagattacatttgtgaaagcagaatgtaaacagtacactagttgattctcactgttaaggtctttacacacgcctatacgtgcagatagaaaacatgtctgaaagggaaacggttttattttgtttcgtatttttttttgagacaatgtctcactttgtcagtcaggctggaatgtagtggcactgtctcggctcactgcaccctatacctcctgggttcaagcaatcctcccacctcaacctccatggtagctgggactacaggcacctgccaccacgcctagctaatgttcgtatttttagtagagacggggttttggcatgttggtcaggctggtcttgaactcctgacctcaggcaatccacctgtctcagcctcccaaactgctgggataacaggcgtgagccactgtgcctggcctgaaagggaaatgttggtattaattttggttgtcactggcctttagaatagttttcttcttttagtgtttctgtgtttcttaagtgttacaagcatatgttacttttgattcagaaaaatgctatttttaaaataagcaagactgggcacggtgactctcaccagtatggctgagaccagaggatcacttgaagccaggagttcaaaaccagcttgggcaacagagtgagacccccacctctacaaaaagaaaaaaaaaaaattaaaaaattagccaggcatggtggtgtacccacgcctatagtcctaggtactagggaggctgaggtgggagtatggcttgagcccagtggttcgagattgcagtgagctacgatcatgccactgtaccccagcctgggcaacacagtgaggccctatctcaaaaaataattaaaaaaaaaatatttgggggctcctagaaggtacagttaaaaaaattaaaattaggccgggcatggtggctcacgcctataatcccagcactgtgggaggctaaggagggtggatcacttgagatcaggagttcaagaccagcttggccaacatggtgaaacttcatctctaatacaaaaatcacctgggcgttggtggtgggtgcctgtaatcccagctactcgggaggctaaggcaggagaattgcttgaatctgggaggtggaggttgcagtgagccaagaccatgctactgcactccagcctgggcgacaaagtgaggcttcatctcccaaaaataaataaataaaattaaaaaaagaaataaataagaacatctccttcttcctttgccaaaaaaccgaggtgaaaagcatctctcaagaatgatgagaatttcaattatttaatatttactctggtccttaatttaaagcttaatatggaatcccagtgtacatctcccactggtattgtttgtcttggccaagacagacaagttttaaagagtgagataaaatttaggctaaagttgaagtatttggagggaaatgtacagatgttctcagcttaccttttttgtttttttgagatggagtctcgctctgttgctcaggctggagtgcaatggtgcgatctcagctctccacaacctccgcctctcaggttgaagtgattctcctgcctcagcctcccaaatagctgggactgcaggtgtgtgccactatgtctggctaatttttgtattttttttttttaatttattttttattgataattcttgggtgtttctcacagagggggatttggcagggtcataggacaatagtggagggaaggtcagtagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaaacacatcttgcaccgcccttaatccattcaaccctgagtggacacagcacatgtttcagagagcacagggttgggggtaaggtcacagatcaacaggatcccaaggcagaagaagttttcttagtacagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggtgcccctcacctcccgggcggggcggctggccgggcggggggctgacccccccacctccctcccggacggggcggctggccgggcagaggggctcctcacttcccagtaggagcggccgggcagaggcgcccctcacctcccggacggggcggctggccaggcggggggctgatccccccacctccctcccagacggggcggctggccgggcggggggctgacccccccccacctccctcccggacagggcggctggccggccggggggctgacccccccacctccctcccggacggggcggctggccgggcggggggctgacccccccacctccctcccggacggggcggctggccgggcggggggctgacccccccacctccctcccggacggggcggctggccgggcggggggctgacccccccacctccctcccggacggggcggctggccgggcagaggcgcccctcacctcccggacggggcggctggccgggcggggggctgacccccccacctccctctccgacggggcggctggcctggcagaggggctcctcacttcccagtaggggcggccgggcagaggcgcccctcacctcccggacggggcggctggccgggcggggggctgacccccccacctccctctcggacagggcggctggcctggcagaggggctcctcacttcccagtaggggcggccgggcagaggcgcccctcacctcccggacggggcggctggccgggcggggggctgacccccccacctccctcccggacggagcggctggcggggcggggggctgacccccccacctccctcccggatggggcggctggcctggcggggggctgaccccccccacctccctcccggacggggtggctgccgggcggagacgctcctcacttcccagacggggcggctgccgggcggaggggctcctcacttcccagacggggcggctgccgggcggaggggctcctcacttctcagacggggcggccgggcagagatgctcctcacctcccagacggggtcgcggccgggcagaggtgctcctcacatcccagacggggcggcggggcagaggcgctccccacatctcagacgatgggcggccgggcagagacgctcctcacttcctagatgtgatggcagccgggcagaggtgctcctcacttcctaggtgggatggcggccgggcggagacgctcctcactttccagactgggcagccaggcagaggggctcctcacatcccagatgatgggcggccaggcagagacgctcctcacttcccagacggggtggcggccgggcagaggctacaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggtggatcacttgcggttaggggctggagaccggcctggccaacacagcgaaaccccgtctccaccaaaaccagtcaggcgtggcggcgtgagtctgcaatcgcaggcactcggcaggctgagtcaggagaatcaggcagggaggttgcagtgagccgagatggcagcagtacagtccagcttcggctcagcatgagagggagaccgtggaaagagagggagagggagaccgtggggagagagagggagagggagagggagagcgcttaaaacaatttttaagatgtatttcttttctcatagttccagaggccagaagtcccaagtcaagggttggaagcaatttttgtatttttagtagagatggggttcaccatattggccaggctggtcttgaactcctggcctcatgatccgcctgccgtggcctcccaaagtgctgggattacaggcatgagtcactgcgcccgatctctcagtttactttgatatgtattaataataacaaagactaatggatgaggagctagacagaaattttataaaccaagtactgcaaaatatgaatggtagactctaggtgatatatgggtgttcactgtaaaattaattaaattttgctgtgtgttcgaacatttttgtaacaaaatgttggaaaatttttgtggaagaacaccagaaacaactttgttgtatctggatataatttagaatattcaaatgttggctaggtgcggtggcaacctgtaatcctagcactttgggaggccaaggcaggtggatcacctcaggtcgggagttcgagaccagcctgaccaacatggagaaactgtgtctctactaaaaatacagaattagccaggtgtggtggcacatgtctgtaatcccagctacttggggggctgaggcaggagaattgcttgaaccctggaggcggaggttgcggtgagccgagattgcgccattgcactccattctgggcaacaagagcgaaactccgtctcagaaaaaaaaaaagaatattcaaatgtccaaggagtaccaatatctaggtaaagccattctgttggcctttgccaaattgtactattttataaagttgttttaaagagagatgtgggccgggcatagtggtgcacatctgtaatctcagcactttgggagtctgaggcgggcggatcacttgaggtcaggaatttgagaccagcctgggcaacatggcgaaaccctgtctctactaaaaatacaaaaattagcctagcgtggtggcgcgcacgcgtggttccacctactcaggaggcttaagcacgagaattgcttgaacccaggaggcagaggttgtggtgagctgagatcgtgccactgcactccagtctgggcgacaaagtgagaccctgtctcaaaaaagaaaaaaaaaatctgtactttttaagggttgtgggacctgttaattatattgaaatgctttcttttctaggtcatccatgcctggcttattatatcatctctattgttgctgttctttttttcattcatttacttggggtaagttgtgaaatttttggtctgtctttcagaattaactacctttgtgctgtgtagctatcatttaaagccatgtactttgttgatgaattactctgaagttttaattgtttccacatataggtcatacttggtatataaaagactagtcagtattactaattgagacattcttctgttgctccttgcttataataagtagaactgaaagaacttaagactacagttaattctaagcctttttgaagattatatagtcttctagtagaagtctgtgcatcagaatgttttaagaaagggttttaagaatgtataaaaaccaaaataattgattttcatacttctatattgttttttatcagtgactcttttttctttcaaatgaaatcttatatgaaattttcatatataatatagaaaaaagtggatctagtctgtcaaagagaatagtgaagctcagagatgtgccagcctggcctttttctcagctcaagtggcagaatacagtttgtaaacaattgcactagctcttaaattcgaagaggcagtcaaactaataaataaattggagagttatttctttggtagaggattaagggaaataaccacagacagaagaagcaaatatgagaatctatgtgaaatggatgatattctagaaaaaaaattatcaaaactgacccctaaagagagaatatctaaacagagtaaagaagaggtacagaaagttactgaagaagtttccaccccacctgcacaaataacaatagtaccaggccccagtggattaatggggaaattctgttaaacctttaaggaatggtaactctaatactaagtgttccgaacatataaaaagaaaaaaagcttccagattaattttatgaagccagcataacattaataactaaagccctgcaagttatcaagtaaaagaaaactattggtcggttatatttattgatttcaaaagcataacagaatattaagagaattcagcaatagatgaaaagaataatactttttttttttgagtctcacgctgttgcccaggctggagtgcagtggcatgatctcggctcactgcaacccccacctcctggattcaagcgattctcctgcctcagccccctgagtaaccgggactacaggtgcgcaccaccatgcccagctaatttttgcatttttagtagagacagagtttcaccatgttggccaggatggtctcgatctcctgacctcgtgatccgcccgccttggcctcccaaagtgctggaattaacaggcctgagccaccgcaccctgccataataatacatttgaccaagtggagtttgtttgcagaatcgttcattataagttgccatattactagatcatcatctctgtatgtgctaaaaggcatttgataagattcctgttcttgatcagattccttaataaatagacggggtcgggtgtggtggctcatgtttataatctcaatactctgggaggctaaggtaggaggatagcttgaggttgaaagttggataccaacctgcgcaacataacaagactttgcctctacaaaaaataaattagccagttgtggtgtgtgcatgtagttctagctgcatgggagactaaggcgggaggatggcttcagcccaggaattcaaggctgcagtgagctatgattgcaccactgcaccccaggctgggtgactcagtctctaaaaataaataaataactaaatctctaacattataaaatgtatgcatctcattctaaaggccaatgtcatcctcatagggaagctagaagcttgcctattaaggtcaggaatgagatggaggttttcttttctttcttttgtttgtttgttttttgttttgttttttctgagatagagtctcactctgtcatccaggctggagtgcaatggtgtgatctcggctcacaggaacttctgcctcctgggttcaagcgattctcctgcatcaaggcctcccaagtagctgggattacaggcacctgccactatgcccggctaatttttgcatttttagtagagcaggggtttcaccatgttggccaggctgttctcaaactcttgacctcaggtgatccacctgcctccgcctcccaaaatgctgggattacaggcgtgagccactgtgcctggctgagatgaaggttttctttatcaccaattatctagcattgctctggagggactagcaaacacaattaaacaggagaaagaaatacgaactatataatttggaaaagaaggttaaattaccaatatttggagataaaatgattgtttactttgttttagaactaactgaaaaccaattcaaattactaagtaagtttggtaaggcaattaattgattacaaaattaaacaaaagtcccctgtctgggtgccgtggctcatgcctgtaatcccagcactttgggaggccgaggcgggtggttcacctgaggttaggagtttgagaccagcctggccaacgtggtgaaaacccacctctactaaaaatacaaaaaattagccgggcgtggtggtgggtgcctgtaattccagctactctggaggctgaggcaggagagtggcgtgaacctgggagatggaggttgctgtgagccgagatcgcaccattgcactcccacctgggcaacaagagtgaaactccatttcaaaaaaataaagtgaaaacacaaatcaataaccttcacataaacaactagttagaaaacataataaaaggataagtcccatttatgatagcagcaaaaaagattaaatatctacgagtaaacaagaattgtgcaagccctggacactggtgaagcagagatgccagctgaggtcctgcccccagctccccttaagctgagcagtgtggagaacatcttgcacaggctgctgactgccttccaagaagcccttgacctttaccatgtgttggtctcccttgaccgggtgggcactgagcagtagcaggtgtagactgagctggcctctaacttcctttggatccacagccagttgtaggccaacaacggggtggaggggtctgatgtggctccaggccctctccagctcaggttacccctccttatgtacattgtactcagagctgctagtgcaggctgtgcagaggaaggcaggggacactgaggtccagcagtccctgctcctgcttctgaagaaatagatattttaagtgaataaactgacagcttagaggggtaaaaaagataatatgcaagatctattgagaattttaaggctgggtgtggtggctcacacttgtaatctcacctatttgggaggccgaggtgggaggatcctttgagcccaggggttctagaccatcctgggcaacatggttgaaactccatctctacaaaaaatacaaaacttagccaggcgtggtggtgcatgcctgtagccccagctgcttgggaggctgagtcaggaggatcacttgagccaaggactttggggctgcagtgaactgtggttgtgccctctatccagggtgacagtcagaccttgtctctatttaaaaaaaaaaaaaaaaaaaattaaaatatgctatcatttgtgtcaagtagaaaagtatatatatgacatgtatagactttctggaaggatgtacatgaaattaatagtagtgctttccaatcaggcacggtggctcacacctgtaatctcaacatttttggaggtggagacaggaggactgcttgagcctaggagttcatagccagcctgggcaacatagcaagaccccatctcaagaaaaagtagtgctttcctctaaagaggggaaccatggggcacagtggggagaaaacctacttttcacagtatctgttgtgaattttatatcttattcatgtgttacctggccaaagattaataaatagattgtttttgtttttgttttttagtttgaggatactggaaatgcttaatataaatatctacatcgtccagaaatttcaatgtttactctattttggaatttcaaagtgggagaggaatcatctttttggatggtacctgaaactgaaagtttatgcctaaaggcgtgcttgctttctcctcagttacctcaggcatcttctacagttgcaatctctttgttgttagatggtggattttgcctccccagaattaaaatagcattttcttcattataaaaatacttaacattcattgtttttttaaaaaagacattatataagattataaagaagaaaaatgaccagattcccaccacctaaagataagtcctgtcatcctttcaggaattaatatatcaatttctcatctactcttctctcacactactttgcataaatgggatcataaatgggatcctatattttttcaagcaacagtgtgttatgcctatactccatgtttatatgtgtgtattaaaaaatgtatttgtatatatgtgtatgtataagtgtgtgtgtgtgtatgatgattcttctcccgctttgaaggtgaaagaaagcacacctttatttaagcataaactttgggtttcagatactgtctggaaaaatgatttatctcccactttgaaattccaaaatacgtacatatattttttttttcttttcttttttagttttagggtcttgctgtgttgcccaggctggagtgcagtagtgtgatcatagctcacacagcctctaactcccaggctcaagctatcttcctgccccagcctcctgagtagctgggactgcaggcatgtgccatcaactttagctaattttaaaatttttttgtagtgatagagtctcactgtgttgcccaggctcgtctggaattcctggcctcaagtgatcctctcacctcagcctcccaaattgctgggattagagtgtgagccactgtgcctagcctgcatatatctatttttaatgactgctaaatctcattgtatgaaaatttatgtcctagctataaaatttgttagcacatgtttaattttttctaatttcagatgttttaaactaatatttcccaaagtatagtatggcattttaggtatgatatgatcttttttcctcttcgtactcatttttatagttatggcctgtgcaactggtttcccatttatatgaatgatacagagcttcctattaagaaaaagttcagcttgggaaaaaaaaagtgaattgttcaacttgagggaaaaaagtgaattaattggccaggcaccgtggctcatgcttgtaatcccagcactttgggaggctgagacgggtggattgcttgaacccaggagttttagaccaacctgggcaacatgttgaaaccctatctgtacaaaaaaaattagaaaaattagctgggcatagtggcacacacctgttgtcccagctacttaggaggctgagctgggaagaccacctgatctccggaggtaaagactgcagtgagccgtgattgcaccactttactccagcctgggcaacaaaatgagaccctggctcaaaaacaaaaacaaaaacaaaaaaagagtaaattaatttaaagggaagtattaaataaataatagcacagttgatataggttatggtaaaattataaaggtgggatattaatatctaatgtttgggagccatcacattattctaaataatgttttggtgaaaattattgtacatcttttaaaatctgtgtaattttttttcagggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatggtaaaacccaagactgataatttgtttgtcacaggaatgccccactggagtgttttctttcctcatctctttatcttgatttagagaaaatggtaacgtgtacatcccataactcttcagtaaatcattaattagctatagtaactttttcatttgaagatttcggctgggcatggtagctcatgcctgtaatcttagcactttgggaggctgaggcgggcagatcacctaagcccagagttcaagaccagcctgggcaacatggcaaaacctcgtatctacagaaaatacaaaaattagccgggcatggtggtgcacacctgtagttccagctacttaggaggctgaggtgggaggatcgattgagcccaggaggtcaaggctgcagtgagccatgattgcatcactgtattccagcctgggtgatagaacaagaccttgtctcaaaaaaaatttggtttttcaagctttttgaggttttgacaagctggccaatatggtgaaaccccgtctctactaaaaatacaaaaattagctgggtgtggtggcgtacccttgtattcccagctacttgagaggctgaggcaggagaattatttgaacccaggaagtgaagtggaggttgcagtgagccgagatggtgccactgcactctagcctgggtgacagagcgagactctgtctcaaaaaaaaaaaaaaagcaaaaaaaaaaaagcacaagcagagtggtagacacacaaaatgctcaattcattttttaaacgatttttttcctttatatcttactgcagaagcttttttcttttttttgagacaaagtcttgctgtgtcacccaggctggggtgcagtggcacagtcatagctcactgcaaccttgaactccctggctcatgcgatcctcccacttcagcctctcaagtagctagaactacaggtgtgcaccaccatgcctgactaacttgtttattttttgtagagagaacgtcttgctatattgcctaggctggtcttgaactcttgggctcaagcaatcctcctaccttggcctctcaaggtattgggattataggtgtgagccactgcatctggcctcaattcacttttaaaatcaaaattaggttacctactttttataaggtaatgtatagaattattcttttaaaaataaaaccgatttggacagtgtgagattcacattctgtaaccaccagtgtgacatgggtcctgaacagttagaacatactccagccattaacccaggcagctttcaggtacgtactctgtggctgttgccttgtatgaaagccaaaaagagatccattttcagagattaatatgtgaccccttctatattataaggccatggccatactcttttttttttctttttgtttttttcttccaaagacaggatctctctctgtcatccacgctagagtacagtggcatgaacgtggcttactgcagcctcaaacccttgtcctgggctcaaacaatcctcccacctcagccttcaaagtagatagaactacaggcatgcactaccatgcctaattttttaaaaaaaaattttttttcagagatgagatctcactgtgtttcccaggcttgtccggaactcctggcctcaagcgatcctcccaccttggcctgccaaagtgttgggattacaggcatgagccaccatgcctggccatacactttttttttttttttttttcaagacggagtctggctctgtcgcccagactggagtgcagtggcgtgatcttggctcactgcaagcttcgcctcccaggttcatgccgttctcctgcctcagcctcccaagtagctgggactacaggcatctgccaccacgcccggctatttttttgtatttgtagtagagacggggtttcaccatgttagccaggatgatctcgatctcctgacctcatgattcacctgcctcggcctcccaaagtgttgggattacaggcatgagccaccgtgcccggcctggccatacacttttgtcattatttacatacttactaaaatgtttggtggcctgtaataggaaacatcatcctcatttgattgacgaagaagtctgtggaaataggattgaactggttctgttcttgtatttgagtaatcagttgtggaactatagaagtcatatactctctctgactttcataattaccttatgttgtatagtacttgatggtttgcaaagtaaccatctattcttgcttagctgtgagtaagaatgccaggtctggagacagaatgtctgggttcaaattctactcatcactttttatttttattttttttgagatagagtctcgctttgttgcccaggctggagtgcagtggcgtgatctcagctcactacaacctctccctcccgggatcaagcgattctcctgcctcagccttccgagtagctgggactacaagtgcgcaccaccacgcccagctaatttttgtatttttagtagagacgaggttttgccatgttggccaggctggtctcaaactcctgacctcaagtgatctgcctgcctcagcctcccagagtgctgggattacaggcttgaaccactgcgcccagcctactcatcacttactagctatttgaccacacaagttactcaactcctatgtcagttatgaagattaaattaaatgatccatttaatacaataatacacttagaacaatgtctatcagtaaatttttttctgttttaagaaacaggatctcactctgtctcccaggctggagtgaagtggcacgattatagctcactgtagcttcaaaagcctgggctcaagcagtcctcctgtctcagcctcccgagtagataagactacaggcacaggttggtgttgacctcctagcttcaagcagcctcccaaagtgctgagattacaggtgtgagccactatacccagcccagtgttatatttttgtataatcctatgaagtatcaaggcagttattatccctgttttactgctaagaaacttgaagtttacagaggtaaattatttgcctaagcctaaactctgatctcgaatctgaatcccaagtccaatattcttttcaccgtattacaatatttttaccatcaaccctccattctgtctgcacatcatacaaatgagtatctctacagagctttgagttgcttttaaacaaaagagatttttgtacccaatgtttagagtagtgattctcggctccatttttacaagatttcaagatttaatttgtcaaaaaagttctgaaattttcaaagcaaaagcaattttaatttaattgctctaaaaaataagcagatttatcatttagcaattctttaagggagagtgtatcataaaactgaaatagtactgaatgtggcagaatcaaacaagttgaaaatctcatcacttcagagcagggcagacttctcattcaaacaaattgaggtagaagtggtgagagtagagatttctttgtgtatgtgtgttttattactgtactatattatattatagttctatatatactatattatattgtacatatatattattatatgaagagacatgaccactttgaggcatgaaatttttttttttttttttttttttttgaggcacggtcttactttgtcacctaggcagtggcgccatcttggctcactgcagcctccacctccagggctcaagcaatcctcccacctcagcttcctgagtagctgggactataggcacctgccaccatgagctgctaattttttgtatttttggtagagacggggttttgccatcttggccaggctggtctcaaactcctgagcacaagtgatctgctgcctcagcctccccaaagtgctggaattacaagcataagccactgtgcctggcaagacatgaaatttttaaatgtaaatgcatttaagtgacaataatgtgaatacaagttatcaattcttcctttacaagtttagctatacctgttttatatttttcagtgtttaaaattatttttatatttttatattctgaattttctttctttctttcttttttttttttttttttgagacggagtctcgctgtattgcccaggctggagtgcagtggcgcaatctcggcgcactgcaagctccgcttcccgggttcacgccgttctcctgcctcagcctcccgagtagctgggactacaggcacgcgccaccacacccagctaattttttgtattttttagtagagacagggtttcaccgtgttagccaggatggtcttgatctcctgaccttgtgatccgcccacctcggcctcccaaagtgctgggattgcaggcgtgagccactgcgcccggcctatatgctgaattttcatgacagagaatgaaagaaaaagtgcagttgatcgaaagaaatggtggtataaacaggaataacaggcatgttgtttcctctctgatttattatttttgtaaaataagctacttttcagcaccacatacatatgttctgagacctgaatatttgtgaccaaagagtaaagaagtaataaactttatctcgcaaagagttattattgtgttttatttaaatttactgccctcttacttcaagtacttctcagtagtacgtaatactgcttttaaaaaggagaagggatgaatttcttctactctgctcttcatattttgaaaagttcagtcaaatcccctttattaaattcatctcagagtaatctttttaatttgtagttcatatccgtgattagtttagaagtgacttctccctgtttctgctcactgtaggttgacaactgcttaaaatagtctatctcatcattatctctgcagctttcctttaaactaggaagacttgttcctataccccagtaacgatacactgtacactaagcaaatagcagtcaaacccaaatgaaatttttacagatgttctgtgtcattttattttgtttatgttgtctcccccacccccaccagttcacctgccatttatttcatattcattcaacgtctttttgtgtaaaaagagacaaaaaacattaaacttttttccttcgttaattcctccctaccacccatttacaagtttagcccatacattttattagatgtcttttatgtttttctttttctagatttagtggctgttttgtgtccgaaaggtccacttcgtatgctggttgaaacagctcaggagagaaatgaaacgctttttccagctctcatttactcctgtaagtatttgagaaggatattgaattagtaatcagtgtagaatttatcggaactgaagcacatgtaactatggtcattttcatggtacttgttctcatcttaaatgcacagcattcctggaactcctgcagatctctttgtttccttgcaagcaattgtcttctacctgatgttgattcaagagagttttcaatatgaatagaaagaaagaaaatgtttagatattggggaaccagcattcccattttaaaacctgttaggagttgttgattagggcaagctcaaggattcctttgagtgactggtttagatgtctttctgctattcggtgaccactggggaactgagattgttgagcagaagggtaatgtgagcagagccgtgcctttgtaagctggcagcactgtgtgagatgaattggtgggttggatactgagatcatgagaggcatactaagcataattaagatgatattgccatgatctaggtggaaagtaatgggggtttgaattatggtagtggcagtagcaatcaagggaaagagttgatcagaggattcagaggtagaatcaatagttctagcaactgaggagagaagttgtaagcttgaaggaaaggtgatgaagaaaaaatgctttcctgtgttttcttgttgttgttgttgagatagggtctcactcccatccaggatggagtacagtagtgtgatcatggctcactgcagcctcgacctcccaggctcaggtgatccacccacctcagcctcccgagtagctgtgactacaggcacgcactaccaggcctggctaatttttttgtgttgtgtgtagagactgggttttgccatgtgcccaggctggtcttgaactcctcggcttaagcgatcctcctgccttgacttcacaaagtgcttgagttacaggtgtgagctaccacgcctggccatgttttcttgtgtgaaggatctgtttagttttatatctttctgtggctcatatctaatttagttgacagtacctgtgggtcactaggtagacattgctagcagacgtttagaaatgaaatactagagcttgggaaaaagttgatatttgagatagagacttgaagaacattagcagagagttggtagttaaggtctgtgagctggtgagcaattcaaataaaagcagaagagaagaggaagacaagggtcaaactttgtcaactactgtgtttagagaatgagacaagagaggatactacaggaagtagaggaaaatagtggaaaattgggcaagccagtatttttcacttaagaatatcattactgttttttgatgtcagcacatgaaatggctgcatagtgttctcttacgtagatattcagtggtgggtatcctcattgatagacatttagatcatttccatttattttctatcacagacagcacttacagagtgcatccatgaacttatgaatattattataaaatgtattcttacagtagaattgctaagtcaaaggatgtatttaaattttgatagtttgccatattgcctcctaaaaaagctgtgcctgtttacattcccttcagtaatatgaaagtatcaatttccttacccctttggtgttttggtttgttttgttttggagactgagtctcgctctgtcatgcaggctggagtgcagtggtgcgatctcggctcactgcaacctccgcctcctgggttcaagcagttctcctgcctcagcctccggagtggctgggattacaggcgtgtgccaccacacccagctaattttttgtatttttagtggagacacggtttcaccatgttgaccaggctggtctcgaactcctgacttcaggtgatccgcctgcctaggcctcccaaaatgccaggattatagctgtgagccaccatgcccggccactgctttgttaatgcttgcctgtgtctgtgcatacatgcatgtgtgtgtgtctgagagagaaagagatctaataggcaaaaaaataacatcttgttttattttttattgtttgtctaatgctttgggtgattatttgaactttttttcatgtgtttcttagttacagatctgaatttattttgtaactggcttggtataatctttttcatatttgtgaaattaatcttttttgtgtgtgtgtgagacagtctctctctgtcacccaagctggagtacagtggcgcaatctcaactcactgcaacctccatctcccaggttcaagcaattctcctctctcagcctcccaagtagctggaattacaggcgcatgccaccacgcctggctgatttttgtatttttagtagagacgggatttcaccacgttggccaggctggtctcaagtgatccaactgcctcagactcccaaagcattagtattacaggtgtgagccactgctcccagccctgtaaaattaatcttaattatacaagtaattcattatccttgaaaaaggataaacattacagataaaaataaatttcacggtaactatcatctctaatcttaatgccttatcaagtacttacccctgttgtcagtttgttgtatatccttgta

SEQ ID NO: 172 - DNA, 189090 bp, Homo sapiens
agcaacacagaatgcaactgatgaccaatatatattcacaaataattgaggaccatggctaagagttgcattcggattccgatgtgactgctattgtccttaacacggactagctccaggtgagtcccccggccccgggggtgtggcgggcgtcacccgttgtccgggcacacaccccgcagacccaatcctagcccgctggctagaccatggagggccgctgggtgcagccacagagcgcggggccccggcgaccccgccccgctccgcgtcactcggcgccctgcggcgcgcgatgagcacctaccactagcggagccgcgagggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcaggtaaacacgcgcgcccgggcggcggggtcggcccaagaactggcggagcggcccgcgaccccgggcgcgccgccccccaccccggtggctcccactacccggcccggcgcgggatgggattctctctgggacagctggccccgcattttggtcacacgtcatagcaagccgcggttttcaaacccggaagcgccgaaaaggaccgagcgtgtttcccgggccctgatccccggtggctcgggtgggagggtggaagccgactcagcctgaggggagccacgcgggttcgcggtcaccggtgcgctgcgggccccggaggtttctgcccttggtgtcccctacctggcagctggccctgcttctgtgatcctactgggttggaaccagggatccagtaggctcgaagtggcctcagacggtgcgcagttttaagaaagcaaagggacaggcctgcagtggcgaggcaggagggaagcgggatgggagtcgcggttaggccaagggtagttcaaagcgattcagcaggatgatgaccacaggagtgctggagccgggcctttcagcccccgtgtggatgatgaccggccatccaggacatgcgagggcttgggacagtggacagccagtgccacacaaggaaggaccgattaaatgacacagttaaaggaatttggcctagggagtgcaagccagaaaggtttggtctttttatatatgtaacattggaaaaaaggaacatctcctgttccctgtattaagttttgactttagctcagcaaatgcagtgtttgtggcagtaaatatactctgataacaatattctttcccaggaatttagagttttatgatggttattgaaaatgtttacatgacaggctgtcaataatattttttgcctctaaaaataaaacatacataaagtgtacggattttaagtatgcaactcactgaacttttcatacgtatacaccaccctagtaaccatcccccagttcaagatgtagactgtttccaataacgcctcatgcctgttcctagatagccccaggaacctctatgctgacctctgtcaccagagattagttttgcctgtttgaataagagtgtaccctttgtgtctggcttctttcactctgaaagattcatccttgttgtgaaattcattcatgttgtagcagttgtttggttggttggttagttttttcattgctgcttctgtttaattgtatgagtatccatactatgtatctctactgtggatggacatttgggttgtttccagtttgcaactattacaagttacacttctcagagcattcctttaggcggcttttggtagacatgggcactcatatctctagggtgtataccctggagtggaatggctggttctagtacttgtgtgtagagctgtagttgacaatgttaaatggttttccaaagtggttatactgatttatattcccacaagcagtgtatgagagttcccattgctgcacatcctcggtaaaaacgtttgggtggtaaaacagctaatgcaaaattcagggttttgacagaatctcgcaaagggctacccgtatacatgcttttcattagaaaaatcatcctttcttctcacttcgtcacatcaagacaattagattttcagagtaggaactctaatcattctttcagaatcaagtgcattattgttatttcagatatacacaatagctgatgataatttgagcttcttattttgttgttctgtttaatcagtattgacatcgtcattttatacgtgtgtttgtgtccttgtattaaacacaaaaccctcaaaagaattaaatattgattgtatccctgaaaattgtaggttttaatatatctactgctgggttgtgggaagagtttcagttgagtttctgttcagagctgagatctactgtgaccttttaaggcattgggggaggctgagcagctgttggaactgctagaaagagctgtgtggtcaggggggcaggaactcttaacagttaaaaacttgagctaccagctcctgcaattcttccttctggcctttagcgccacctgcaggctctgagggtacaacaaggtttgacagcgactgcagtgcaacactagttctcaaacttgagggcatcatttacctggggagctgggcctcagttcccagaggtgctggttcagtaggtcctgggctggggccagagaatgtgcattggtaacaagttcccaagagatactgatgctgctggtccggaaaccactgcccccaccccaggaaccactgcagtaaagactttgggaactagattgggatataagaatgacaagcctcatgtttggccctctttgtggtgggccagaatttatatggtcaaggaagtgcatgtaagtgcagagtgtgaggctcatcttcccagatgtagttgtcgtcttttccagaagatgagaaatcagcctgcttagttacccattcgggagttggaaacgatatgcccttggctgagggagcaccatactccagtaaagctgggcccttaataaagaaaacaaagattattaaacatttttcaaaagtatttggcggaggcggcttgtattcggttttagaaaacttgggatctgaagaacttactttgtgtactgaaaagtgagcacatgaacccacaggccaacagaactttaaagggatttatccgtgagacaagggtaaagatgcctaaccttgcaatgatacttttttccaacatttaattcatgctgttcatcgagttgcctgccacagcactgtgttatatcttgaaggatatatttaaatgtttgatttaggtatctttgcctctagttttcagtttgtttggagaagctggctatctcagataaacaaatctggaacttggaagagatactgtgagatatgcagacttgggacgttggttttcataggctggtgaagacagaaccatttcccatttcagcaaggcaagcatttcttttagtttgggatggtcttaaatgtttctgtaaaatggcctgggaatactagcctgtttgcagttttaatttctataagaggccattactttactttttggaaagtagtataagtttccatccctctttttctgccctaaaagtaaatgtttgagtcatatttttaatgtttttcttaagtccatttttcttgttaatgctactaagttgggatgtacccaggtgtgagaggtcacctgattcattgcgtttagaagactgcatttattgctgttgggggctgaacaattaattgggttcatctccaaggaaatgttaattgggaaaccctaacattgtgtattgaaaaaaaaaaaaagaagaaaaatcatttcaggcctgttaaaacaaaactcatttgggttcacttaggctgattaaaatattccttaatcagccccctgattaaacagtcctgaggtgaaactgcacctcaactcgaattttcagttagagacaagttttgcaataaagttatccccctttatttcatgaatatacatgttaaaaagtattttaggaaagattgcacttattatttatttctccacagaaagcagtttcatggaggtagaggatgggttgctttttgggagataagaatccctgtctaccttagacatttcaaatacaataacagctttttatgtgaggcatcgtgataatcacaaatgattataccagagctatctttccaattggaatgcaaaaatagatgtggaaggattgtataaattcatgcattagaactatgttctaattaaaggatttaaaaaataaatttaaaaggaaaaactaattttcttatttaatgatggagaaaatttatattaatgttatttctgattacagtcttgaagattttttttttttttttttggtccaccaactggcataattgtagctttttataagtccaaagaaatgcctcttgttttgggggaggaaaaaaagtaaaggtttaaagtgtatggcaaaggaagaactactatagatttaactgacttttcagtgacactaaaaaacactcttttcccttctttacctaatggctcatggttaatctcagaagaaaaagttaagcaggatttttgttctttgtcaaaacggtatgtatgtatatgtttgtgtttagaaatatacgtgagggccgaaagcttccttattttcagaagagatgaacttcacttggcacatgatagagaacctggccaattcaagtgctgattttagacaacctcggaataattaagctcagctttttggaagatgtgtcatttaccgaatagtctactgcaggcagtcagcagtgtaggagtctcagagttttccagcatagagcgtgtttaacattttccacatgaatctcagtctggctttgtttttgcaaaatgtttttcggtgggacccgactgacctttctcagatggccactggatctgctccccttgctatctatctgagcacgttctgaagtggatggacttcagttgccagttggtgtaatcaggctgtttccagagtctgatcttgtccctttagtaactgttccaaaatacttgggacatttataagtaagaactcatgactcccacatatttatcctccaggtcagaaaaaaattcataaaaggaaagcaagcagtgttcatgattttttatttgagtaacagaatagggactgcatggattctcccacatcctctgagactgtgattttaaaaaacaaacaactcagtcagtgtgctccaaagcctggctataataacacagacttaaaagctagatttatgctatttattagctctgtgtcattgggtggtttacttcctcactataaagcctcacttttgtcatctccacagtggggagaagagtaccagtctcatggggttgttatctgtggtttgagttactcataagctttcttacacctcaagcttttagccctgggcctgggacagagtagatatttcaataaatatttactgaacgaataaaagtctcacattccatttcttcctgcaatgtctttgcttattctgctttttcctccccttctacttctatccaaattctaccctttcctcaaggttccattcaactttattttccacaaagctaagccatttgctccagctcagcttctccgtcttgactttgtgtctgcctggaatcctgcctgctcttcactttatctacctggcaaattcctacttatcctttaaacccagctcaagtatcacctctaccaggaagccttcccatgggtctctcctcttgttactgcccaggttcgtggtacctctttgaccacctacacatttcatcatgattattcatttaagtgccatttttatataaatatgtattgaacacctaatacatgccaggagctagagagagtccaagtgtgttttccctgagtggccatttcgcttctcagtgtgggcacctcagccttctgcttcagagcacaacctccaaacagtagagcatgtcacgtaggatttccaggcctttattcagagctacctttatgacttccttgtctaaggatgactgtttgctaaagcagaatgggccaccccgtggcaaggggatgtaagggatttggggctgcatgttctagtccctgtttcattatctgtccccgaaacagctaagctggaggctggcttactcctccgagggcctaggtctcaacatttggtaaggctctcctgcatgattggctacctttgcctgattgtttttaaagattttttgttattgttgttgccttttaaccttcttttgaccagttaactctacatttacacgtttttctcacagtggtttttttttttgataactttaaataattagaataataatatttacccagtatagaaattctagtaatatggggaaaaaaataaagaataaaataatttgtccatcatcctcacccaaaataaaaattttggagatatttctttccagttttttcatgttgtttacattacaaaatgaattccaatcttcttaaatttttttttcttatttttctatttttgcctttatttcattgtttacccttactacttatttaatgtaacactaaaacactcagggagattggggttacataaaagtttatatggtgctgttctacataaaattggagaaagttcagttgatttaatagaggtaggggctgtttttttcctcttaattttgataaggacagaaactcacacagtgatatgaaacaagttgacaaagagaatttgtattttaggctttgaacattgaagaggtgtaatacttattgcttcagacagtagacagtacatatttggaatgggttatctttgaaagtggataaagattgaaaatacaaataggtgcaaaagaggtaaagatacatttacagagctgtattggacccaatggcaaactaggatgtttcaaaagccattcaaagcaggttacatttttgaggacaaccatagcctcctgcaaacatcccttggtgtgctttcctgaaaccggatactggtttgaatagcctgtgagtctgccttagtatggaaattgccattttttaatgtggggtcagtgcacctgggttgtgtgttacaaaatcaaacatgaacttctttgggagttccttagcaggttcacatcctcccaggaaggagcaggggtggtggagagcataggacatctggccctagggtgttgcagcagcaggagtccagggtttctgcctctctgagtgttaacttcctcttctcaaactaacttcctgcatttagtgaaaaactggtttcacgtgattcccaagctgcagatccccccagtgtctgctgggaggggtctctcctcttagttccagtttgaaacctttcaaaacagccttctgactggtcctgctgtggtcacatgcagtcccaccctccaccacctattgtagccagggaggggcaggctgtaagcacaaggtgggagaggaggaggacaaagtgggcacttgaggctaaagagtgcttttctggaagaaggaaagggtacaggatagacagcagaggaactagctaccacgtcgtttcaccagtgggactctgagctctggccagaaacctcagccactcatgagctgtcttgcctatggccaacattaggggtttctcagttgctggtagtctgtttgactggcttgtatataggtatagcagaggtttatttgtatggagaattgggttctagttgtaacttgtacttgccttcatttagtcaaagtttgtataatttttaggaagcccagcttctaggcctgcaacttctagctgttataactttgcaaaacactttcatataattgtatttgaccctcttgatgaccttgggaagcagttaaggcaggctttattatcaccattttgcatatcaggaaaccaagactcagagaagtcaagtaatctgtcaacatacaatagaaatccagtggcagagactgtcagctctctcaagtccttttccaggactcctgcatgtgccagaggccactctgctgactgaataatgatgcctcaccactgtgggagaggccagaggaccaggaaaggctggtctcaaactgctctcagtttgatgactagggaccagacatacctccttccctggaaccaaacctggttgctctcagtcaccccaatcaggtctgtcttttctagcactccacaatttttcctgcttcccacatagttcatgctccatccatgctccatctcagtatgtttgctggtctttgtggctctgagttggctgtgaacctgaatatttttactagcttcttcaccagtgcacaggctgttcctagaaacatggttgttgatagggacagccctgaaagaatggagattttgtcttctatggtcctgctgaaggctagtttctaatttttatatttatttatttatttatttagagacagagtctcactctgtcgcccaggctggagtgcagtggcacgatctcggctcactgcaagctccgcctcccaggttcacgccattctcctgcctcagcctcccgagtagctgggactacaggcacccgccaccatgcccagctaattttttgtatttttagtagacacggggtttcactgtgttaaccaggatggtctcgatctcctgacgtcgtgatccgcccgcctcggcctcccaaagtgttgggattacaggcgtgagccactgcgcccggcctctaatttttatttttttctccaaagcttcaaaagaaagttacacttagaggaatctattacttcagtaatcacataattttcctggtgcatgtctctcttgctttcttggtttgcctcttgtagtctttgaagaaacaaagagcttcaaagccaggaaaatgacccagatctctttgacagcagtgctaatgttttgggaagtgaaggcatatagttattactgaaattagtgttcctggaagctgcaagttacttgaaaattatgctgatttgtcttgcatgcattgtatttgtgtcctaccaaagtgtttccaaggaagtatctggcaaacaggcaggagggtgccggggcagtgggacggggagggtctgaatatattctgatggctgaagtctaaagaaaatgaactggaacctatttaggacatcgtattgcataagcatgagagtgataatctcatctctctttttcttttttctattggatcttcttaagaaacctgaatagccttgatatgatatctaaaaataaagtaaatggtgctttgatgtctgtactttctcctccatgtaacagtgggtgtatgtttctcagagtttatctcctgtgtgccaaaaatcagagaggctcaggaacaagtgtccattgcttccaagtcataagaacaattggcaaaaatcacttgtcttgtgtctttgaactttaaatgcagtgaaaaaacttgtcttaaccaagagagggataagaaagagctgccaagtttgaaaaacctgctgataaataacttcataccaactgtacaacaacctgtactatatagtctgtagatgaaaaatcatgtaccattttggcttgtacaatactttgtggctaactttaaaaaatacggaatggttaagtctgtgcattaatacgtgctgtgtaacctaacttctcagcattataatgtcacagatatctgggggtggtggggagaagtatatgcagctatgtatagaatatacacagctctccctcctttctcttccttctgccccctggctgtgtggtctactggctggattgcaatagctggattgcagctggttagatgactctgctggtttttgaggatgaggaggacaggacaagagagggaaaattttaaatgtttatatcataggagaatagtcatgtcagaatcattgtgtttccaagctgcagtttgtgctttttaagttaagaggtatgggacttcagattaagagtttctttacagtattatagtttaaaacattggctctggataatagttgactgagtttaaatcctggctctatagttgacttgcactctgaccttcaggcaggtttttcatccaaaaaagtggaaattaacatagcacttattatgtgaccaatatagaggacttaaacagtgcctggtagaccgtaaatggccaatacatattagctgttatttttgattttacattcattagacacaattgtctctttgtcactggtatgttttctttaaagtacagatgtcaggaaagtagcaatcagagattccttgtttgttgagggtgttttgttttgttttgttttgttttgttttgttttgttttgttttgacagagtcttgctctgtcgcccaggctggagtgcagtggcgtgatctcggctcactctaactgcctcctgggttcaagtgattcttatcaagcgattctcatgcctcagcctcccaagtagctgggattacaggcatgtgccaccacacccggctaatttttgtatttttagtagagacagggtttcaccatgttggccgggctggtctctaactcctggcctcaagtgatctgcctgcctcagcctgatttcacaatactgggattacaagtgtgagccaccgtgcctagcctgtggaagcccagcagatggaagatttgctgccagagttaatggtgaccggtgggatatacaattgaatctttacagagaatatagagaccatgagataactactctggaatcagttagttttaaggaaccacaggggcagagcttgagataattgggaagtttaacatattattaaacctaaaatggccagcaagactgatagctgcttctcagttgtctgagttttttctttttttgtgaaaatacttttttagccagcatgacttatgtcatctcttagatgagagaaaagagtaaaaaagacaaagtgtatagctactcttttaaaaatagtgttggaagcatagttttggaagaaggtgtctcacatgagtcaattttctagacaagtgaaatttggctcttttagtatcaaaacttgcttttataattttttattgagttttttctaaacttgaacaattcatttatgttatgtttattgagtatatctcatgtgccagaaacactactgggtactttacattgccttgatttttacatataaaatgcattgtgttctggcttttaaacaagatacactggttttaatttaatattttcttggaagactaattgttaagccgttatgtaactctgtgcttagatttcgtgactttcatattttgatcttattattccctacgtgttctcgactttttccacgtagttgagggaagggttactgattgttaattgattatttattatgtgttctaggcactttcacatacatttcatttcaatctaacagaaacatgtaaaattattattatacccattttatagatgacacaatgaaccacagagaggttgagtatcttgcacagagtcacactgctgagtgaggagaggagctgagattggagtatggacccttctgattctgggtccaatgttctttctatgctgacatcattgaagaaatagacataagttaaaagtaggtttatagatcatgacccttcctcacactccctctttcttttctaattctttcccattgctgtaaaagcagggttttcttctctaattaatttagctattcttcacctgtgctagatgcaagtaaaagacagcagaagttagaaaaagggtggagcctccaaacctgttgggtgagaggctggtccatgaaatgacccaggattttctcagagtaaatggaaaatctttaactttgatagagttaatttatagttacaagtaattttgtgtgcctaataccaggtatagactaaggaatttatcagaaatattatagtaaatgagccctttttctcataccaagtcttcaaagttcagtgagggtaaatccaccctcccataaaagcaatgaaaacactagcaaagatagcaaaaagcaactttttcagaacccctgagattagccaaaggcttccaatagtttgagaagtgtttattcaagaaaatcttctgaatcttattaggaacagcagggtttgtgggattgtaactgaactactcccatttcctctcctcagctctgcaatagccttgaaaaccagcagtcttgcaaaacttgtaaaaacggtacttgtaaaaaccaacagccttcaaccattggctaggataggcctggatggaagatcctcaagaagtcccattcccagagcattgtccctatttgacttttctcacagctccttggaaaagtctcatttgcagggcatagttgttatttgacctaccttggagctcagagcttgctctgttcccacagagccctatcttcagggtatttgtcaaaaacaatcagtgacaattgtttaacgtcgtagcttctgaggggtcaataccagttgcgcaaataaaaacctggccaaaaacttacgggtaagatgtgaggaataagatgtccataagaggcttttaaaaaactcttttgacatattcctagaggattagaaggctacacacatatgcagggctatgtgcatgctcagaaggacctgagagggcctcagtgtctcacctctgactgagtatgaggtccggagaaggcaataaatacaagctaaggcagaagattaaagtgcccaactgttgaaggtatgccttaacacacacacacaggacccttcagcaaagattggatcacttattggttcacagcatcagctaaccactaagctaactaaacagagacatcagtggctgcacaccacaagaaatacagactttacagaattagtccagaaaagtcactaaacaaacaaacagcaacaactgcaataactacaaaaaacagcaataacaaatcctggggagttgggagaggagagtctgatttccagaattgccacatttgttattatctgaagtgctcagttttgttttgttttttaacaaaaagcatgagacatacatacacaaacaagacagtatgacccatacacaatagggaaagtagtcaatagaaactgtctctgaaggggctgagatgttggatttattctacaaagattttattcagctactatcaacatagtcaaagaactaaagaacatcatgtctaaagaatgaaaggaaagtatgacaatgaagtttcaccagatagagaatatcaatagagaaattgtaaaaggatctaaagtctggatttgaaaagtataataacaaatgaaaaattcacttgtgagctcagcagcagatttgagctggcagaggaaagaattagaaaactcaaagacaggccaattgagattatccagggtgaggaacataaagaaaaagaataaagaaaactgaacctgaacctagtcccagagacctgtaggacaccatcaagcctactattatatgcattatgggaatcccagatgagaagagaagggtggaagaggaatatttgaagaaataatagccaaatacttcccaaatttgatttaaaaaaatacttgtctgcacaactaatgagtgcaggaaactctaaataggataaactcaaggagatccatacctgtgtgtgtgtcgtagtcaaactgtgaaaagacaaagagaatcttgaaagcagtaaaagaaaaatgactcatcaaataaaagggatcctcaataaaattaacagctgacttctcattagaagctatggtggctggaagtgagtgggatgacatatttaaggtgctgaaataaagagagtctcaacaaagaattctatatctgttaaaattacctttcaaaaattaggaaggaaccaagacattctcagataaaggaaaaaagaatgtgtcactagcagacctgtcccacaaaaattatgaagggagtccttcagattgaaaggataaggcactagatgataacttgaatccacaaggagaataaagagcactagtaaagataaacacagaaataaacataaaagcacaaatatatttttgtaactcatttgggtgatagataactacatagagcaataattatgaactgtgttaacaggcttataatatgtaaagatgtaatttgtatgacagtagcacaaaggagaggagaggaaaaggaatatgtgcagaaaacttactactcttgaaactcagttaatattaatctgaactacattgtgagttaagatactaattgtaattcccaggataaccactaagaaaataactcctttaaataaaagaaacaacaaggtatcaaaaatggtaccctagaaaacatctatttaactcaaaataagacagtaataggggaatccaaaggaatatgacatacagaaaacagagctaaatggcagatgtaaatcctaccttatcctaccttatccataattatattaaatataaatgcactaagcacttctattaaaaggcagagattggcagaatggagggaggaaaactcctgacccaattatatcctatctactagacacacttacacacactttaaatttaacaacaaaaatagtttgaaaataaatgaatgggaaaagatatacaatacaaacagtaactgaaggagagctggagtggcaatactaatatcacatgaaatcaactttatgataaaaattattactagacacataacagtctattgggaagatatcataattataacatacatgcacccaatgacagagccccaaattacatgaaccaaaaactgacagaactgaagggagatatagacaattgaacaataacagtgttttttttagagaaagagtctcagtctgtcacccaggctggagtacagtggtgcagtcacagctcactgcagctttaacttcctgggctcaagtgatcctcccaccttagcctcccgagtagctgggactacgggcacatgccaccacatgtgtattttttgtagagacagggtttcaccccgttgcccaggcttgtcttgaactcctgggctcaagcaatctgtccaccttggcctcccaaagtgctggagtacaggcatgcaccaccatgcccagccaagattttcttttaattactgatttcaaagtattattgtgatgtatagttttattcctgtttcttatgctttgagttcattgagcttcttggatttgtagttttcatcaaatttggaacatttcagacttactttcttcaagttttttttttgttccctcttctccttttggaaactccagttatacatatattaaaatgcataaagttgtcccgtagtttactaatactcttttttcttcaatttttttctctgtgttcccattttagatagtttctattactgtgtcttcaagttcattaatcttttcttcagctattaattttatccagtgtatttttcatctttagaaattcaatttaggtattttttttttgcaatcttctatgtctctaattaactcgtctatgaggattgttgtttttaaagcctttgtctatcaattctattatcttgtatattaatacccctctttcagtaattgattttgtttactcattatgggccatatttttctgcttctttgaatgcctcatagtatttgattagatggcagacattgcgaattttgtctttttgggtgatgagtattttgtatttctataaaatacccttgaacttcattcttggacacagttactttgaaagaattggatacttttaggtcttgcttttataattagtttggtaggaccagtccagcaaatagttagggctgactcttccctactactaaggacccttttgagtactatgcctaaagctccatgaattgtgaggttttacagtctgtctgggagtaggcacaattcaagaccctgaggaagtatgaggtactgctccctcgaatctgtttagatgggttttctcctggcttttgggtagtttcatcacatgcatgcactgatcctacttaagtaggaccctctgcagatctctggggtcttgtttctttttagccctctcctttcctgtgtgctgacctgtgaaccctaaccaccttggtgtctctggaattcttagcatcatctcttcaattcagtgagtcagctaggctttactgggttctccctttctgcactgtggcctggaagctcttttaaagcagtaagctgggcaatcatagggctcatctcatttgtttaccatctctcagggactacggtcctgcatggcttgtgtgcagtgccttgagaatagttgtttcatatattttgtctggtgttttgtgggtttttgttgttgttgttgtttcagagggttaattgaattcctgttattccatcttggtggaaagtagaaatctcaattttttttttctgtagatacttaatgtcactattagtttaagaaaaaatggtcgtattttaaccattcatgggtaagccaacttgtaaaatatgtctgctctatttaagcttatgaagatctgaagtagagtaaagggagtgggggccatagaaaaataaaagagagtaaaatctcccttctttcattctttctcttttgctcttttggtaaattgttgctatgcccccttactaatcagagccccattgttctttttggtaataggaacattttaagagttctgtgaatatgccactcaaaatatatgaagagtgttaccaataaaattgtcatggtctttatgttttaatctatgtgataaaaacttgatggttttggtacaactggttaacttctcgaaaaaaatatttaaattggatttcctcttaatatcttatacccagatatagtccagataggttaaaaatataatttctaaatattaaatgaaaatataggcaattcacagaatcttaagaaaaggtctttctaagtgtgatacaaaggatacaaccataatgaaaaagatcaatatgattacatgaagattttatgtcttttatatggcaaaaatcattataagcaggattaaaaacatagtcgatatccttagtatataaagatacctcacaaagtagtaaaaaaaaagccaaatatcccactgggaaattaggcaaaggatagttgtgtaaaaaatataggtttcaggtaaatatgtttacaatgctgtacttcataatagtaacaattacaaattataatactcataataatagctatcatttatttcatgtttctatttgcttgattacgttaatgttttcagtagattggctaatttgatactttgaaaaacaagtatactattattgtcagtttataaatggcatttgagacaggagattaagacccttgcccagggtgacaaagctatccaagtggctaagccaagattatcacccaggccttctgattctagacccctgcttctcatcattcctcatagcaatacatttaaactacctgaaattcaactgcaacttgcagagaaattggtaatttgctcaagatcacaacatttgtaagtgataaattgagttaaaaatcttacaaaagtcatataagtagaagaaaggaaaacagggtaaagtaaggtgagcaacaaaacagctgtgtgttttaattttagatattcacggtttattttcagaatatttaaaagatgcttcaaagaagatgaaaaatgggctaatgtttgtaaaactggttaacccctgttcaggtaagttctcttctcataacttgaatgttcttaaatgttgtggctaatgagtatatacacttttatgtctttgtgtccttgctctttctgaatagcttttaaagttaagatggcaccgtgaggagaagaaaacaaggtgatgacattactagtcttcccagataattcatttgacttaaacattttaaaaatttcttctcataattttaattcacagaactgttcagccatcagaaatacgggcaaaacaaaaaagtagcatgtttgagttctctttaaaaacagattaattttctttggcttccttaagccaacttttcttagttattcaacattagcctccatttatatccattttatcttataaagtaaaataaacaaccagaatttaaaaaaacaaaaacagaaggcttttacttgacatgccaagattttgattaggttcagttttagctatacttccctattttcttctgaccaaaaagtagtactttttttctccgtcaggggacttttttttttttaaatgataagcattgtttattgaagggattcatatcttattggaaaaattttattttaactttatattcagtgcattttcagttttgtcttcacattttttaggcaaaaatattaaagtgtattctaaatattgagtaatatgggtgatagtgtttatctctgtgtgtaattgtttttccattaatttataaggttttgtgtagacacctgatacttgccatattagaggtttctcctggtgacagtaatacggaatagtaaaagtatgggagggccactgagtagtgccttgttgttatagagacatgtaaatagaagcaacaagagaagaaacacattcctgactttctccagtgttcttttcttcaaaatgaaattgactgtaattggtcagctatatttagaaatcttagttatatatcagactaagttgacgtgagaaatatttcttcaagagaagttttaggtagcagtaaaggttctaaagcatttaagaaaagtacaggtacagaagaaagccagccctcttttaaaatttctgttttatctaaatgctcatagacaacagaggaacaaatgtttttatttgctacattggcagtgggaaagtaaaggctaacatttgctgagttcttactatgtgccaagtattggtttaggaaatttacatgtgttcttttttttaattcttataaaaacccttgaggaggttcagtattgtctccattttacagatgtggaaacagccacaggaaggtttatgtaacttctccaagggcacgtgcccagcatatggtggagatagagttaaagtcagcatccttgtctccagagattgtgctgtggttaaaaaaaaaatttttttttcattagttgaagtgataaaacatgcagatgtgcacagtcttcaccctcttgtgcctcctcccttttttttttttttttttttttttggttaagaaaggaaaggaaaaaaaattcattcagttgaataaagctttactcactccctatggcttcaagcatgtctgtctttctcacttagggttggcctgtggcttggtccctgtcagaccctgtgtggggagagccacacactgcccagaggcagggacccacgtgccagctcatgtcatatggctgaactgttgtgttttgatagtttaggaatggatattccctcttgatctgatggaggatttaaggacaggctttgtattagttaagataaatgacttgcactttctaattttttggtttaagtccagtgaggattatggagctggaaaactaccatctatgtataatagctgtaagctttccttggaatcagttttttagaatagacctgtgtatgtttatgttcatattaggaacattcgtcagagatactggatagtcttttggggtgtgtgtgtgtttgtgtgtgtgtgtgaaaacttacaaataaaagacagatttgtcttaacaggagaaggagccatttacttgttcaatatgtgtctacagcagctgtttgaagtaaaagttttcaaggaaaaacaccattcttggtttataaatcaatcagttcaatcaggtaggtgactagtgtaagcatttccaataactaaacacatactccagcttttccattcttcacacgtggggttgtgggtctgtcaccgggtttggagtctggtcactggtttagccttccttggcatgagagcaggtttaatcaaggagaaaggaaagatcatttgagcactaaggttaagtcatctcctgtgtgtcttagacggtaggaagttttaaactagcaactctgatttgtctcctaaaacagtgacacatcctgagttagaagttagatttgtacatggggcacatattgtgttgattagaaactcttttgaggatctttgtgtttttaacatgttatttccttgaaactggatactgatatggcttctaacataggctagagcataacaaagtttctttaaaatgctttgtcatatacctgcctgcccacctgctcccccacccccatacacacatacaccccccagcaccaaagttctgtttcttgtggtgttcccttaatttgggggcagtgctgactaaaggaagagtaggccaacggaactgttctgcctcatgttctggggtgggggcagtcagtggctattcaaagaatcctacatccccctgcccacagaccacggaagggactgtgtatagagagaatggcactgctttcccatggctttgtcctcaaaagcacaggaaattacattttactgcagctttatagatagactgacgatacaggttccctaacattgccgtcttctcattctgtctgtgcttcctcctaacccctcgtttttcagggggttgggaggctgtgttaaaaatgatttctaaagaagaaatggaaagttaaagatcaatttcagggtcttggttctcctctccacacagggatttgaagctctttggagtaaaatctcatagagcacattctgccttttgagagaatcacatagactctgaggcctgtataagaagagatttgaatttggaatttcacatatatttttcaacactgtttttcactttgagattaaggtgaaatagccacattgtctttccaagacgtttaattcccttcatcctttttgtaatctgcaggaggtcttctccattttgccacacctgtggatcctctatttctgcttctccactacctcataaaggctgataaggaggtgagtttccagctcggagcatccacagtgaggaaacagaatcaactatttttgtttgatctcctctctctccttttaatgatccaaaggtggattctaccttcagatctattatagtgactagagaaaacatgaatcatatgggccagtgcaggacagagcactactgcacaggccagagaagcagcaccttactcttgatccagtctgaccctggcttgcttgtgacctctgacttgcctgactcactgtgctgtgcaccttactgcttgacaaagcctgacagctaacactcctttatcattaagtattccttacacttgaaatacaaaacaggtatttaaaaattgaccacatgtcttaaagagtctcttctttagtgagagactgtggaataggtaaactggagcgggtccaatagaagctcattaatggtgatgtgctagttgagacttaaggaatcccagatggataaaatttacctttggaatagaaataaagacacagcttactaatagtaataattttagccagaagttctgtaatattttggtctcaggatacatttacaattaaaattattaagggttccaaagagcttatgtttctgtgggttctagcaatactcttagaaattaaaactgagagatttaaaaattatttatttaaaagttaaaaataataaggccattacatgttaacataaataacacatttttattgaaacaaacaaccaaatttaatgaggcgtgtggcattgttttacatttttgcaaatctctttagtgtttggcttaactagaagacaactggattcttatatctgattctgcattcagtctgtttccatatgttattttggtaggattatatgaaaaatatgcggccccatacatctttgtagttagaaaaggaagaaataatgttacagcctttttagattattgtggatattcttctttaatactgcctaaaaaatcaacaagtagttttttaaagtttagttgcaatgtgaaatgtgaaactttgtcagttaactttctatgctctgttacattaaaatgcattggtctatcttgcacttaaaatggatctttttaccagtgtatgattttgtaacatcatgctttggtcatttggaaaatattgatttgctgagttatgcatatcttccaaatgttgacacatctcattttacacacacacacacacacacacacacactcccttttgttaatattaccactgatctcatcagaaagctctttaggtattgagaagctgtcatagtggcagatagaaattttctacaattctaatttttgcttgaaagctcaaattttattattggccgcaaatattgtcaatctttcccgtgaaatgacaggctcacttcgttcatattctgcctaataccggggtctgaatcaccgtaattcatagtgggtttttcaaataaaaatgatatccatgaaaaagcagctggttctgcttgcaactcagccagccccaggagaacatgctcttcctggtaatcagcttatctttggttaagcagccaaaggcctttagccatacctcactttcatcacagataatttacaagacttgtgttcaagggccaagatttaagtaaaattaattgcttttactacttgctcaaggatattcttaagtgaaactggcattttttaaactgcacataaatggcggtgaggatccaaatgatgactaggacagtctggtgccaccaccagactcgtgctaaagagccagcagttttacccaccattgcatttgaatcatctgtgcagatgtccacacagtgaaaatgcagatagcgtcttagcagtattaggaaaatagctttgagcttaggtacttcatgacccagggatccatcaaccatagttggaaaatcttttaattaataactttgagtgataagtgtcactcaaacagcttagaagaatctggtttttttggactctcatgtttgcataaagtttgaacacttataaatttcttacttaatccttagatcaaattcctgaaacctccatttggtaggtaaattaatttaagttgctgtaaatactgaaagtcataaagtatcaatgcatgttttctcttgatgcagcttagcctcttttagcctcctccttccctgccctccgcccttcactgtgaattagtgaagttttatcccttcgtttaatcatgtgtcccattatctggaagctactgtgatggccggtataacgagggcacacaagctgtgaggctggtaagcctcgtgtctttaaggaacagaaatggtcctaatcaccaccaggaacgccctggggaatattcagggaggaatttgtaaacctcagtggctcacctatgtggtgttttctaggataaattaatgagcagaaagacaccaaccagcctcagcaaatgtattgatctgcacttaaggctccccctcccctttttgatagcatttctccatctcccattaggaccatgactctgggggattaaccctgtcttggcactctgggcacctccagggtgctatggcgagctcacgttgacaagtgcagaatgaagcagaaatgctgttcagggtggcctttggctttcattttaaaccgtcgtacttcccaaacacgtcttcccaagtgccaaaaatgccctttaaagtaacatttgagatgtttaggtatttccttctctacattttagacatgatcatttcctatttagttaaaaattattgatacacacttttgaaatgtgacctgttcttttaaactttattttaacatcagtaaaaataactttttttctaggtatcccactgctactagctttatagtcaaggcaggttgcttattgcatttccttcaatgtatatatggtaaataaaaataagaatgaaacactagttaattacaaaattattttatatcatgattgtatggtagtccattacatataaatattgttttagagtagtcaaatatttaagatattgattgatcatggaagactatagatttaaggtagaaatctaaagacagtaagacttgggaaaaatctgtgcattattcttactatttgaaggaaaaagaacatttaaattgagatagttcatggcactagttaacctaagagaaagtatggcaagctatcacgtgttcttaaatgattgagaagattttacccttaaaacccaagaaagctgcatttgcagaaattgatcagatgcagtttttgtgtcttcaggaggagttgtcagtacacgagaggtagagcgagctagaagtgggtcatgggcaaggccatacatctggtacagtctggtgtccccaaatcagggggctaataccttaatttagacaaacttcacctctacttgctactagtacagttacgaaaaactagacctaattccaaagaatgatgttgtgaatccatatggtctgcacttctggcccactggcaaccaggccatataaacttctgtggctgagcctgatttagcctgtctgcagcttcccatgacttctccctctggctgtcttttcttttattctggtctaaatttggaagcattgtgaggcagctttgacaggggtagattcacttttgtattttctttttgtggcgggtgcttctttcatcatccctagagtgatgatggggaggcagatgtatgtctgggcctggtctgggcttgttccaatgtgacagtcaggactcttgctctgtgaccacagctggttcttcaaattgaatgggttggaccatccccaggcagtctccaccatctttgcaagcttctgtggcttccagtgcttttgtagattgattttcttccccatttcatttggggactgtacacccaaggtagatggtgtgctgtgtgggactccagtgctcacaggagcttcctgaagggagctggggtccgtcctagagcctgtcccattgtagggattccttagatggaataggtggcttctgcactaagtttaaaggcccagccatgagttaatgtgtctttttctctttttttctgaatgtctttgttgaatgaaatgcttgctttccaactaactgttttttcaggggaagtttcagccccttgatcaagttgtggtggataacgtgtttccaaattgcatcttgttgctgaaacttcctggacttgagaagttacttcatcatgtgacagaggaaaaaggtatggtataacttaaaggcttatggctggtagaaaggatggaccttgcctaagaacgtggctgcttacagacacactgaatgtaaggcttattctgtgtccaccatagggaaaactatcattcagatttgctaacactgccagcactgttcctctattgctttggagtgtttagtctttggaactacaaccatggcagtctagggcctacgtccacagggcaggaatcacaaggtgtggcttcagtctcacttcttctttgaactagttctgtgacatcaggcaagtcactcagctgccttctgcctcagatgtctcattgtaaaattacgtaaaacctgtaccttaatagatggaagcatttatcgagcaccttccaaaaagcatatgttgcacattagtgctaagctctagatacttatgaataagacattgtccttttcttcactttgcgcccagtctgatgggggtcaatgacaagctgagcagtgaccgcacagtgtaacggaagtgaactctgaatttactggggatgcacaggacaggtttctaatctggcggggttgggtggggaatgtaggtgggtagatgttgtgttgctttcctgggggaaatgacctctttatggagtcctgaaggatagtcagagaagcagtgtaacagaggctcagatgtatggaaaagtttgtcaggttcaggaagttccaaggagttcaaagtataggattctggggaaggatgtaggttggtaaggaatgaggcgggaatgctgggcatgggtccagatggtaaagggccctgtgtgtgtttggactttgcttaatggtagtggagtgtctgtgaagttttaagcatggcagtctgcagtgtggagagtatattggagaagccaggtccaccaaggctgttgcagtgatccagacaggagataatggtggccttgatcttaggagatagaacaagaagaaagtagccatttagagatggacccaactgcatctggttgttgggtggtggtcaaggagaaggaggagtcaagagtgacttctcggtttgtgcctgacccaaaggatgtgtagtggtgggatcctggacacagggaacatgggctggaggagcaggatagggtaatgaagagatgcgttttcactatcattcatttaatttttcagagggaaaagtaaggcagtgtgtgtgaatgtgttttgacaggttagaaatagtataaaaacttggctttggtgtcttaaaaaatcatccaagtagtttcagggttaatatggaaacaaagtgtgggaaccagagcatcaggctgataagttgtggctgtttgggtcatagatggtttggccaactatgacagttcttctgggaccaagaaagtggtgattccaagaagtgtaagcttacagtgggaaagagaagaaccttattgattgcattttatgtttaaggggtccagtaaattcatacttggccacacttggagctccagtttggaactgaggggtatatggtgccagggttttatcaaagcagttccattaaagacattccctgatgctgagtttggcagaagacagcagtctttttgtgggtgacctgaattagcccataaccacttttaaaagataaagtaatgaagaataatttaattaagccatgttaatttttgtcaacttaatgcaagctgaaaatgcagttaactcattgtccagaattctgctattagctgtataagaacaatcatcttaaaacccagaaatccagatttagaaacaatgttagtgcctcagcatttgtttccttacagtctgcagccgagagcaagaggctctctctgtgtcatcccttccctcttgtacaccgaactcctgaccatttattgcatcattatctgaacttgtcttagtctcctttgcttctcaatattgcctaacttttggaagttctgtacttccattttcaaagtagctatattattagcctttatatttgccagatttcaaaaaccctaggcctcaatttttttctttatttttaagtgatgggcaaaacataaaatactttagaataaatttcacacagtaaaagatgtattcaatctctagaggtttggcagtttctttttatcaaattcttcccttaataagctgcagcctgtgaatctcaaaataatggaagttttaaaaacagaaagaaaaagatttttatttttatttttttatttttatttttttaagacaaggtcttgctctgttgcccaggatggaatgcagtggcacaatcacggctcactgcagcctcaatctctggggctcaagcaatcttcctacctcagcctcctgagtagctaagaccacaggcacaagccaccacacctggctaattttttcattttttttggagagatgagggggtctctctatgttacccaagctggtcttgaactcctgggctcaagggaacctcccgcctcagcctcctaaagtgccgagattataggtgtgagtcaccatgcccattctcaaaaagatttttaaatggggggaaaaatacgtaagattctcaaatgcctcatccttaagaagatattggaaaatcaaatatctaaaaattaaatatataaaacctaagcgggctttattgcaagaattcataattggttgagcatttaccataatttaccatatttatgcattacaaaattgtatgattatctcaaaagacacagaaaaggtatttgataaaattcagtcatgatatatattatcagcaaatgaagaataaaagggaacttccaagggcatctatggcaaacttaaacagctaacatcatcttcattgtaaaagactgaacacaatcttcccccaagactggatacaagagaaggatgcctgctcttaccacttctattcaccatgtggtggatgtcctagcatgtgcaataagacaagaaaaagacatacagattggaaagtcagtagtacaactgtctttattcatagacaatattgtcatgtatgaaaaaatccaaaagaatctacaaaagaagttactagaattgataagcaaagtttcaggatacaagttcaatatacaaatattagttgtgtttctatatactgacattgaacaattggataatggaataaaaacataccatttatactaccattaaaaataacattctagtgctaaatgtaacacaatatgttcaagaccaatatgctgaacattacaaaatattgctgagagaaattaaagaaaaattaaataaatggagaaataggccatgtttgtggattggaagactcaatatttttaaggtatctattttccccaaattacactataattacactatataattacattatagattcagtgtaatacttagccagctccatttttttttctttttttttggtaggtattgataaactgattctagaatttatatgactatgtaaagcagcagaagcagcagtctccaacctaattttggcagcaggaactggttttgaggaagacaatttttccatggatggggcagggagggggatggctttggggtgaaactgttccacctcagatcatcaggcattcgattctcataaggagcacacaacctagatccctcgcatgtgcagttgacaatagggttcgcactcctatgagaatctaatgccatcactgttctgacaggaggcagagctcagccagtaatgctcacttgcctgacactcattcctgctgtgtggcccagttcctcacaggccatggattggtaccagtacatggcttagggactggggagccctgatgtaaaggacctataatattcaaaacaattttgaaaaagaagaatttggagaacttacacaaactgaattaaagacttactataatcaagaaaatgtggagatcaggcacaatgactcatgcctgtaatcctagcggtttgggaggccgaagcaggaggattgcttgaggctgagagttcgagaacagcctgagcaaagtagcaaaaccccatttctacagaaagtttaaaaattaggcagctgtgggccaggcacggtggctcacgcctgtaatcccagcactttgggaggccagcgcaggtggatcatgacgtcaggagatcgaaaccatcctggctaacacggtgaaaccctgtctctactaaaaaatacaaagaacattagccaggtgtggtggtgggcacctgtagtcccagctactcgggaggctgaagcaggagaatggcatgaacccaggaggcagagcttgcagtgagccaagatcgcgccactgccctccagcctgggtgacagagcgagactctgtttcaaaagaaaaaaaaattagccagctgtggtggtatgtgcctatagttccaactatttgggaggctgaggaggaaagatcacttgagcccaggaggtcggggttacagtgaactgtgatcacacaattgcactccaatttgggtaacagagtgagaccctgtccctaaatttaaaaaataaataaaaataaaataaatttggtgttggtataaggataaatatatagataaatggaatagaatagagaatctagaaataaacccacacttatatggtcaattgattttttttttccaaaagtgtgaagataattcagtgggaaaaaggatagtctttacaacaaatgttgatggaagaatttggtatacatatgaaaaataacgttgattcttacctcatacagaaaaattaattcaaaatggatcactatgttaaattcaaaaatgaaaattattgagcttctagaagaaagcataggataaaatccttgttgtcttgggaggcaaagatttcttaggacacaaaacccactaactgtaaaaaaattataaattgtattttatcaaaagtattctcttttgtttttgaaaaatgccattaagaaaaaaggagattgtgagttgtgggacagttggaacttacctacctggctgtccacggcttaaaatgatatagccacttgacaatttcttacaactcaggaattctactactccctggtacaaagtaaggaactactgctagctgcaacaaaatggatgaatctcacagaaataatgttgagcaaaagaaattggacacaaaaagtatatactatatcatttcatttctatggtgttccagaataaagcaagaattgccctataatgatggatgagtggtgacctgtgatctgggtagccatgggagaattgactacataagggttccagggaactttgggggatgatgcttacatgactgcatacatttttccaaactcctcgatttgtacatttaaaatgggtgtgtccattgtgtgaacatgaacattgcgtgaacacctaaataaaattcatttttaaaacaatatttactgatccagcactagaagctaagcctcctgatttctaacacagtatttatttttacttgcccctttcccccaaaataatattggctccttttctctctatacttcctacctcccatgggatggagagatggaatgtgggaggcaaggccagtgtgagcactggctctgaggtttaggcctcgatattcaggagagtggtgtaggaggaagatgaaccactgggttttagacacatggaggcttagttcagggctttgggcctcccggttagtttgtttagtcttgttgatctaggaggagatcacaccagatgaaaggatacagttgactttggaggagggtgaagcagagctgggaaaagaatcagataagtcattagagacataaaaaaatagaaagcaattttatatatgccatggaggagaggttgttaggaggtactgaggaaagtgcagacctagtgatcttggtaaagtgaacatcagatccacagctttgatgtcagcatggttgggagttgggtgctcttgcctacttcctcagtgacttaggagagtttacttcatgtcactcagagccagtcttcgaagatggggacaaatcatggtttattaattgattctgagattcattctgatcattcaataagaaaatgtataaaatgtgcctagcacagacctgaataaacattagtttcttatgttttattaacaaatcatatttttcatcacaatatcttagctaatattatgtatttgctaagtggcaggtgttgtgctctaggatttgtatggattatcacatttcatgctcagaatagcccagtgagaaaaaaacctctctttacacatgggggaacaggctttgagcacgaggcggcttcccaaggagacagcatgtgctggggtatgcatgagccctggtagcatggctcagtctgtgctctctgccccttcttagagaataattcccagaggtagaggagaagcctcctagtggggctcagggagtgggagacaggaaggaaaacagcagcagatggtagacattctttgagaaaatttggaggtagaggcaagaaagaagtgagatgccagatcagggtaggattttcaggagaaccttgagcagtgagcttcttttggagtttttttttcctcaggcaatgaacataacttctaaaagccattcagcgtcatatatttatttagtgattgctgtatgctcttaaaattcccctggtttgtacatcggttgggacatgggctccagggaaattgagtccggtctcattggctttggcttacagtaggctgtttgcccaggtagtcctggctccaaaacagcagacattgcaccttggaattctgacactcctgacaatgcttttgcacctgtccctcttttttgttactgtagtgacatgtcctgagaagatggctgcagatgtccagcccccaatccatcctgcctcatcttgcctgcagcattgacaaccataggctgaaacagagaggaaattcacaggaactaaggccagggacctcccaacctctctcccatacagtttaacagactgcagaaaatgaaccctgaatgggcagttttcatttcccatcaaaaggtgggagggagaaagagcctcattctatataactcagaggtggtaaattcacatcaggcccaagggttgctagtggtcataaagataaatcctgcatggacagaggaggctggaatagaagtgctgcccttgctaattgcacagacagaagaaatcccatgaatgaaaagggttgcagaggaaatcatggtttaatgtcatggtatataaggctgggtggattgtggggaagttaagtgtaatttataagaggtgaaacttttatctccataaagggccagattgagcctaccataaatctaaatcttctcaaatagctatgattatgttggtaatatgttaaaagatagatagatctttttttaatgctcccccaatccccaataccaggccactactgagtagttaacaagatttttttcctgaatgtatgtagtgaacttcatagatacctgcatttcgtttcaattttctttattgggattttcatttttattttaagaaaaaaagtggttcattgaaaacattgaggtgagcttaaaattattcagaacagttaagactgcttagtatgctaatgtgaacacaaaatatctgagacaggtctcagtcaatttaggaaagtttattttaccaaagttaaagatgcacccatgacacagcctcaggaagtcctgagacatgtgccccacggtggttgggggtacagtttgcttttatgtatttcagggagacatgagacatcaatcaatatgtgtaagatgtacattggtttagtccagtaaggcagcaacaactcaaagtgggggtttccacgttagacatagataggagacaaaaggtggcattcttttgatcagccttccactgaatacacaatgtagtctggcttgagtgtggagccattgctagggaccggccctcttctgcccagaatttccctgcctcctgtccctatcaacaagattattttcctttcacattagtttgctgaggttttaaaattaccttttctacagagttgtttgtataatttgaaggttttcttaaattcttactcatttagtggttgatgactcctgaggtagccacattactactaacatttaaaaaaacatttcaagtatgttctcaggtttgtaaattaagcttttcaagaatttaaacttacaaaatattctttaaatggttaacttgtatatgatacaaccttaggagtttattttttttttaattcattgtgctgagtcttttttttcttttaaggtaatccagaaatagacaacaagaaatattacaagtacagcaaagagaagacattaaagtggctggaaaaaaaggtatagttcctctctagtgccttgtggtaaaagtaaaaattcagttctctaagaaattttcagagaaggcagtaagtctgaatccagagaccatcttgtatattcagtgaaaagaggaaaattgtgtagagataccaagtatgagaagaaggctttgactttttaatcctccctaacttctgtatctctgaagttagctttatgttttcttgtgacctgcattctcgtttctccctgctcctactacggaatgaaataatttgttggtgtagatttgagtcttccaagtaagaggataccaggcttggcacttgttggccactgtcagtcctgcaggtgtctccaagggtgatgcttacacacagccaggcaaagggacccagggacacagccaggcaaaggtgttcaggtttagaggaagtatgtcctgctctcagggtctggacactgatgaggggtcatcttacaggcaaaccctgtatcttagtgattctaagaatcttgacctaatggatggactggggcagtgaatttcaaatcaatttagtaggtaacaaccagtatttctcttggaatgaaacagattgtgatgggatgggacgggacaggacgggatgggatgggacgggacggacgggacgtgatgggacgggacgggatgggatgggacgggatgggatgggatgggttaaaatatagcagaggaagggcaggtattaagtatggctctgtgaaatgtatttatatgtgtttaagtattgggttgctgtatatttcttactatgggttgtgataaaaaaaaaactttgaaagccactggtctaaggataatatgtactttcacattgattaagaatctcgctaaaccatatagaataatgataaagtttttgcaagatcagtggataccagtagttgtagtactgtttcctaagattctcttccatcttttgtgtgaaaagtcatgtttgtctgcatgttctctctcataagtgggagttgaacagtaagaacacatgaacacagggaggggaacatcacacaccggggctgtttcgggggttaggggcaagaggagggagagcattaggacaaatatgtaatacatgtggggcttaaaacctagatgatgggttgatgggtgcagcaaaccactgtggtacatgtatacctgtatgacaaacctgcatgttctgcacatgtatcccagaacttaaagtataataaataaaaataaataataataaataataaataaattgtgtttatttgtcataccatgttaccaggctcattgaaagcctgggaagctggaaatgagtccagtagaataatcagtctcctaatgtgcaaagtagtggaaagatttagagtgccatgtttcattttttatttgtgatatagtagtagtagtattccatgtaggcgaagaatgagaataaatgcggagcagaatccttgatgtttacttttgctcttagccaaggaaaatgacatgaatagcgaagaggagtttatacttactgattatatttcctaggaagtgggaaatttatattattctatttaggaagttattacatataaattttgtgccaggttctattgtaagggctttatttacatatattacctcatttaattttcacagtagtcttatgaggtgaatgctatttttttcccccatttcacagatagagccacagaaaggttaagtaactagccgtggttacagagccaagcccagcagcctgactccagagtcagctctcagttatcacaatatgttgccttctcatattgtgtaggccatggaagtccatgtattgagatcatccagatattgctgccactcagcctttcttcaaatgggcaaccatttctcatcttctggtgtctggtgaagatacttctaggttctcaaatacttctttgcagatctcttaaatggtctgaaggccacctatgaattcatagatttctaaagttaagttgaaaataccctgcctttcccctcttggttgcttcataggttaatcaaactgtggcagcattaaaaaccaataatgtgaatgtcagttcccgggtacagtcaactgcatttttctctggtgaccaagcttccactgacaaggaaggtaagtaaagcattttatcagaaaagatttttgtctggagtaagttgcttatgtgtaaatgcctatcttaggatttaaaaatcttaatatcacagaagcctcatattcctaccaatgcctcatacacattgtggcaggtgtgcatcttatttcagaagcgaagaatatttctaccataggttacttctgtcattcattgatacttaagttatttattcagcaaatatttcttttacattgatagtagtaacaaccctggctatcatttattgagggtgtattgtgtgccaggccctttgctaagttgccactatacaaacatgatctcatccaaccctcccagtaaatttcataatgagcatcttgaggccctgtgcaaagtctcacaactagtaaatgccaaagctgagctacttatggagcttgtctctgaagcccacacttgtaatctttttgtgatactgttcctgtggcacagttgtactgttccagtggctgcatctgtttgcattttcttctcaagatgcatgtttcctgatacagggatcaatatattttgattttagatgaaaattgatttacttggcaatttttcttttaggttattcttttataatctaaaaaaggtatattattttcttttccaagtagagtcctcttatttttatatgtatagttgaataagaacagctatataatgcagttaacaatctcaaatggtgagacagaaattattctgacgttaaactccaattcattgttcccttattcagggtatacatatggctttagtcattacataaataaaaactaggaatagtggcctgtttgtgattgatagtaattcaggcaatctgatttgcaggaatctaccttgcatgtataggtagttggctactgccattctgggagtggtggacagcacctttgccatactgagttaccagctgtcagtgtctttaattggctttaacaatagaagatgagggattgagatagatgattaatggatagataggtgggtggatagatgcatccatggatggatggatggaaccatagattttgttttaaaagtaggagaagggatgttagaggttatttagacagatcatctcattttttaaatggagaggtaggtaacttatcctcaagatcttctgttctaagtctagtgcttttaccagtactctacatattaaggttctgggcttggctatattgccatttagtgtcctgaccataaagtaaactttacatattttacattatttcattttttagatatttaggttggtttggtaccagaagcagcaaatgaactatatgttgactttcttaaaatagttttcttggtctagtcatgactcattggataatgactatcccagatccatgagcaattttaagaagggtcaaatgataactttcagttctccattgacaatgaaaatctcttactgaagactttttgacatcaggtggtccccagacggcagtcattttctatgtaatactgaggcaaattgttactttgacttgagagcagaggagaatggaaaaaaggaagtgagtgaatatcccagcagcaaacctggggtctgcttttggtgctttatatccccacgtggttatcccatcttatgattaagtttgattatctgcttgtattctacataaaatactgaattcaggaacagagttttgaaacattttattgtcttcttatgtaactgtatttctaattgctgccagagctgcattttagtactgagaatccaaatgctttagaattaatgatgataaattctgctgagttagttgtttaagtttaagtattttattagtttgggagtgtgtgtgtgtgtgtgtgtgtgtgtgtgtgtgtgtgtatgtagaactatgtatatagaacaatatgtatgtatagaactatatatatatatttcagggttcttataaagcaaatacctagtagtagagacatggtattttatttctcttaaatgagtacactcattactgttgaataattagatttattctttattgaagcaggcttagaaaagattacccttttaaaaaagacatgactatttcatattgttgtagatgatttttaaactttatttgtattcagtggtttcaaataagaaagcaaccctgagtttttgtttttaatgtcatttagggagcatctactgtattatacttgttttatcttatatctttggtatcatcacatgtcatatctcatccctcatatcttcccactagtctgaccgatagatattactatccccattttacaaatgagaaaactgaggctagagcttaagtgagttccctttatccagatagggtcagaatttgaattcaggtcaatttgactataaaaccaccataattactattttttttttttgctttcactcctccttctgtttctttcagaggattatattcgttatgcccatggtctgatatctgactacatccctaaagaattaagtgatgacttatctaaatacttaaagtgagtattgattatcttcagtcataatgaagtaccatttgcttcttggtttccccagcagtggggtttccttatggcttatcatatcactgtttatgatacaagattattcttcagctatgtcatatactttgtgctttggggatgatttttaatggatgattggaatgaactgatttgatggatacggattgcaggaactagtgaatgtcaagattggaattatggcttggtctgattttagaggattaactatgttaaaattttatcctcaattatacttaactaatttggttctttgtgatcgttttaagaggaagaaaggagggatggaaagagtagatggaatatagacttttttttaatttacaaaatattgatatcattttcactattatcactagatgttcactaaagggactttatgccaaagacttggaagtcaaagtaatatgaaacacaatctgtgtctttgaggggcagaagaagggttttaagaatggtttaatgtatgttcctttctttataaagagcttatacatttagactttaagttgaaaaagaagtgttagaagtgtttattttctagatttttgcaaaatcgttacttaattttgttgttaagattttatgtgtgtgatgatttaatagcttttcctgatccttataaatcctttttatcctctgagtcatgaagataaaatgactttttaatagatacagttgttggttttagcaaattccagaggtcctactttaaaaaacaatgattggaaactggtttctataatagttaaagtgtgctgaaagcctgcttcaaattgataatcatatccttctgcttaatatatccccagatttctatgctgcttgtcttgttagagacctcatgtctttgtactccattgtttgtatagattcctttctttccactaacatttttaagttttggttgaagagttcagaagaaaggtatgccaattaaactgctttctaatggaagaaaagttgaaatttatgtggctttttgtgaacagttaaaatgattttcacctttaaatatatgttagcatcttcactatgaagaaaaaatactccaacaccgaaacacaaatttatagaggctaaagaaaaggaactctgttccaacagatgggttctaattttattttttagttcagacaacaccaaaacaaggacttacatatcaaaataaagactcatttattgagaaaactttcattctttacactgagttgattgaacaggaagatatatggaggtaaagctgtaagttgaaaagtaggacttactaagtcttaagttggccctgtctttctgtttgtttgtctatgaaaaacgatgactttgattgttatttttaactttcttaggcttccagaaccttcagcctcattgccaaatcctccatcaaaggtaagaagctgtgactaagatatctttgggggacttagaaaaatattacactcttaccacatgagtttagttggttctaatatattttaaggtgtactaaatccattttgcatggagtgatgccatgtggaataaagattgtactgggctctccatcactattttttatttttgtggattccacctgaatggtaaataaagtgccatgaaaacccaagaagagttggttttagcaaggtacccctgtgaaaatattaaagacatatagttaaaattaaatcttcctgcattagttagatcacttaattaaatttagtaatcactaagcatactctatatataactaaaactcattttgccaaatctaattgtcactggcacaaaggtgaacagaaaacaatttccataatacaaagaatcctttgagcaaagatgatcactttttttctgaatttgaaatgattgatgaatttacgtgtaatctttgttagtggaaaatcttttcctcattcattctcaggctgctacccacagctcctctgcagctggtatgtttatctcctagatccagagaatggagaagccaatcataaaccacacctgactgcaaattgcagcgttccttcagcccaggccagatctcagatgagttaaactctgctccaagacagggaaataaacatgtgcaccagcttgtcagtgaggtcatttcttcagccagcaaagtaacggatgccttgagaatgtaaaatggacatattgtggatgttacaaactttccttctcccttgcattgttttcttggccttcaaggtagctaaaatgctcataattttttatgtcattccctgtataaaggtggtggtggctccaaagacattgtccttagaaaaggacagaaaattgaaagtacagcagtgtttgtttgggcctatgttcagcatgttgtcaaaaaaaaatgcatgttttactctcttggagaatagcactgggcagaagtctgttgctgtaagatctaaggactgctctaggccagacccatgcgtctttcattccggtagttaatctctgacagtagctctagaggacctagagaggcacagttgtcttgctgaaactaagagggtaggttctcagcgtgcttcttatttttcttcatccaaaaatgaagcagatttttttctcccaaatatctatcttccttagtaacttagagatcattcatgaattgatctaaacctattcttgaaagctttaaccttggataccttttggagtaatatgtttcataactttattcttctctgctcctgatttctgttttcttattttaattttcagaatttaagttgtttgtgacttcatcatttatgatttagatcagagatcagcaaaccttttcttctaaagccagacagtaaatattttaggctccatgaagcagatggactctattgcagctactcaactctgctgttgtattgtgaaaacagccacagataatacataaacgaatgagcatggctgtgttccagtaaaacttcatttataaaagcaggcagccagctggatttggcccctgggccatcatttgccaagccctgattttgattttggcatcttgctcttcctaaaccccagccttgtcttctatattatttgagttgcttttcgaggtcttctactctgtgtctttctggggttccagtgtacacatgacaaactatactagacgatgtaccatcgtttaaacaagcgtagaacatatcttctgctagctttcctgtctgtatccaggatttgattgatttttacagtaatatagttgactgtttccaggaaatatattccagtagtcattaggtatctttgtatctatgttgtaatcgatagcgtggagcctgtcatctttaatatgttttatattattttcctttactatcatatgtctgcctttgttgaaactcagcttccaaccctcacttgctccagtcttttcaatttgtcactgtcagcaagcagagttgaatgcaaccagtgggtttggagatgttcccgagttccttcttgcaaatcatttgtaagaaggcctaacattatccctgtggtactctgcagtttgttctctttccagaactgtatccatttagtcatagcctttgttactgtctttctgagccacttctctgctgaaacaatctcccaaatccatagggatttggtcttttaaataacaaaaattttagtaaatgcttcaatcatctttttttccaatatattcaacagtgcactgggaataacatacaaactagttatatgtagaggctaccacaatcattttctttttttaaacacttgtaactggtatcttgttttgttgtgagctattaaaacacctgaacaagtcatttctccaattaaacattttatgtccatacaaaagtacctttcatcttaagttcttgtaatgaacactttttatttgaattatcaatgaaaagtgaacctcatcagttcagtggcacacacttgtagtcttagctactcaggaggctaaggcagaaggtcgcttgagcccaggagttcaaggctgtagtatatgatgatcgcaactatgaatagccaccgcactccagcctgggcaacacagtgaaaccctgtctctaaagaaaaaaagggaataatgtctaagtgtttataatgacatctgtgttaggaacattttgccatagagaaggaacacaagcatcctcataacttcaagctttttgtgttttgaaaatattttggccttcagcattattagctgtgagtttcaccctcctagctgaagatacctttctagtaaaaaatgtgcatcacctaaacaccctttgctgtcttaatttaaatagaaacatgtatttttttttttgagacagagtcttgccgtgtcatctaggctggagtgcagtggcacaatctcagcttactgcagtctctgcttctcaggttcaagcaattcttgtgcctcagtctccggagtagctgggactacaggcacatgccaccatgcgcagctaatttttatatttttattagagatggggttttgccatgttggccaggctgatctccaactcctggcctcaagtgaccgcccacctcggcctcccaaagtgctgggattacaggcatgagtcactgcaccaagctgaaacatatattcttaacaaagttgcaaatatacattcacttggtgctgataggtggttcatttgtgatggattagtctttttcttttaatgattcatttgctagaggttgctgtgtggccaagaggttttcctatagtgtgtggtatattcccaggatgagcctctgtttttttacagcaaacaattttaagacatggtgttttatcctcttgggttatgggataaaacaccatgggctgtggaatcttttagcaccaactctacccgttctttgtttagcaaagcaggggcatgaagaatgaagctgggaagaagtctgtttcctaggttagatccatgttgggtctggtcaacctggtgtctccataaacagcctgaaaattataaaaatctgggttgtgatcaccatgcagtcaattctccatgttcaacagcaagacttgtcttccctgcttttgtaccttttacataataagtgtggcatgatttcttctatattgtgatcattaaggccttgacaagattctcacattcactggtgtaaaatgttcatgtgaaaggagaaaatattaagtaaaggtctgacttagttgcattgggcctaatggaaagaacactgtatcagaattgaaatcttggccaaagtcctctacttggtgaccttaagctattcatttagcctctctgtgcttccctctcttactggctgcttgcttgtgcaaggttgttcttgcatggataaagtaagataaatattgtcccttcattcataagtggacattaaactggcccaggaggtaaatgaaatagggattctggctggacacctggcccccttcaagagactattctcattttgacttctgtgccttgcattcatctggtaattagcaatcccctcatgcccaccacacctggcacctacaaagcctgtgtttgctggaccagctaaggggctcagccatgtacttacccaatcatatccaccatcaccaaggctgcttcttaggagtgatgtgtggctcaattccctagatgattggcaaaatgtaaaggagcctgtaaaaagtaagccctttgctgggtctgctgtcccattcgcctctgtagaggtctaaattatacatgttgggtttttttttaatggattgatgttgtgtcaaagtgacatttgacaccacttcactgctctaatgttgcagaaaataaagttatcagatgagcctgtagaagcaaaagaagattacactaagtttaatactaaagatttgaagactgaaaaggtatgtgggttcaggtgtagtggtgtttcgttcatactcagtgcgtgatgtgcatgaatacatgaggaacagttgcacgcttgattgtgattacagttttgaccaggaagaattattaacttgcatttctgtgacttaataattaagaattgcatatgacaatgaaaatgttaagcaactaagacttattattagtcagagaaaaacaatatactacttatcaagagtgtgcctaaattttgctatgtattcatagagtgatagggtgggaaaggagggaggaagctctacaggtaattttttgtcaaccctgctgcccagaagcagaaattatgatgataaaaattaataatttcaccattcagcattcaccctggcaaatggcattttggtaacagtccttacttagttttatacatgcattataaatacatatgtggcctttaacattggcattataatactcagttctgggctttttatttaacattaaattgtgaaaatgttcacatatcattaaacattctttgaaaaaatattcatgtttttatgatattcagtcatgggtgtttgtttcaccatatggaatgtaatttaatcatttccctatatttggacatataggttacttctgatttttttattttttgtttttattgaagtgatagacattcttatttacagtctgtatctccaatcatttcattagacacaattttgaactaagactaagagcttggagaacatgaattctttcataattgaaatatatatagctaaagtgcttttcaaaaatggagaaagttgtgcttccaaacattattgccaatgagtatttatcttgcatttttgacgacattgagtattgcttttattcttgaacattgttgcctgtcaaattaggctacatttctttaactagaaaggttctttttccaaatgcttatggcccatttgcatttttgcaaattgttggttcctgtcgcttgcctgtttttatgttgagatagtaatgtttctctgttgctttgtatgagctcattctaaattaaggctattaacacttttcatgaaatataggatacaaacttgttttaactttttcatttgattttttaacagtgttaaatttttctgagtgttaagtacagaaattgtttccctttatgatttttccattgtttttatgcttaggaaggccttgcccatctcaagataagttaactttcacttagattttaaaaatactaactgccctttgagtttaatgttttttagaactgttattcttgaatcaatatgtaatttatttgggcatatgatactgaggatagttcgatttaagatctgcccaaatagcgagttatctcgatgctgtgtcaacagggacattgtcagtttctctgagagaaatctttgtgccccgcccttctgtgggagtgccacttattgtatccacttgggcacagcatggagaatgtcttaaatgcaccagataagtctgaaacagactgttgctttgcaccattgagtcaaaaataagcctactaaattataagtgacagaatgtgaaaagcagaattgtgggaatcatatactgtgcctctaaaaaatactttatcaatgactttgtcttacagttcccagggagacaggtgatttttttgttttctgattcccatcatttatgcttcttctgaacaatttgtggtgcatctgcatcaaagttaaatcagctgctatttaccttctgcaagtgctttatataagacatggaagaaaaaaattcagtgaccagagagagatagaaatgtacagggcagaattatttggagtcagctttttggaaagtattgctttgttggaggaaaaataaggcagctatcctgctggtctgggatgctttgcaacacaagtcatcttttgaatatcatagggttgtccttggtttcccatggagcaaatgaataaaatcagatggtaaattggtgtgaattattcatcatgtggtaatacaaggctgtaattcctacctctgacaattgcggcctgtgtcagttccattgtttgtgttattgtactttatgcaccctccagaattatctaccccctccccagtgtaaaccattggttggaacattctgcttcttagaaggcagcagttttgtcttctgcctcttttaacatattctgtctcttaggtctgaattctgaatagaaatcagaactttttcactcccttatgaagcatgttagtgggggatgcttaccttccttaatgaaacttgagacatgcagtcttctttgatttccatatatgattaataaatgttacattcataacaatttttctctcttattttcattaacagaaaaatagcaaaatgactgcagctcagaaggctttggctaaagttgacaagagtggaatgaaaagtattgataccttttttggggtaaaaaataaaaaaaaaattggaaaggtttgaaactttgaaaataaaatctagcaaaaatatttgctttttacatgtttcagtttgtccttcctgactgttaatgactacctttggttgggggaaggaagaggccaatttcatgttctcttaaacatttctttgcatttggtttttgtgttcctgaacaaaatatgggaaagtgtctaacttcatggctatggccttttggagtctcatctgacataatgaaaagtaatcacttgaagagaattaacatatagcatcatgattttctcaataaactgatgtgtgacaatgttagagtgtatgactgctttttaatgcaactttgcattcagtaggtttagtaataatattttcaatatactgagagaaactggattacaaaactgtgaggtaaattgttactttaaaaaggctttagtttttggtaaattttttttttttttttttgacacggagtctcgctgtcacccaggctggagtgcagtggcgcgatctcggctcactttttagaaaatagagaaaataataagaacttcaatctcccatttcttcattacccagagataatgtattgtcttataataatttttagaaaggaattacagttactttgtaaccttttttttttttcaacttttattttagactcagggggtacatatgcaggtttgttacagaaggatactgtgtgatgctgaggtttgggatgtaattgaacctgtcacccaggtagtgagcatagtacccaatgggtaatttttcaagccttgctctcccactcttcctccccttgaagtccccagtgtctattattgccatctttaagtccatttgtacccaatgtttagctcttacttataagtgagaacatgtggtatttggttttctggtttttttgcattaattcgctcaggataatggcctccagctgcatccattttgctgcaaaggacatgatttcattctcttttatggctgtgtagtattccatggtgtatatatgccatgttttctttatccattccactgttgatgggctcctgggttgatcccatatctttgctattgtaaggagtgctgtgatgaacatacaggtgcatgtatctttttggtagaataatttattttcctttgagtacatagccaatagtggccaatagtgggatttctggatcgaatggtagttctgtttttagttctttgagaattcttcaaactgctttccatagtggctgaactaatttacattctcaccaaaagtgttcccttttctctgcagccctgccaacatcatctgttatttttttacttttaaataatacctgctctgactggtaggagatggtatctcattgtggttttcatttgctttgctctgatgattagtgatgatgggcgttttttaatatgtttgtgatcacttgtatgtcttcttttgagaagtgtctgtttatgtcttttgcctaccttttaatggggttatttgtatcttattgatttgtgtaagttccttatagattctggatgttagtcttttgtcagttgcatagtttctctcactctaggttgtctgtttactctgttgatactttattttgctgtgcagaagctctttagtttaataaggcccccacttgtcaatttttatttttgttgcaattgcttttgagcacttagtcataaattgtttgccaaggctgatgttgagaagggtatttcctaggttttcttctaggatttttatagcttgaggtcttacagttaattctttaatccatctttagttaatttttgtatatggtgataggtaggagtccagttttattcctctgcatatggctggtcagttatcccagcatcatttattgaacagggagtcctttccccattgcttatttttgttgactttgttggagatcagatagctataggtgtgtggctttatttctgggttctctattctctttctttggcctatgtgtctgtttttgtatcagtactatattgtcttgattactgtagccttgtagtatagtttgcagttgggtaatgtgatacctctggctttgttctttttgcttaggattgctttggctatccaagcttttttttggttccatatgaattttagaatagttattttctaattctgtgaaaaatcacagtagttacctttttataaacattattttgttactattttcccagactactaactgttcttcataaatatgttttttaatgacagtataatttttgattatttggatatttgattatttaataaccatgatcctgtttggacatttggattattcacaaatgttcactatttgaagaatcagattataagtaaatatttgtccacatattttattgtttccttataatggatttttggatgtgggcttattggattttcaaatatatatttatgggaatatatttcatggaaagtttataagcttttgcactctaggcttattttaatggtcttgcactctaacaaacagtgggtgtgaaagcttaatgccaccttgttagcattggttgttacctttggaaataagtgtaaaaacattttattgtggttttaattcatatttccctgattagtagtgattttgaacattttttcatacttactaatcaattgtcatcttatagagaattgtcttttatattctttgctaaattattagagtatcaatatttttcttattgactaaaagtattctataacttaaggacattaattatttctactgtgtttgttgtaaatttcctttcttggtttatactttgcctttaattttgcctatgatttttgacatgcaggtgtttttagtttttatgtagacatatatacataaacttttcctttacacagatattgtacttagaaagatatttcattttacaggaaatttaaccagacacttttattttcttctgatttttttaatagttatgtttttggttcttttttgttttttttttagatggagtttcgctcttgttgcccaggctggagtacaatggcgtgatctcagctcaccacaacctccgccttcagggttcaagtgattctcctgcctcagcctcccgagtagctgagattacaggcatgtgccaccacgcccagctaattttgtatttttagtagagacggggtttctccatgttggtcaggctagtcttgaactcccaacctcaggtgatccatccgccttggcctcccaaagtgctgggattacaggcgtgagccaccacgcctggcctatttttgttttatatttaattacttaaatcatctagagaatgtgtaattatgtttaaatatgctgtgaggtaaagctgtaatttaattattttctcaccagtttagtttttcatttaatctgtaggattattttgtcaagttctaagagtaagttccaatgggatttttactgagattttgttagatgcataacttactttgggaaaacaaacatctttacaaacttaaatattcttatttgggaatatagtatttctttttagttactcaagtcttaagaatacctttcactaatgttcggttcttcatcttcaataggttctagacatatctttgtatgagtatgtgtagatattttcattgctattaatgaaatctgtttttttccagctaggtctaccaactggtcattttgtggtaaagttttatatttttatatatttatcttttaaataaccagtttactaaactattaatggaaaaattttccattttatttattttgggttttagtacataatatagtatgtaatttagtttttaaaaattgcatgcaattctttctaatagttacacctcttttattatatattttacattatattacatgggctagaatatccagaacagtattaaagagtaataatagccgtctttgtctaattggtgattttattgatgtgctttaccattaattctgacactagctgttgctaatatgataaagactatccatccttttatacttagtttccttaaggtttaaattaataattggtgttggttgttatcagaaagctttttggcatctattgaggtgtctataaagtttttactacttactatcaaactgtacccaaatgtctaataaactcaccctggcagtagataaaggatcaatagcataatggatacatcctatctttcttaacctttgtcaaatatagttttcaattagactttctacacttttattaaggaattttgcagacatattcataagcaatgctgctgttaggctttagcgttagaattaggctagctttccattttttccaatgttctggaaggattcattttgcattattatattctattgctggaaaatgtttaagaatcttagaggtaaaactatctagcactggagcctttttgttgttatagttttctttaatctgcaagagtttctcatctgttctttgtcttacttgacatttttgagtacagggtaaatatttgctggaatatttcttattctaatatttctttttgattaaattcaagtcatactcttagggcacctccaggagtaatatgtctttctcagtacaccatggcaggaatcacagtctatcccaatatcagtgttgttgactttgatcacttgattaaggtgctgcctacagttttcattgtgaattattgttgattatttttataattaataagtaatttgtgggtaagtattctgggactttgtaagtatcctatttcttatcggatgtttgcccactatttttaggatctgatgattttctaactttcatttcttctatatttatcagttggcattcttctgtaaggaagaactttcccttttccttgcttcttccctcatttatgaattcttaacagtatggatttatagatttttattttatccagtgggctatattgcattattattattaattttaatgctcatgttgtttcagaagagctagtgggagacccttcaagctgacttgtgtatcttttgggtatgtttctatcattctttaatacattcctgcttctgcgactggagtttcagcctcttgtcctgtgcaagccctgaatccacctttttttcaaagaaccctggttcctttcagtgaagaatggtatttagaaaccaagatctaggcagtaggtatgctcattgctattggtatgtcattgcttaggagccaaagctaggaaatgtgtgtgtgtgtacaacatgtacacacacatatatacactatatactcgtatcaacatttctaaatctatccatgtatctatcagtatttatctatgtgtgtggttttttgtagattccctttatcaggctgagaaagtttccttctgttcctagttcactgagagtttttatcatatataggtatttatcatatgtggatattgtcaaataatttgtatctactgagatgatcaagtagttttctttttaatagaggaatgtcttttaatatatgaattataatgattgatttttgaatgttaaactaattttgcattcttgagataatccctacttggtcacagtatattattctttttatatgtagtatggggtttttttcctaatattttgttaagtacttttttgtatctctgttcatgagggatattggtctgtggttttctttacttgtaatgattttgtctgattttgatgtcagagtaaaactgggcttataaaatgagttgggaagtattctttcatcacttattttctgaaagagtttgtgtgaggttggtgttgttgcttccttatatgtcggacacaattcaccagtgaagccatttggacctggaattttctttgggggaaacttttaaattactaattcaatttctataatagatgaagagctattctaattttctttttttttcttgtgccagttttggtaatttatgtctttcaagaaatgtatccatttgatctaggttgtcaaatttattggcataagttgttcatcacatttttattatccttttaatgtctgtggatctgtagtgatattccctttttcatacctgatgttggtcatctgtgtcttctttttgctttctctgttagtatagctaaaggtttgtcaatttcattgatcctttcaaagaatcattgtcttctggcttgcataatctctgatgagacatctatgatatttcttatatttcttctcctttacataatgtgtctcctcctcatgggttcttttaagattttcttctttattactagttttcagcaagttgactatgatgtgttgatgtggttttctttttgtttatctcatttgggagtgtattaagctccttgaacttttgagtttttaattttcatcaaatatggaaaatttctggccaatatttctttaaatacctttttccattctttcctcccttttctccctatcccctcagcttctggcctccaatttcatgtatgctggaacacttggtattgtcctccaggtcctatcactgagtttctgttttgttggttgtttgtttttttatgttccatttttagacagtttctaggtgtatcttcaagtttactttgatttatagcatttcatcttctgttaaccttagttatttaatttttactttaaatattgtaattttatttatttatttatttatttttgagatggagtttcgctcttgttgcccaggctggagtgcaatggcacaatctcagctcgctgcaacttccgcctcccgggttcaagtgattcacctgcctcagcctcccaagtagctgggattacagtcatgcgtcaccagacctggctaattttgtatttttagtagagatggggtttctccatgttggtcaggctggtcttgaactcccgacctcaggtgatccgcccacctcagcctcccaaagtgctgggattacaggcctgagccaccacgcccggccttaaatattgtaatttttagttctagacgttccatttggttcttctttatgtcttcccgtatctgttcttattatgcttgcagttttctttaaatacttcaatatagttaaaatagctacttaaatgtcctcatttgctagttctattatctttgttattttctatcttctaggtctatttttctcctctctcttttactttattttgaaataattttatacttttctagaaaagtcacaaaaatagtagagtttagatatgatgttcacccagcttccctcagtattagcatacatgaccatactacaaagatcaaaaccagaaaatttaccttattgtactttcacctatctttccactaatacttttttaatttcagaattcagtctgtgatggtacattgcatttagctgccacatctcttcagtgttttctaatttgtaagagtcccggccgggtgcgttggctcacgcctgtaatcccagcactttgggaggccagggcgggcagatcacctgaggtcaggagtttgagataagcctgaccaacatggagaaaccccatctctactaaaaatacaaaacattagccagacatggtggcacatgcctgtaatcccagctactcgggaggctgaggcaggagaatcacttgaacccaggaggtggaggttgcagtgagccgagatcacaccactgcactccagtctgggcagtaagaggaaactccatctcaaaataaaaaaaagagtccctcaatattcctttgtctttcaatgaccttgacacttttgagagtagtagccagtttttttataaatgccccttaatttttgagatactttgaaactatgttaatatcctatttcttttacgatcatttcactatactactaactaataatactgacaaacactgtatagcatttatgtgcttggcattgatctaagcactttacatataataactcatttaatccctacaaaaattataatcatagagtgccatacgagccagaatagtgacacccacccaaagctcaaaagatgagaggaggagctgcttaaacacttgcattattatccctgttgaaagttagcttcttcacaataggaactctgtaccattcaagcttgtgtcttgcacggtgccgagcacacagtatgcaattggtaaaggatgagtacatgatagtcagacaggttgaataatctcagcaatattctcactaattgagacttgattgttttttccagcaaagtcgagatctttatctacctttaaagtgcctaagctgttttctgggtttcttttgggtccttgaatatgccaagctgtttccacactggtgcctttgtatgactggtttgtctctatgtgcctttttctgaatcttcacaggactggctccatcttgttattatcacttatcttaatcacttttccagagacccaatccttgaccttcctcccctacccccacccagctcctactcagtactctccataccattttcctgccttactccctgcataggaccttgcctgactgcttcacatatagtcatgccccgcacagcaatggtttgattgatggcagactgcatatgcgatggtggtcccatgagactataacacagagctgaaaaattcctatcacctagtgagttgtagccatcataacgtaaggttgtagcacattgcattaccttttatatgtttaaataagtttagatatacaagtacttactattgttttacagttgcctacagtattcagtacactaacatgctatacaggtttgtaccccaggagcagtaggctgtaccatatagccaaggtgtgtagcagactacaccataggtctgtataagttgtataagtacactctgtgatgttcacacaacaacgaaattgcttagcaacacttttcccataacatatcccatcattaagcaacacatgactgtacatacacagcacctaacttggggttgcatacagtagaccttcaacagatgtttgttgcatgagagaattaaccaaccaaccaatccatcaatccatcctggacaccccagacaggtgttcagcaatacagtgttggagtccttgacagccttgtggctaaaccttgaacttcaagagtcgttctgagaatgagttttctgtgatgcattagtatttgaagtccaaggacttattcataaactcactcataaacttgtatgggccttaaatttgtgtgttaatgttgctggtaataaatgaaatagatacagtctttaatctctctggataaagggctgtgaattttcttctgtcagttgattgaactgcacttactggagtcattttacgtagcatttagagattatttatattaagcccgcaacctaaattattgcagtttgagaatatatgtggtttttataaactctttgtattcacagaggcttgaataggagctcatattatgatttagctacaaattatttgggaatttggtaaactggcaattttgttttcttgcctgtttcactttacctttgatgccaagttgaagatctcactggcaatgtacaacataactgagctgaataataattgaaaagtgaaaaacaaaaggtattacacataccaggtgccattttggggaataatattaggaataaatccatgtgggtttatagttatacataaaatgttcatatacacacataacacacataaacacacatatatacacataagtacacacaaacataaatgcatacccacatatggcacagatacagacttaaatctacatagcctgtcctttagaattctttaaggaatttcagactagagcctttttagactcttgtactaaacattaggatacgctagcctacttgaatcctttggccctttgcttctcttacttacatcatttttctctttgattaatgtgccaagtttgggaaagcttcacaacatttccacaaactgcaaaaccacttgggtacatagacaaaagcctccatctttttcatcaagccatatatttttttttttctgaaactgatcacaggttgccaacattcttttttatttctagtttatcttcaatttaaatttaccttgtagtctcagaccctgtcatctttcaaggtttgtgcttctcggttctgcactgccaaagagactctcctctgtaaggcttaaattggatgtcaagtggaattgtcttttgtttgttcgaatctgtttcatattgtgctgctgtccattcccaaaatcatatttctcttatttggggccttagcaagacacaaaggcaagctctaagtgagaacctaaagtgtacctgttttcttactaaatgtacagtgttgtttatattgtatgcaaacttctgacaacagtgaacaaatatcttaatctttaaaaatataaataaagtgaaaaaaggacttcacatcaaccatgtttcagtactaaacagactaattaatacaacatggcaggattgttcctggttgtagtctcagttccgccttaattctgtgagccatggaggaagtcattggcatctctggcccccagtcacttctcagcatgaaatgggactatatcatcaagattttttatgtctttccctccagccgctggtgcttggggagccatgtctcctttacacctgggaggaaagtgcttttagagttatctttcatgcagtgcttaccatgcactaggcactcccctaaactctttagatgaaccagctcatgtgttttgctggaagaaagtctggaagaaaatacaacaaaatgctcatactgggttttggggtgcccatgatatgtgtatatgtatatttcttttcttcatttttcaaagattatttcactttgccatagaaagaaatacaaagaacacaattgttggaaagtaataacaaagactggcaaagcgcattgtgatttttaaagcaactttgacatgaatttatgtgtttaatctttccaggagccatatggcacaaagggtattatttctcttgttttgcagttgaacaagggaaggtcagctcatttccccaacatcacacagctaatgagtaactgagccagaacttgaattcaggacctctcacatccagactctaccacatcaaattccctttccccagtggctctaactttgactctgttacatcctagaacatcacctctttaccagatatgaaagacaaccttttcacatagtttaggagttgactttctctgttcttaaagctgatctaacttgactagctgccttgtattacatattttctcccaaacacccctttctctaggacgaatccaaaatttggcaatcttgggagttagctatgtcatagtcagatctcttggaagacaaagagctccaggtctagagaagcaagtgggagggtgttttccaagtgtacttagaaaatgtttatgagctttgtcctcatctgaataatcagaagatatgatttgatttttacaccttggtatacacttggagattacacagtcctgaggtttatatattcctcagagccattagactgaccaaaagggttcgtccctgtgtttcatagtatttttacagttctcacagcaatcacttatcagtatttaaattgaccttagctgggcacagtcactcacttctgtaatcccagtactttgggaagctgaggccagaagtttaagtccagcctggacaacatagcaagactgtttctacaaaaaaaaaaataaaaaattagccaggtgtggtggcacacacctgtaattctagctacttgggaggctgaggagggagaattgcttgaggctaggaattcaaggttacagtggactatgattataacactccacttcagcttgggtgacagagcaagaccctgtctcttaaaaaagtaaaataaaataaattaatctttacaacaaccctccaaggtagaccagaaagaggtggtatccttattttattgatggtctgtgtgaggtcatacagacagtaggtggccaagcccagatgccaagcctaagcctcgttccttttgtttacccaaggttcctattcataccattatatgaccatttagccttaaataatctgttttaattgcaaattttattttaagaaaggaaaaaaatcacatttattctgctgcatcttcttgctttattcataatgaattctgcaggtcaatttatcctcaacgatggcaagccagaatttaagtaaagcttctacttagctggtacatttgcatgtcaaatctttaattcagctgtcagtgttttagcatttactgtactttcattaataaatgttattttgatggtctcaggctaatcaagactatttgaaatgggggacggcaccaaatgaaatttacagagaaatcagagcttcttcatggactttaaaataattgttactttacacgtgtttgaaatcagaatacttgtaaaattaaagttagacatgttgttcttgcataaacaagcaaaagaagctaaggaatcaacttagatttatttgttcctttaagagcatgtactgagcacctgctgtgtgctagacatgttgtagatagaggaaatgcggatatcaacatggcaggcaaaaataacctgccctcaagaatttccattctagagcgagtagacagatgatatctcagatagtgccagggcctatggaaaaagctgaccaggcagggcactgaattctggggagtgggtggtcagggaaggccttgcttccttctcatccacattctggcatagaagtttgatttccatgtacatgtttttttttgtaacatatagctccagaatacgttatttttaactttgcactcaataaaaaatcaacttgtagtaattaaacttgttcagtacattcttcacagggacattaggtgctactacttctatcagcaacaagtatatgcttatctattttttatacattggagtctacacaaggcttcctgctttttataaaaggaactgcctctacaaaaaaaaaaaaaaaagaaaaatggtttaagaattactcatctcagaacgttactttcgtgcatttcttgtattttattttttttcctataagatggtgcccatcctgtaagtttgggccaccccaacattatatttcactccctttgaacattcaaagaaaaacatacttcttggtgtgctctcgaggagcctgctatgaaccctagaatgagatctcggaggctggccacgatgggaaccccttcctgtgtctgaggtcatctcttagaagcgaaaatgctcagctgccctcaggactaaacccgccagccctgcgttctgttctaggagctgcagatggtgcttggggtttcaggtgactgtttctcctcaccaggacacaccacatgttttcctttcctctctagatggcagcacaaagacagaaaaggggcaagtgatggtggtggctccacgcaaggcttggcggttttccctgcaacttcagacactcccagaggactcggactttttcttctgcacttttttggaaaatcgccaggtgccaaaaggtgcattttaaagcgctgactgtaaatgctttatttctttgattagtaccactagtctatgtgggcagcggcattcctccctggagcactcagctaggcggttccgtccaggagcttgaaagcatcccagcggtgcacctgttcagtctgaggacctcaagcttgggtcaggccagcatgttttaggtatggatgtggtgacttaaagtacttgattgtcttgatttcaccctgaaagctttggcaaaccaagtttcaacccttactttaaaaatctgacactgctttactccatatcaatttggaagcttctaattcataaatatacctaaacgttggcattttatctctccaggagttattaaacatttcttcctttttagaagatttgtccagtatgtgtattattttatttttcagagtaaggacataggagatgacggaaggttggaagtagatgccaaaaagtgatttggtggggaatctggtgcgtagtgcatatgttttagcaggtagtgggaggttttgtgcaaaaatgtctgtggatttgagctggcttgtccacttgacatgcaagaggaatgtgtgggtgctgctcagctgatcttcccgcattcacacaggaccccaatctgcttcttcaggaaataattttgtttctgaatctctgactacaaggagtattaataattagatcctagttctgggaagtagtctgccacttttccacacctcccttcacatgtagaaatttttgttaacctcaaaggactttaaaaattcctgcccttctgtagtggaaaagtgaatcttccctctgcaaaaaccaaagccactagatattgataatgtccaagtttgtcactagaaaccctgctgtcttacctgtgccccaagtttctgttccaacactttaaattcaaacacctaacattacaagatttcattgggttgttttttttcttttcacaagtaattcatgatacattctcacaaaaagagaaggcagaagtgatccccacctcccactgccagcactactcaggctcccctgggtgactgcatccttgaccctgaatcaagcatgtttcttagttatccagtttcccacttccagtttctatcttttgccttgcagcccgagcagccctacagtcactgttcatgcaatccatttcatcgtttcatctaagaatccaatcctattgagctctccttcagaaatacctcatgggaaaattaaaattaagacaaatcaagaaatagaaaactccagcacttgaataagcccttttctctcttttttttttttttttttggagacagagtcttgctctgttgcccagattggagtacggtggtgcaatcttggctcactgcagcctctgcctccaggttcaagcgattcttctgcctcagcctcccaagtagctgggattacaggcacgcaccaccacgcctggctaatttttttaaaaattatttttagtagagacggggtttcaccatgttagccaggctggtctcgaactcctgaccgcaagtgatctacccacttcagtctcccaaagtgctgggattacaggcgtgagccaccgtgcccggctagccctttcttcttcatgcccactgccaccaagcataaggctgttctcttgagggcagagaccatatgggccatgtatcaaatagagacaaacccgcggtgctaagaacaccaagatagcactgagcatgccgcatgtatcccccactcagcgcatgagtcactgacacacaaggtgacatactccttccctatcaagttgtcaaggacttttagaaaacagccatgctcagagctagagaggaggtgggaagtgggccttgctggtaagaatagaaaatggtacaacttttggagaccaacttggaaataaatatgaaaagcctgaatttgttgcattttctttgtttcagcaatatccattgttagaaatacagccttaggaaataatcatgaatatgtgcaaagatttagctacaagaatattcactgtggttctgtttaaatagtaagtaattggaaaaaaactaaattagaaggctgaaattattttttaaacttttttactgggctgtgtgtggtggctcttgcctgtaattccagcactttgggaggccaaggtgagaggatcacatgtgcctaggagtttgagaccagcctgggcaacatagtgagacccccatctctagaaaaaataaaaattaaaagaaaaattagctggtcatggtggcatgtgcttatagtctcaggtacttgggaggttgaggtggaagaatggtttgagtctgggaggtcgaggctgcgatgagctattgatcacaccactgcactccagcctaggtaacagagcgagactctgcctcaaaaaaaaaaaaaaaaaaaaaaaaaaaaacaacaacaaaaaacaaatttgtactgcaagtataagtaatatctctttttctctctctttccccacttccttctttccttcttttctctcctttttttcctttctccttgtctcccttttttagaaatttttctagataaacatgttactattatgctaatacaaaaataaaactactcagttggttattttataccattagtccctcataattttcctctccagattataatctcttttaaaatttttgtgtctcatttagtaagtttcttggaggaagaaccatactatatatgtttcgcagttttttgcttagcattcaagtagatcttagcaaatcctaccagtatcaaataattgcccttcttctatccccacacctttagagtttcaggtctctactatccgattccttgacttcccaacccagtcaaagatacatgatttgcttggaattgtgtgtttggggcatgtacacacatgctgaaattaattaattttgctttgaagatttcctaagagccctagaaataattgcaaatgctctgcagtatatcacaaccaggactgataattactgtttctgtctacaaaactaaggggagagagaaaaacatactactgaatgagcagaacacagaagccagtgaatgtttcacacttggtgacgtgcagtttttgctgtttttttgccctagcagattgtaaccaaattgctcaacttcacagaaataactgtagagactcaatttctgaatgctcgtaattggcttttcaaaagaactttatagggataaattaattgctactatacttttaatggttttaaagttacttaggccacttctagaaatatgtaaaattgtatgatcctaacttaatgtttcatttctccctcagtttttatgtgatttgataatataatgaagggaactataaaaatttgatattgttggggcctttttagaaaattgagatacatttttctttgtatcattgttgctaaaagaggttaaatattgctacttattacctaggagaaagaacagcattttgtggcaaaataagtaggttataccgaatttgacagacttctctcctgaccgattttggagcacatatcttcatgtgccttgtaaaactagagatgcattcagttttcaatgttcccagatatattttaccactctatttttcccatatagcatctcaataaactgctgtttcataaaactcctttggtacttttccttgcaccttctttagtcactttatagcaagaatgttatccacaatatttaacataaataaaatagcacagcacagaccgtagaacaatctagccagattgccagtcttgtagtactgatgccctcccctgcatatcacccaagctttaacctaaaaattaaggcaggaaagccttccagatgaatcctgttctggaatcctatccatctaggaacccttgggtgtgtgtttattgtttgggttttgtgttgttttacatttgtttgttcacttgttcatgcttacatcatttcgatccatcatgatacagctgttaagaacttaatatcaccagcctttggaaaacccagttctatttgattaaatgttatctatgaaggtattaaatattttttctagaaggttatccaggctgaataccaccttttcattactatttcaacgtctcaagactcaactactccacaaatgtagacctccatccagacttcccatctgagctccgtgcttgaatgtctagtggtcttttgacatcacagtcacacttgagtatcttaaggactatctcaactcatgatcttctccttgattgaaaaagaagaaggaataaagggaaggaaaaagaaaaaggagggagggacgtagggaggaaggaagggagggaaggagggagggaaggaaggaaaggaaagggagggaaggaaggaaggaaggaaagaaggaaggaaggaagaaaggaaggaaggaactaaggaaagaaggggaagaaaggaaaagaggaaaggaaggaaggagataagaaagaaaatagaaaaggaaataagagaaggaaagtgtttaaaaccaaacatggcggacagagtttttcctagctttacctgttgatacaagctgcaaatcttagagtcacccttgaccgcgtcgctattgtaaccttgataccccatgcatggtctttcagtttatcctgtaaaaatctcaccaagccagatgctttgctccattcctatcaccttcctgctggttcaaaccactgtcatctcccagagcacaactgtgtcctccctacctggaggaccagcatccaactctagaacccttctgtgcattctccatgcctttcaaacacaaagttcactatcatccctgcctctcccatgaccttgcacatacccagttccactctaaagttttcattgctctttggatgaagccccacatcatgacctgcaaggccttgcatgccacagctgaagcccttccctctgcagccacacttcctctgcagaccctcagtcgtgccatgcttactctggctatgtggcctttagctgtgctgtctcctcacctgaaatgatctgccagcttcctctggttacctaagtcctgatcttccctcagatctgatctaccatggtcagccacagggaagccttagaaaggctcccctgacccccagagcaggtcagatcttcccatcacagctgtcacgatgcccttgacctccccttcatggaactatcagagacaattttatatttgtaggcctaataatcacgttaatgtttatctcttggattacacagagcttcgtgaaggcagagaccatttaactaaccactaaccactcgtgcaaagagttaacacggcaagcctgagactgctatgcttagaacggcctgcttgcaaggttggcctttggctggcatctgggagcttgagtggtaaatggttccttacactagtatgagacgctgataggatcagaggggctggccgtgcctaaactgtgggtagaagcatgtgctttatgttgaacatgcaactttctttccgggggtcgggagtttcgtacacgccaagcagaggaagccacgtgaccagccccaacattagtcatggaatcggtaatggacttccctaggcagaattgttgcaagtgtggagctgcatttccatcgctgaggtgcaccccatgtgaccccacatgggagggagagagcataaggaatcctgtacgtggatttctgcagactctgcccatgtcttttttcctggcttggctgtgtatcctcaccacaccactgtcataagtcctagctgtgaacatggctatatgccaactcctgtgagtcttcattgcaaatactcaaacatgggggtgtcttggggactctcaactcaccatggtatccccagaatcttgctcagtatttgacatttaatgaattgcttaatacataattttttttaatgaaaatgaaaatgacctcagaggactaggactaagtctatcctgtggaaattctcaaaagaactaaggaattttatgatttatcaactatatcctaatgacccaaatagagaaggcacatctttccggaaaaggcagaataaaaaatgattcaggaaattttgcccggtcaaagcccatttgaattgttttctcatgaagatgaattttctgtatctgaagtggcagcagggcagagatgagccagcagctcctctcaggccctgatgttgttctgctggcttcaccatctctgccctctttactgtgtgtttagattgttggccagcctgtcacagagagtgacgcctcagcatcaggggagcaagagcttctcaatgttggctgcacattggaatcacctgggaagctttaagaactactgatgctgggccccactcctacagatgctgcaaataatcagtctgaggtatggtccaggcactgggattttaatttgcagcctcttctgacaccacactctcctttccttcctccccgacacatcccctttgacaatcagatttcacaaggtccatccttccaccaaagtgaattcttattttgtaaatgcttcttaaaatttctggtttctggttttcgaactcacagccaattagcaggcacactgataagaggaagaaataagaccttttgcctcaaccacatgagaagactggagcaactaagacaagcaagtggaactcgaaactatacaaatcaggactatggcggattgggtcactcctaaggacgtggctggggtgcagaacagagttcaggagatggtttttaataatgaccagtagtctacaccaccagttgcccactaagaaatacatgtgtcactttacatataagatgatgtgaattaactttattttgattatttgttaacagttcatcatcagtgatgaggaggtgtatgttatttcctatattgggaagctccttcctccactaaatgtaaatctatccatttgccattttttaaccgttctctagacaagacagcagaccatgagatgcaagagttgttaattggcagagctgtgatttatctttcctttgtaacacccagggagattgctcagggaatggaatctgtgtctagaagcagtgtgaggtaaggctattcatgtcttgaagtcagacagaggagtttggctttgaagggatggaaatgtaggttctcaaacagaataaagagccataaaaagggagctacagggttgccaggtgtagatgggaggctcttatggagaaggtggaactgagctggaatgaatgggattcaggcaggtgcagcccaaggcaaggcccaagggaaagaaaggaattgacaacaccttccctgtcttcagaatcagaagcagtgagaattcagcaaggaagtagtcttagctctttgggtttgaagaatctctttgggatataatttcactttttctctgcctggtgctagagtctaaagctggcagtggaaattccaagataagttgttcttagaaccataagggctggctaacaggccagtggggacacagcctagagggccagcagctatctgggggccctagggttggacaggcccaggcaaggtgagggcaaagtcaggtgacttcatttacccaggtgcaaagaaaggcgtcagccttcaaaggctttccattgttaacaagcagaccagaggcaactaatcactgaatggaaactgataattttgctgctcatttattttcccagttaatgcttttcttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccccagttaatgcttttcaacacaaccctttatatttccgaagaataaagacttgtaaaagagatgggggagttatggctgcagaaaactggcccttactttgctctgctgacagttttataaggccaaggaagttcaaaaagtaaaaagactttctaagcaattccacagaaattctaagcattttcaggaaacccatttttaactttaaaaaaatattaatacaagattagttgcagtgatttaattagtaaaccatgacagatggttaacatgcagcattttttttttaatgtgaacaaaatcaccagtttttttttcagtttgttttttcttattaatcttgggtaaagattccttgggtcttcaaagataactactcagtctactttttaaatggatagtttgtctgaataattttgttaaagctttagtaaatgaatgttgggagtgtaatttccagagtacaggctgaatgcaatgacccctaacacagcccagatctggtcaccatggactgatggcagagaggatccagatattttggttggattcatgattagagactaaatcagtatgatgcctatgaaaaggtctggtttttaaatatttgccatggagctagagtagaaggcagggtgacagaggcagcggtggctggagtgtaaccagcccatgaatctcaggcaggacaggcttgcatgcttctgtatatttctctaggagagaacactgggcttcaaggctagtctgttctgtcttcaggctctaggaatcttcttgtcaaaccccttcattggaaaaatggggcctagaaagattagatgactttcccaagtgataagctaagaaaataccccgaatgctttaaatccaccttgaggcttcaatgtctatgtgctctataaagtgaatcccatattgtttttctttaaaagattttcagaaatagctgccttttaccctttactcacactaaagttttgaaatactaatgtttctgatttgaagatggaggtgggaagttcatcctctatccccacctcccacccccaatctcttctttgaaatcatccaaagcaaaaggaaaataagaaatggaaaccaaaaaatcaattttcagcaaaactaggaggtattttaaactatgaacaacaaatagatggaaggactgcaaaaagcaggggagcttccaggagaaagaggaaggaagagttcatggctgtggaaatgagactgagtcagcaaaaatacatttgtaaacagagagggcagaggtgaggaataaagtctaagtcacatgtttatgacagaaggaaccagtatacacaccagaacagcaagaactctccaagacccaatttagttgtgaaatgaagaggtgatggagttaaaaaaaaaaaaatcacacatccacatcacatttgcaggaactatctatctcagtggcagagggaaagaagagagacgttgctttttaaaaatccccatagctacctgtctttattgatcagggagaaatagaactaaaacttgcatgcaaaaccctggtttataaagaaaattcctactaggctgggatgaggccctgtaaatatttggcccaaggaaaactcttgtgcctcaaagatgagaaaccaaaaagaacaaacccaagttatttcaaagatatgaaacataaaacaagaaaaaaaaagaccagaaaaagtaaatggcagataaagtgttgccaaagagcagataaaaatagtaaaaagcattttactacaaacataaaatacttaaacaattacctctatgaagtttgggcacaaagtagagagggaagaatcatggaagtcacagaaagacaagtgatgttgtttgagctggcgcactacagggtaggcatgggggaaaatgtaaaccatcaaagaaacaaagatgtgtttgaaggaagatagacaataataatagcacaagagctcagaggttaaaaataagaaaaccaagcaaaatgaaattgatttgggtacaggaaagatttattaaacaggacaaaaaggtgagcaaaatactgattttttaaaacctggtgattgtagagttcaaaaaaacaagcttacttgtaaatattaatgcaaaaatattaaataaaatattaccaaatagactcaaacaattcattaaaagaataatacaatgtgacaaattggggtttattcataatataaagatggttcaatattaagaagtcttaccatattagttatctaagaaagaaataaggtattattaatctccttagatacttaaaagatacttggtagcacttcttcttgtcgccatgtgaagaaggatgtgtttgcttccccttccatcatgattgtaagtttcctgaggcctccctagccctgtggaactgtgagtcaattaaaccccttcctatattaaaaaaaaaaaaaagatacctagtaaaattcaactgccattattgatctcaaaataattcagtgaaataggaatagatgtgtacttccctaatttatacaaaataaaagtcaacattatgtttagtggagaaatatcagtagtgttaccattaaagtcaggagtatgataagaatgttttaaacaaataagagagagaaaatagacatatacaaattgaaaagaagtaaaattatcattacttgcagatcttatatttgcataacccaagagaatcatctgaaaaagattataaaaattataattcagtaaggtagcttaatgtaaaatcaatatataaatatcaaaagcttttatacatttaagcaactgccggatagatgtcatggaagaaaagacccttttacactttcaagaacatcaaaaaagctaaaataaccagaaataaatctaagaaatattccatatgtatatcaggaaactttaatcctgaaagacaacaaagcacagagaaggaattagaggggcttctcgcttagaccaggtgaccaggcaatgtggcattaggaaggcatattgacttcatcaataagatttaggacttctacttattctgtaagaacgcttacagacttcatctgtagagggaattttctcttagttaacatttattgcagagttacatgtgcaaagcactatatgctttgccagtgccatgtcactcatcattgtaacaactttttgaagtaggcactatgatagtttccctcccacagaaaggacttccagggtccaaaggcaagaaatggtttgcacgagccaaggagctgcagaatcaggctgaaaagccatcacactattctttggaaaactcagaaaagaatgaagaagataaataaagtcacccataattcttgttcctaaatatgaccactcttaatattttaatctaaatcagcagctttctaccatttctccaacccggtccatctgagttctgtgactcttttttccttaggaactggggctcactctgaaatgatttttcataggggtatgaaggtgtcatctgaaaagttccacctgtttttcatgtggtctgtccattgtgctgttttagtgtccttctaataaatgacatggtttttcaaagttcacgttgtccatgatcaggtgcgaagaagtttgatttgtatttattattaatggaaagccttcccatactgttgcaaacctactgatttacctgtaccctctctggccagccacttgctttacttttcttaagatgctgaggtattatggtgataggcatacatagtcacctgtattgtcacagtgcatatgtcacctgagaagtgagctaatattaaaatacacacacacataaacacacatacatgcacatacatatacatttttttcttttttgaagagctgggtcaaaatcaattttgattttgccaatcacaaacattttttaaaaagtcataatcacgggggaggagccaagatggccgaataggaacagctccggtctacagctcccagcgtgagcgacgcggaagacagtgatttttgcatttccatctgaggtaccgggtttatctcactagggagtgccagacagtgggcgcaggtcagtgggtgcgcgcaccgtgtgtgagccgaagcagggcgaggcattgcctcactcgggaagcgcaaggggtcagggagttccctttccgagtcaaagaaaggggtgacggacggcacctggaaaatcgggtcactcccacctgaatactgtgcttttccgacgggcttaaaaaacggtgcaccaccagattatatcccgcacctggctcatagggtcctacgcccacagagtctcactgattggtagcacagcagtctgagatcaaactgcaaggtggcagcgaggctgggggacgggcgcccgccattgcccaggcttgcttaggtaaacaaagcagcctggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtgtttctcccagcacgcagctggagatctgagaacgggcagactgcctcctcaagtgggtccctgacccctgacccccgagcagcctaactgggaggcaccccccagcaggggcacactgacacctcacactgcagggtattccaacagacttgcagctgagggtcctgtccgttagaaggaaaactaacaaacagaaaggacatccacaccaaaaacccatctgtacatcaccatcatcaaagaccaaaagtagataaaaccacaaagatggggaaaaaaacagaacagaaaaactggaaactctaaaaagcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcaatcaactggaagaaagggtatcagtgatggaagatgaaatgaatgaaatgaagcaagaagggaagtttagagaaaaaagaataaaaagaaatgagcaaagcctccaagaaatatgggactatgtgaaaagaccaaatctacgtctcattggtgtacctgaaagtgatggggagaatggaaccaagttggaaaacactctgcaggatattatccaggagaacttccccaatctagcaaggcaggccaacactcagattcaggaaatacagagaacaccacaaagatactcctcgagaagagcaactccaagacacatatttgtcagattcaccaaagttgaaatgaaggaaaaaatgttaagggcagccagagagaaaggttgggttacccacaaagggaagcccatcagactaacagcagatctctcagcagaaaccctacaagccagaagagagtgggggccaatattcaacattcttaaagaaaagaattttcaacccagaattgcatatccagccaaactaagcttcataagcgaaggagaagtaaaatactttacagacaagcaaatgctgagagattttgtcaccaccaggcctgccctaaaagagctcctgaaggaagcactaaacatggaaaggaacaaccggtaccagccactgcaaaatcatgccaaaatgtaaagaccatcaagactaggaagaaactgcatcaactaacgagcaaaataaccagctaacatcataatgacaggatcaaattcacacataacaatattaactttaaatgtaaatggactaaatgctccaattgaaagacacaggctggcaaattagataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagataaaaagagacaaaaaaggccattacataatggtaaagggatcaattcaaccagaagagctaactatcctaaatatatatgcacccaatacaggagcaccaagattcataaagcaagtcctgagtgacctacaaagagacttagactcccacacattaataatgggagactttaacaccccactgtcaacattagacaggatcaacgagacagaaagtcaacaaggatacccaggaattgaactcagctctgcaccaagcggacctaatagacatctacagaactctccaccccaattccacagaatatacatttttttcagcaccacaccacacctattccaaaattgaccacatacttggaagtaaagctctcctcagcaaatgtaaaagaacagacattataacaaactatctctcagaccacagtgcaatcaaactagaactcaggattaagaatctcactcaaaactgctcaactacatggaaactgaacaacctgctcctgaataactactgggtacatgacgaaatgaaggcagaaataaagatgttctttgaaaccaacgagaacaaagacacaacgtaccagaatctctgggacacattcaaagcagtgtgtagagggaaatttatagcactaaatgcccacaagagaaagcaggaaagatccaaaattgacaccctaatatcacaatgaaaagaactagaaaagcaagagcaaacacattcaaaagctagcagaaggcaagaaataactaaaatcagagcagaactgaaggaaatagagacacaaaaaacccttcaaaaaattaatgagtccaggagctggttttttgaaaggatcaacaaaattgatagactgctagcaagactaataaagaaaaaaagagagaagaatcaaatagatgcaataaaaaatgataaaggggatatcaccaccgatcccacagaaatacaaactaccatcagagaatactacaaacacctctacacaaataaactggaaaatctagaagaaatggataaattcctcgacacatacactctcccaagactaaaccaggaagaagttgaatctctgaatagaccaataacaggatctgaaattgaagcaataatcaataggttaccaactaaaaagagtccaggaccagatggattcacagccgaattctaccagaggtacaaggaggaactggtaccattccttctgaaactattccaatcaatagaaaaagagggaatcctccctaactctttttatgaggccagcatcattctgataccaaagccaggcagagacacaacaaaaaaagagaattttagaccaatatccttgatgaacattgatgcaaaaatcctcaataaaatactggcaaaatgaatccagcagcacatcaaaaagcttattcaccatgttcaccatgatcaagtgggcttcatccctgggatgcaaggctggttcaatatacacaaatcaataaatgtaatccagcatacaaacaaagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattctatatctagaaaaccccattgtctcagcccaaaatctccttaagctgataagcaacttcagcaaagtctcaggatacaaaatcaatgtacaaaaatcacaagcatccttatataccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagcccacatcgccaagtcaatcctaagccaaaagaacaaagctgggggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagcttacaccttatacaaaaatcaattcaagatggattaaagacttaaacattagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaagagaaactaccaccagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcaaaggacatgaacagacacttcgcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaatatcatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgatattggaaatcatcattgtcagtaaactatcacaagaacaaaaaaccaaacactgcatattctcactcataggtgggaattgaacaatgagatcacatggacacaggaaggggaatatcacactctggggactgttgtggggtgggaggaggggggagggatagcatcgggagatatacctaatgctagatgacgagttagtgggtgcagtgcaccagcatggcacatgtatacatatgtaacctgcacaatgtgcacatgtaccctagaacttaaagtataataaaaaaaagtcataatcacaagattattttaatcagagaaaattattaaaattttatttcctaaaataagttgatggccaaaagcttttgaatggctttctaaatgattttctctacttgggaagttaaactgactaatgattgtgtgtctgtttctgatgttcattaatcacaggtaaattagtagacacctcaggttctgtttaattaataaatcatctctgcaattgtgcatcttgaacttcaaaatagcacttgttgaatctggggaagcattcaagattcctctgtaaatgaatcttactttttgtttaatgcttaatttaaaatactttttgatatgtaaaaaacttgtcatgaagatgttaaccaaatttatttgtggaaagctattatgtgaaaataattgattatggacattaaccaattgtatgacatcagctatgacatgtattttgagggccgttgacctcgatttttgttcttgagattttttgtgtgtgtgtgtgtgacgaagttttgctcgtcacccaggctggagtgcaatgatgcgatctcggctcaccgcaacctccacctccagggttcaagcgattctcctgcctcagactcccgggtagctgggattacaggcatgtgccaccacgcccggctaattttttgtatttttagtagagacggggtttctccatgttggtcaggctggtctcaaactcccaacttcaggtgatctgcccgcctcggcctcccaaagtgctgggattacaggcgtgagccaccgcgcccatcctcttcagattttttaatgctggccttgaattggttttcccgttttcttctctctgttttgattcccttcattctttagtgtttggtctctgtggaacaagagttgttcattctgactatcccagaccttgcatcagccctcccatggcttgatgttcctgttgttttcttgagctctcgagtgatccgttcttgagtgagctatgactttgtctctttcgtgcttttccctagtatttgaatccttttaattaaggtgtttattggaaaggatactttaatagtactttttgtttttgtaacgcaagtttattatgctaatgctttcaaaccaatgtgttcaatagagatgaaaaaagaaaactaattcctccataagcatgtttatttttttttcctcacctaagacaaagctaatgctctaaaaggttgtgagtctccttacttatgtctttacccttggacaaggtaaaacaagttataatggagggtgttgtgggtgtgactgatgtttattagtccctagcaaattagtagatgttttgtctcctgatacctctggctttgattcatgtttgctcactacagaggggcctcatggactttcaggatggcactcattcatcggagaaagcattggagattagtacataaatctgttgtatttattttatcatttgtttggtttaaaacatacttttcctgagggataaaacgtcctcccttttttctgtgttctaattggcatcagcttccgtgtatttcaaggcagctgcttagtgaggaagcgcagggggcgctgaagtccaaacacaccctcgcctgctccctgactcctccacaatagaagagagcaatgaccagtagttggaggcactttacttttttataaaataaactaatgtaaacccagctttggacacattgaataatgaccctttttcaggctccaaatgaactgtctgtttaaacagctggatatgtcagggaaaaaaatcaagttttaacttttattagatctctcctgtttagttcacaccaactatatgtgtctgtcatgatgagagtgctttatacagggtgtgagtgagtagttacctttcttcctgctggaacattggagaggaccggggcccagtggctgagagctaaggtcagagttaggcagagctaggtctgaaggccacttcttccacttagccccaagcctcagtttcccctctgtgaaacaaggataataatactatatacgtcacactcacgggactataagaggccacctatggagaataattagctgggtgcttgatgcaaaacaagcatcaaccaacaatagccacaatgatatagttaccatgtttttcagtttgagttcccaggtggataccactgatattagataacactgatattacacaccactggtatctgtagataccactgtggttagctaacagtgaatgtagacacgacagtgcttcatcaggtagacatcagacttggaacatgcctccatctttctccaaccagaacccctgcgagggggaaacagagcaagttaaaatactgcaaagctttgcatttagaaaccggaaaacagatgcacagagcagtctgcctctgtgtaaatgcacattgtaatcagttttctaacgctgcctttacaaggatgagttaagtggttcgttgacatatcattatcacattctgaagataaacagccacaggatctatgaactctcatcaggcagttaattattcttgaatttttctgcactcttgaaacatattctatttatttaaccgtcccctgggagccctggtcgcctttgtccctgccacacggccagtggtgtaaaacctctgcatctgtcagatttctccatgtggagcgtaattgcctgatttccatttgaaagtacagccctgacattaaaatgacatagacccaccaatgataacaatggcttcctgacacctaccagaggagagggggcgagggggcataatgcaggaataaataagtgcatgaatgaacgctcgccttcacggggccaggtctgaatttacagctgcagatgaagtgttccttgggagcaaacaaaaagaaagaatgaaagaataaaagaaaaagaaaccaatagattagcatccgcgtgagtctgttggagccagatggctctctgtggagagcgagctggcctgctttctcccagtaaccctgaccagcagacagcaagcccgctacacggggagagaaatgatctcattcctcagccgggcacgtgagccgccttctttctctcacacacaactcgagctgaaggggagttggaaaagagagaaagggtgaaaaagaaagggcgggggagaacgggtgattgtaaagaacaagcaggtcctcgtagcccagaggaagagtgagactccaggccttggccagccctgagcgtccaagaactgtctccagatgtccacgaaggagaagacagggagacagaggggacacccgacacattgttgtctcctccacacacatccgtgaacttcacctccacgatccaatgttgcctggaaggcttgatgtggagaggctgagaggaggggcgcaggctgctgtagaggccatgggattaagttctgtgccccactggaaaggggcagtgaacaatgttttcaattcttcctaatgacaatgtctgcctgtctctgtgggccacaggcgaatgagtctgtcagtcctcagcctgcaggaccagccatctgctgggatcctggtctgccatgctcctgaacaggtgcctgagatggaggcagctggagtaagggggcagtcaaatgaaactgacaggttgtaggtgtgggagggctcctatccttgaagattctgaggctgagaggggcttggtctggggtcattctgcctgctctgctgagcaaagcattcactgcttgtaaacaagtctgttgtctggagtgacagccacacgtgggggttggtggacatcagacagaccaccagatgctggtgttagagcctagcacttgcagatgtgtgcagaggtgcaggcctccttcaagtgaatctgccctcttagtgagtgttcacacacccagcttggtaccagggctcctgaggcctccaacccagagaagcagactaagagagaatgaaggtgcccgtgcgagtgagtgctgggggctcacagagcacttcatcagcctggctaggttgcttgggcacctgaagcttgtctccagcagtgtttactcaaaagaataaatagtttccagggtgacaccaaatgcggggagatgtagtcattcctttaaagctggaaactattattttactcctaataaatattgagcaaaattctcttcattttcagcccaggatgagagcacctgcttcacaattcctggcagttgtcggtacaaatgaacattaagctggcatattctatcagggccaaggaagcaaagcaagctgccagctgggggctaaaaccacaggctctggcttttcttctttctaaaaatgaaacagaaagccaccaccccaccaactgttttgctctttatctcccaggcaatgctaccacataacagggttcctcgttctgtatgggattctcactcacagcagagctaaggatttcaaaggaaaccgtatcactaaagtaacaagagcgtgagctccaacatcgttccttgcctccacttaagcagggagatcagtcactcaataggagcatttaagaaaattttaaaatgctagcatttaaggagcacttaccaaagtgtcggccctgcctctaagcgttttgtggacatctcaggtaatcttcatgacaaccctatgcagcaggttctctgattacccttattttacaaataggatgccaagtcccagagatgttaagcaactttgccaaagttgcacagctagtcccgggtccataccaccaggctttcccacctcttttgatggtgtaataactgagctttaggctccctattttggctgctcaccagtggtgccatcttgggctactaagtctccctgagttcccatttccttgtctgtcaagtaaggactggaatagtggtcttatagggttgctgtcaggagcagaagtaatgtgtaacatacatgcatgcagggccagtgcccggcacatgtttgaggctccataaatgttagtacagatggtcccctgatggtttgatttaacagtttttcaactctacagtgggtttgttgggaagtaatcctgtcgtgtgtcaaggagcatctgagttaagctagtttgatttacagtttcaactttaccatgggtttatcaggatataaacattttatcaggatataaacctgatgcatttttgtattttcagcttacaatgggtttatctggacagaaccctcatcgtaagtggaggagcatctgtggttattactactgtaagcattgtcattatctttgtgctcttagatttcactgaattctcacacgcacacatgcacacataaaactatgaggtaggtggggcagctgtcactaaccccattttatagctggtgtatcaggtggtaaagcttgggcaagaacccccatctcttgactctgcactttgtctaatctgagcttgctgtttcccgctggactgcaggtcacacctgtccatttctagacaccaaacacagttgctgtctagaaagattgcagcaaggaattcaacccttgtcactttccctttgtctccaggccctgggattggctgaagacagagccaggtcctgcctgtgccctcctgggaattgctgagacagttaatgcctcttgggacaagtaaggtactagcttaaatggatcacaagctcctgtgtgcccttaagattttcgttaatgtctaggtcaaaaaaaatacttattttcttatcatcacgaaatgcagatgcatagccccatctcatgcctcgcttctcctagttgggatagcctctgagaacatttccaacactcttctttgcagaaggtattctgcacctacagctggaagcaggagacgaaccggccaaaggtgtcttggctgtgctctgccttctttccttagctttcctaactctgcctttccggtgattttcatgttttccctttcattttacattcagaaaatctctggggaatgcagcttttgttctgttgcttcacgtaattcccagggcagggaatgaaaattatttgctttcacaacttctggctgagtgcctttcacagcctggctgtgttctggggtgatttataaactgcagagcctgggtctctttcctcctccttttcctcctcctcctcccccccctccccctccccctccgccttcccctcctcctccctttctccttcccaccaccctttaaaacaaggtgagcctccagagtcagggtgtcagccactggggctcttgttcaggcaaaggttcagtggaaccatagtgatgagagcttgaagccattcattcctgttagaagaagacagaaataggcctcaaggccgaacttacgtctctgagaacaaatttgacccaaaatctcaaagtttagggttggctttgaactaagaatataaaagcacattttccaaacttgtcaggattgtgtttcatttctagacttttattctcaaagggatgatgaggaagagacacggcttaagaagttttgagctgagaaatgaaaagaagtcacttttctttgctgccacagaactaagtagggggaaaattaagcccaggggttcatttaacctgttacaacaaaacacagaaaccagacggcaaagtgtcatttgcaaggtgatgtgtctttgtcggagctgaaggctgtcgccggtcggctgtctccatggagtccccatctggccctgcactccccacagggatgatttcatcaggagctgaaagaacacagaggggtgagcaagtgatcgagcctcagactgtctgtctgggccagaccctggggaacacgtgtggacactacgggcctccttttctactcagtgtgatcctggacaggaagaattcttcacagccaaggccaaacagcccggacagaccactgccttgtggctatatgagttctttgaactgccctgtgccatctttttggtcatacccacatctttgcttctgcataactcacacaatagcaccaagtctccttgtcttctggcctgtggctgtctgtgacttctgagcagcagacacggaggctgaaggtcagagccagcattgccactacttgacctgtaaccctggatgagttactgaagctctctgggcctcagttttcctcatatgaaaaatggagaaataacacctgccttccagggttgttatgatcattaaactagatgatttataccaagtgagtcacgcaatgccccatagagcacaaactcaaagatgccaattagtatttctaagcatgggagggagccctgggagaaggccctggagaaaaaccgcctccgggactgtgagccaaggcaagagagagagtgggatcagagaaggaatgggatagaggccgggtggaggacactgaatctatctcctcccgcgttccctgcagtttcatttggaagggcagcgtctgagattttaaagtcatatatcattgccatttccttttttaaaaatataaatcattgtcccagagatattcaagttcagaaaggcgcatgtattaggtctgaggctcacgtacatctagtattatagaaagcgggaaatcaagaggggctcctgtcttcggccttctcttcccaaaataatggatgacttttttttttcactattagaggctgttagcactcagacttcatcctgaacctggattagtgatcggttttgttttaagatcctaagagcacaaacaatgagacagaaacaggctccattcgctaatgcactgctcattgaggaatgtcagtgatgacatacatgtggaaaatttggggctaccagacctctccccagtctcatctcagtctcaggcccagaatgaggtgaaaattggagagagggccctggagcagagaaagggggattcctgggacatgtagggccatgtcactgaggcaacttccagcaatgatttacaggaagcgtttagctcatgcatatattggggccaatctgaaaaggaatcaaggttcatgaaactctcaactgtgacattttatagggtatggcgcaaccagagttagctaagtacagatatcattagctatatgttcatttgattgctattacatattctctctctctgacacacacatacacacacacacacacacgcacacacacacgactgaattatattcagcagtattttatgctctttggaaactgttacttattcagatacaggatgttttgtttttgctttttgctgattctctactaattttattattcccaatactctctttcattttgaattatggagtttattgcagtattgtattttttgagatgtaaaaactattataattagaactaaatttttcaaaaatggaaacatgcaggttaaatgataaaaatagtgtatttgtgaaatttgggttccgttttgttttgtcatcatagcaaatagagaaaaaatgagttgattacagatggaagtgtaatttttttctgttgagaagacctggtcatctgcctccacatccatcaccacccaacagcactacaaagagcagctgaactctcccccaatactcctctgtgccccagtttctccagatgtaaaacaacaccacacaacacatctgtctccccctcaactcaaagaaatgttataagaatctttgagagaaaaaaatatccacaaaagtgttgtgatcccagaacttatttgttttgtatgtttgtaattgtatgaaaagtggaggtcactctagtgaaaatgaaaactgagctggaaagggctggaattgctaaaatgagcagaaatacggtaaaggaaaccattccctgtacccagcagctgtcaggctgtgttcatgatctgctcttgcttcctgagagcaccatgatttctttgtaaccaaaaggaataatctattttctggcctaacctctcataaggtattttggagtaagctcaacactaggaaacaatattttacagatatcttcgtctcctctttattcaacactctaattttttccccttgcaatttctcttctcagaaatgtagcttttcagcgttgattcatctctcctgcctcatagcacatttttctctcttctagcctgaccatttttcatttctctcacttgtatcttaactggatcttccatctcctccacttctactcctatttcctttaaattcattttcttctttcccttttctctccctaaagagtgaacagagaacagacagaaaggacaatcagctaggactgtgctgagaaaatgaactgaaacagcacagtgaaagttggacaagccaaacctgactccatcaatttgggttgatgcctctgacaattcaaacaagacttggtcagcgcagaactgcaaggctgtcttggaattttcacacatatatgtttgacattctactccaattcagttccacaatccagatgctggaagaattttgtttacttgagatggattctcgtccatcatctttcgctcccacaaaaccattgttcacaacccccaaggactgcctatgagtaccatcattttgttacagttaatgctcattgttgtgcacagttgggaaatgtagccttctggttaattacattttccaattaatagaaattacaaggtacatcttccatgtgttgctgacatctagacacctgggatactctaagcaccaaagctaacttgaacaagtttagtctttcttggaaaatttagaggaaacttcaggactcatggaacatcaagggtaccaaagtgtgttgtagatgtgggtagtataagataattgggattttcatttggtacaatgtaaaagtggtttgggggtatgtaatagcacaagtcacatgggaaataagggtaccatgtgaagcacattatatctttttaaaattatcctcctcagtattattaagtgtttaaatgttcaaaggaaagaaattcatgccctgccagattacaaaacagtatatacatgacaattccatttttgtaagaaaaagcatgtctgtatacacatatacacagcctcccatataaaagtcagggaagatatgacccatattttaatagtagtctctctgaatgatgtaattataggtgctttggttttcttcttttggtttatccatacttattaaaaattaaatatttcttctataatacaaataaacaaatagtctttaattggaaaaatcacatagctcagtattaaaatcagcacagaaatctatctcaatgtagatcaagaacagattaaatgaaaagaatggttgcagaagaaatcttcccatttggaaaacacctatcatgtgagattgtcaaacacaaacttggaggctggggagttgggggtggtagtggctgcagcgatagcagcatggaatgtgaggaaatgctgttgccttggggaatagaggtgggatgtggatcatcacctgttatcacaggcaggctctatgaatcatacacgatatgatatggggttacaagaaggattcttacaattgccattaagataatcacttcatagcatttctgcatctgtttctaaccttctaaacagaataagatatggaagaccacatcttggtttcaacactgattctccacgactggggtggagggtttggcctgagcctgaaatcaggcactcagtcttctccagggccctgcaccaccacggcttcaccccattcaccgcttcaccccattcaccgcttcaccccatcctggtccttgacagcacagggcttgtgccaccgtcccacctctctccccaccctggactggcctttgctctgtgtggtctccacttgtgcagagccctgtaccgctcccacttgcttccatctcagttttcccagcgttcaccctcatcctagaggaagagcaggggatgtgtgaacagacaaaagagacacaaattccaaaaatgaaattttaggggaaattctaccagtgagtgtatacttctaccctagcgatacaaagagtgcagtggcatttccaggatgagggaaggggtggctgttctaggatcacactgcctggttgcctctttccatccatgaacaaaagaggccatgccgtgcaggaaataaattcccagcttccagaagtccccacattttccagagaccagagcagatccttgcctattcttgtttctgctgttgcatgcaccttgtctaagaggttttccaaatcccagtgtgtgtttcagcatcacttgtgcacactgtcatgctggagcgccctgcacaaggctgggagcctgacttcccatgtggattcctctgtcccatttgtctgaagctcttcgcacacaacagatcgtatttaaaaaaaaaaaaacaaacctctgcagtacctcttacagttttgtgttaagacccatatatttgttaagcgaatgaatgcccaagtgactcagcagtccgcacacctgacactctgctgttttcaggtgctacatactatctcatctatttctcaaagcaaccctgtgaagaaggcccgccattacccctgccttcaggatgagaaaaatgtcttgaagaggacttgcccgaagtaacacacaggtcgctgactgccaggacctggaattctgatttcagtctattgccctttccatcacgatggtgatccccaagccagttggctcatcagaatcccctataaagttggttaacgaaccagtcacagccctactgcagacttgccaaatccctctcaggtgaggctcagccgtctatactatgaacaggttgttccacagatggtctggctgccctcccacccatgccgcctgtgctgaccagctctgatttgacatctggtcgatgctatcaagggtgtcaacacaaaacttcaaggctagccctgacactgaaaatcctatgttcctccattagtcacctccttgtgtgtgaagagttcatttatacctcccaggatcctccttctgtaggagctaggttaacggctcaacttctagaaaacccaaggttaaaaatagctgtgacactcattagccccaagggggaaaggtcagcaaagtttgacagccacacttaggaaggactgagagaggctgcagaaagggctcggagctgagaacagggacccagccttccttagaagcctggctccaaaccagctgggccccccctaattggccacgtctgggaaaggtgctcgtatagtcacgactctgtaaagcaaggggcaagggccctggtaattaagtgaccacaaacccatccaataattactcatcagggagactgcaaatggtggaaaagttcttcctgtttggaagagtgagtgaaatttggagggaatcagcaacccaacccctccagcagcagaccgctaaagtctaacctcatcaggagagagaccctcaccactcaagttctccagaggaacaattaggagttgcttgagaagtcccccaagctgacttaacctgccatgaacccagcaagcagacgccctctgactgtgatttataaggaaggggtcgcctccagagaggggcctgggctgcttgcctaagtgctgtgtgcaggtcagcctggaaaccattattgtcatcaacaggaggatcagttaggagacaagttgaagcaagttgaaatttgaaaaacacattaacagcggcctgacgagatgccagaagagtctgccagcagggacagctggaaggccaatttctgagtcaatactgaaaggtggttgcttaaatatctgagtcaacacacactgatttctctccggctcaatactcccgtttaattgcactagggagtctctccactgacaaatctaacaccaagatatatagttaagtgaaagaaaagcatgttattgaagtgcaaatgaggtcctccatgcagcctgcaggcctgggtcccgctgagcgctccctactgccctggcagaaggtggttgggccttgcagggactccctgtggccccctttttaaagagggtcgagatacgcgtgagccccaggcctcagctggccagcagagagaagtctaggtgcgctgcagctgcacaggctaccaagactctgagatactttgtcaggatccacggtcctctccggggagagggggccaggagtgcccgtttcccacccaagagggccaagtcagatggaatggtgtgccactgaagagccatcatgtttggcagccaggtgaccacctggtgagattggtggcagagatgatgaacgaagcaagtcttgaacgtccacccagctgcctggagcctgagaagcaggttggtctctgaggagtcctgacaggtcatggctactgatgcagacacttccccatcgcgatgcccacataggggccgggcaggatggcccaggggtagtgacgaggctgggggctcccacagtgaccctctggcagccttcactgacttcagagctaagcatgatataggagacctagctagacctgaaaacccatgagaaccgggacccgaaccacagtgaagaggcagctcccatgagcaggtggcatgagtcctccactgctaaattctatgtctgctgccaactgtcaaagatgaggaagaagcccatgtcagtggtaaacccaaactcaaattactggggcacattgtgaaagggcagtttctggttcagtacgtctcggtgtgggtagctttgggtccagtggcactcctggtgcacaccagtctgtcatgaacccacagtgtgggagtgcttcctcattaatacacctgctaatcacaccgaacaatcagagatctgttcagatggggcccagaggatctgagagacaaatggctgggccattgtcaacccaagcagttcaagtgcagtggccaccacttagggaaactatggaattgtcttggtctgatgctcaaaatgaactcacacggacgtgatctgccctagacaaacaagtctgaaatgaagatcaaatgctatttcttccacttactagttgtgggaccttatataactgttgtgtaaataagataatgtgggtaaaatgcctggcacaaagtagttgccaaaaaaatgccagttcaccgctcgagtttccccccaaaactgaggtggcctcaatttttccttctctagttcagtgttgctttttgtccaggaaagccacagttagaagaggtgctgtgaaatttctatctctcacctctaagcaagacatccagccctgctggtccctgtggcaggacctccccatctcccacgcagcagaagtttgaaaaattaatttactcatcttcctggagcataaagagttttttagaccttcccttctgaactgtttatggaaccgccatttaggaattcaaatggcagagccgttctccctctgaaggtctccgggagccccagcgcctcctcacctaccccttatttcatgctcatgcttttttgcacgttgataagcagtctcaaggccaagactgtcccaggccccgacacacctgtctgatttcatccctatgtctcccttcctcttgcagccctttccaggcacactggtcttcttgtctcctgtgaacttgccaaggctgtttctgccttgggcacagcgctgcctggaagcccctacccaggtagccacatggggtttcttccttcatccaagtctcagctgaaatgctgctccctctcagaagacttcactggccctctactgagttttatttttttcttaacattcatcactaccccaatgatcttatttgtttagttacatgttaattgtctgtttccctctactaaaccacaagctgcccaaaggcaggaatctcatgtgtttagttcagtgagcattgcagatcccaggacagtgactagatgctttgtccattcctgcagcagcaacagttttccaaggaacactatcaaatggacctatgagtgttataattctatcctgtaatacgttggacaactattcagggttttgggcactgccagaaacatgcaactccaggaaggagaggagtggggacgggagggaaatgcctccaggcaatggcaaaaactttgctttgagcttctcatgtcccagaatgcaaatgtccatctgaccccaggatcagagtgagagaagttttgctctgtctcctctcacctgaaatgaacaggaggctgctattcattccctcaacctcaggttctaggatcaagctagagggaagcctttgggcatcagggcagtgccaatgccaagggctcaagcaacactcaactttagagatattgtctaataaagataacgagagctagactttttatatggattattaagctgttctaactcatcacatggatcatttcatttgtcttaagaaattgtctcagtgaccagagatggtttttagaaaatgcatgagatgtgatcccctctatactgtggccgtgccgcttttaactccacacggatcacctagcatgagggttctagaaaaagatgggggagctgctgctacaggggttcatgttgtccacccatccctggttcttcattattcctttgtgactccatactcaaaaaccaagccttgtcagtcctgagaatggctctggctctgagggagctgaatgactgccaaggccgtccagaataagcatgaattaagcaaaccctcctgtccctacgaccctcaggacaaagtggagaagagagtaactgggctactctgcggaagtgtcaatgccctgaggtctctgtaaagcaccagatagtgcaggaagaggaagtctcagctctccttagcaagacaaggcaagctactgagggccacgctgtccagagaaactttgttttgtggatgcacagaaagtaatacgtttttctggtattagagattcttttggaagcgagtatagatggccctgccggaatgagagcccttgggacacctgggataggggtgctcaaaacaacagtttattcaaaatacagcaagcaagtcagtagcgtcctgccccgggacaccaaactccacctgtgctatcccttcccggctctttctcactgcctatgaagtgacctctgaagtgtccgattgtctttatgagcaatgcaaggctggaagtattttagaccaggcctgctgcactcaccgtctgcatctgctgcgtttctgtcggggatcagctgctgactgtcggcatagctcatgacggcagcagttctcctgtcttcatttccctgagcacttgcttctgcaaaaaaccgtgagaggaaggaaaagtgaggacggttgcatgagtgggcttcatggctgccgaagtgggagactttttttggatgcctctgaacatcggctgcccctggcaggtttcccacaggtgcccatcatgtgaaggactggatggaagttccagctgttggatgtcgtggtagggaggctgaaggacatttaacgtgtttcatgtactcattacctagaacgaggaaatgcactgtcttgagaacgaagtggaggagaggaggctcatttgaggaagagctctcctggacactatcctttcttgtttctgtcaccttctgggtctttttgtgctagggtggagtggggcacaagaaagaccctgcagggccctttcttctgcattgctttggtcttagacatagttcttaatgctgactgcacactagaatcactgaagtgccctcgctgctgctcctccctaagtaacccccccaaaaaagtcgtgtgtgtcccatgggagataatctgagggaatagacccatgtgaaaagagtatcagtgaacataacagtgtttccatgcccctcccccatcactgtctttgagaggctctatcttgcctcatggagatgtcagtggtcactgggagaaaacaccctggaccccggaagttaatggggttccttaggaagcagtatctgcatgaggtctcccctgagagttcctggccttcctgctagagcccccatgctgcagatgaaggcaggcagggagagacagactcaccctcccccagagcctggtggctgaggctcacagcaggaaatccaaggctgctggggaaagggagaggggactgggaaatgcacagaagcatgaaaagggttgggatccttccttcctgggaccacatatatgtttgtgcagttttctctacatggaggcacctggccaaggggttcagggtgaggactgacctcagtccacacagaggttgccattttcctctatgataagccatgtctgggggctgtcgaccccatagcccacaaaggggtccttgttcttaatttgcacagagacactgactggggcctcgggggatgggggctgctatcccctgccctcctttcacacctaccctccctcctctttctcaggctccattctgagggctcccagttgaggcacccttcctcactttctactcagggttgcttttccctagctcagaactgaaagtgggtttgattctactgactcagaccttgctccggaatactgtttctctaagaagtgtgggaaccctcagtgaacgagtgggagagagcagtgtggggttacagccaggcacagctgagacccatctgccctgtcctgtgccaaagcctccagccctgccttcccctctccaatgatcacgtgatatgatgccccctccccactttactttgttcatttcttgacaacgaagaagagaaaagggggggatgtttgtttgccttctctctagaaaccctctgtactgtggggctggcatgatggtgggtgggagggagtgggagatagcagtggatgaggtgcccagagcctggaaattctggggctaaaacctctaatgaggactgctcctcgtccttattaccaaagttatttcttgttttttatttagatatttgtatctcagtgtctacaacagtaaaatgtggcctaaaccaactatagctcacagggatactacagtgagctgatattagaatgaaagcattatgacaacaattttaaaaattcttcaaataatccatcttttctttgggatagccccacttttaaaaatagtcatcataatccacatgtcccaaagagacatactgcgtgtaatagctgtgtaaataaggaacctctggactttgagattccccttgtgggcctctggagtggctaaagattagctcctgtcagaaggaattcattcccttcttggaggttcagaaaggcttgcctcctattaccaggtttccccttcaggtcagcacttctgtcttagccaggctgtggctaagggaccctgagtgtgtgggactgatcagccttgcagctgatggagagctcgccattggattccagcttctttttgggggtaccatgagccaaacagtaatccctggtccagcttagtactgggtttttttaccctaaactcccaccctcttgtcattcctggagctgggtgagtcacaaattttgtccctcatcccagttttggaagctagaacaaaatgtgaaaaaggttccagcacgcgagggaagcctgtgctggagcctctgaggctgtggagcagaggaagcactcacaaatcattccccagctaccagagagctgcatgggaaacgcccagagaagaaccttgaagactaatgtatgtagaactcttcagctggatctatcggcccagctcaaagaacgtcataataaccaggatgcaagagaagagtgttcagggcaagatggttgaactgagccctggagcttggtggtgggcaaggatgctttctgtgttgaccctgcaaataataaacatatctgaagtggttagtggaaaaactactcaacactaatgacaaagcttctcttttttgcttacccttgtgatcaactggggttttagatctccccatgatctcatcctctgtggcattcaagttctggatcaaaaagtatgtggtcattctccctttacctttcacttcaatttcacccctctcaatgattttaaacccttgatttttcaaggctctgcacagagaaaaaaagtgcatcagatatcaaagattgtgggtctgtaactcaagagttggctacaatgcaaagggctactcaagaggaaaagtccaggacacaggacacacaacagcaggggagggaagatcccagacatctgcctgctgaagcaggacagaggccgtggggaaagtgaggatgagatattctgaacaggatgccaaaggccaaaagagaacacagggacccatcaaaaccctcccaaccctgccaccaattttcctccctccagctcaaccctcatatgggcatctctcacgtttctacacaccatgctgtcagtgcccatgtggacaccacctttcatgtttctgccacgtaagactcttgggtatcaacactcttctttccatcttccccaagtgcaccatataccccatgcttgctactatgctcatcctaactacccaagctttctccaccacaatttctgtctgccaaggaactgaagaggaggactatagggaagggaccatgaaaagagacagagctatggggtaattacaaaacgtttccctgtttatttatttactagccaccaagtgatgttagagaaaagccaaagaaccactcagaccaatgaggattcaaattcatgaccacctgcctcggcactccatcgagccttcccttgcccttggccaggttggtagagagttcagaccttcaccacagtcctcatgggcctccatttggcatctgctcccctcactcatacgctggtggctgtgcctcctactttatgccctgattcatctacaaaattacattgattacaggtgagagcctgtgacttctcaccccatgaccacaccatcctgtcccccaatctccgaggatgaggtatatttcttgtccagggtctcctcaccctcacccccttcccaccacctctgggccttgctccattggccaccccacgcttatcttcatctcccattccatttgcctttctccttctgcttttcagtgtgcttatgtctcttccatcctaaacagaaacaaacaaaacagcctctcacctgctttaatctcatgcaaactttctcctctttttattcttcagcccaacgtctatcccaccattctactacaaccacttttgagaatgtccccaaaacctctagtgagtatttttcagtccttattactacatttgacatttttgttcaattcttccttcctaaagtcatccacaagagtgcttctcaccctcaactctcctggtcctttctgagtatttcttctcctgtctcttccctgggctcctcttccttctgtgccacttaaatattggttctgcacaggattccattcttttcccactgttctttgcacactgcatccttccctgggttgatctcatcaactctcatgactgttattaccacctatatgttgcttactccaagtctggatcttcaataactcaactccatccattttatggcacctctagctgaatgttccacagttcctttgaacccagcgtgtccaacctaaactcattgtctgcccctatgatctgggatacttctcatttgtcccattgcagatggccaggccaccattcaagccctagtcacccagaatggagacccgggctccccccttcttctcatcccccatttctaactactttagctggttttattttcccccatattcccaccactaatgttctgattcagaccaaactcctaacaggtctcatctgtctcattttctggttctcaaatatgccctttcagggtctctagagtggtcagtgtcaaataggaccctgaccctgtcactgtcttcaacctcacattcgttgggggcttttcctcacctacggcatagggctcttgcccttcagtaaggcatgtgcagctctcactgctcctgcctcatattttccaatacagaaaacctcgggtgtttatagttctctgcacctattctacatgtgagcctctacccactttttactcccaataccccaattttggctaaattttactctggaactccttgctcaagattcagctcaggaatctcctccatgaagcccttttttactgggtcaagcacccttgccctgggctctcatgacacccccggtgactaccttgaggataagagtgcagcagttaaaggggggacactgaactctgactccgtgggctgcatctgggctattctccttcctagcctacctggtcctgaggcaaatgattaacctttttgtgccttttctttcatgtaaataataataataatgtatcttcacagagctgttgcaactgtaaatgaattaacatataaaagaatttagaatagaatgtggcctattttaagtgctcaagaaactataagtattgttttatgcacatatttgtcattgtacttatctcactttaaaaataatcaactacaacttttcttttttcttctgctagaccaaaggtcagcacgctttttatataaataaagaccagatagtaaatattttagactttgtgtatcatatggtctttgttgcagtgattcaactctgcctttgtagcatgacatcagccatagactatatgtaaatgaaagtgcatggctgtgttccaataaaactttatttacaaaaatgagcagcagactagatttggtctgtggggttatactttgctgttccctgaactaaactatatgctccttgacagtaaaaactatgctacagttagaagctcaactaaatttattatctgccacaatatcttctgtaagccattgagacatggaaggaaaaacatgagtttcctgcactaccccaacccatggctgctaggcactctgtaagttctagaaagaggaagggacaaaggaaggcatgaataaatggaaggctacctgtaggctgtgggactgaggtgcactttgttgggaagcccatgactttccatcctagaagctgtgttcacagtgtcaccaaacaagcagtaccgtggcatcttgtctcctacaacatctgctaagactggtccagtatggatccccactctgagctgtacagagacagcatcactgaaaagagaccatctaatactcttgattttatttgtaagttgagatataatttacataaaataaaaaaagatattaaagtgtttggctccatgagttttgacaagtgcttatatccctgtaaccaccacccaaaataaaatgtaaactagttccattaccttgcaaaattatcttgtgccccttctagttaagctctctccccatcttcttcagcagagataactacattctcatttcttctttttttttttttttttttttttgagatggagtttcactcttgttgcccaggctggagtgcagtgtgatctcagctcactgcaacctccgcctcctgggttcaagcgattctcctgcctcagcctccagagtagctgagattacaggtgcccccccgccaccacacccgactaatttttgtatttttattagagacagggtttcaccatgttggccagctggccaagctggtctcgaactccggaactcaggcgatccacctgcctcagcctcccaaagtgctgggataataggcatgagccactgcgcctggccttttttatttcttttaccaaagaatgatttgcctgttccagaacatcacatatgtacaatcttatagtatatactgttttatatctggtttcatttactcaacataatgtttttgagattcatctatattgtcttacatatcagtagttatttttatcactgaatagcattctattgttagaatacaccacattcattatccagtctccttttcatgaacatttagattatttttcagtttgaatctattaaaattaaggctgctataaacattcctgtacagatatttttgtagacatgttttcctttctcttaagtaaatacctagaagtggaatttctgagtcccaaggtagatacagatttaattttattttttaacaaaacaagccaaaaaactacccagcaattctccaaagttgttttactgttttacatttctatcagcgacgtgacactttcagttgttcccattttcaccatcatttggtcttctcgtgggtgtgaaatgatatctcactgtggttttaatttgcgttaaattggtgactaatgatgttaggcacactgtcacacacacattggccattcatatattttcttttgtaaaaaagtctgttcaattttttgcctgttttaaaaattgagctgtttgtcttttattgttaatgtgtatgaattgtacacatatttggatatgtaatatgtatgtattacaaatatttttatcagtctgtgggtttgtgtatttattttctttaataagcagaatgttttaattttgatgaatgtattcatctgcttaggctgccatagcaaaataccacaggctgtgtagcttaaacaatggaaattatttctcacaattctggagcctggaaggccaagatcaagctgtgggcagggttggtttctcctgaggcctctctgcttggcttgtagatgtccacctttttgctgtgtcctcacgtggtccttcctctgtgcacatgcattcttagtgtctctttacgtccaaatttcatatttttataaggacatcaggcacgttggatgagggcttactcttaaggtttcattttactcagtaaagcctctagctccaaagacagtcatgttctgaggtagtgagtactagagtttcaaaataagaattttgggcaagacacaattcagcctgtaacaatgaagtttatcatttttttcccttcatggtcagtgttttttgtgtcctatctaaaaaaaaaaaaatcattgttttccccaaagtcatgatgctattctttatttccatcaagaagctttgtgattctagattttatgtttcgatttgtgatatatatcaaatgattttttttgtatatggggtaaggtagaactgaggtacattttttctttccacatgatattcaatggtaacagaatcattttttaaaaagaggttgccttccccactcaattatttggtgccttggtcaaaaatcaatggactaaacatggagtctatgtctggacactctgtgctgctccagtggtctctttgtctattcttctcccaatctcactctgttttttttttactgttgctttagaataagtcttaaaattagttgtgtacatcctccaattttgttattttctaagagtgttcgggttagtctagattctttacatttccatataaattttaaaatcagcttgtgaatattttctaagaagcttgcagggattttgattggtattctacggaatctatacatcaatttggggaaaatggacagcttaaatatattgagttttccaaagaatacggtatatctctctatttaattaggtcctctttaatttccctaagcaataccttatagttttaagcatagaggtcatatgtatcttttgttagatttactcctagaaatttaattaagtttattttctttttatttcattttcaattttttgtccttaacatataaaaatttaattaattttcctgtatttatgctatgaccttgctaaactcatttattagatcttgtagtttcctgtagtttgtataagagtttctaggtgcaccattatttgttctgtgaataatgataattttatttcttcattcatttccaaacttaatgtcttatatttcttcttcttgccttagttcactgggtagagtttttggtatgctttaactagaagtggttgtctttgtatttattctgcttgggtttgctgagctctggatgtgtgcattgatatccttcatgttgaaaaattctcaactattatctcttcaaatatttcttcttacccattctcactctgttctcattctagcatttcagttacatatatgggagtccatttgatattgtcctacagatatagagtgtcttgttcccctttttaaccctgttttcttctttgcatttcagtttgggtgatttctatttctctgtcttcaaattccctgatttttttctctattgtgtctagtcttcgttgagcccataaaattaattctttatttctgatttctgatatcatagttttctgttagatatagatatagatgtaaatatagacagtatgtacgtatttcccatatcttcacacttgttttgccccttttcttatagaccctttaaaatatttatcacactaattttaaagatccaacatctaggctatttctggacctgcttctattgactattttctctattggctatccactatattactattttcttgttgcttcttgcatctcatatttttcattatctaattgaatgacccatattgtgtgtgaaaatacagtagagactgaagtagataatatttatccaccagaaaatgttacatccctacagaattaggctgctggaatgggcagtaagtaaatctaatccatatttgagttgggtcagggcttttccagaaatattggtagattccatgcaccactggtttcaaatattatgaaggctgaatcagaactttcagtacagcagagcttagaatctgagcaccagcaagactctgaggaccttgaatgctgtacagccaatccacagcttttggagttgtaggagatctcctcctgcattacagcccaacagtgagattttcagaagtctctttgctcttcagtcccaccctggctctctgcaccttgggaaaattttctctgccattcctccttgccctcatacttcaaaaggtcatcgtagtgtacttggtgaagacgaagagtacttcagttggatttctctcagttctcttactctaacattagcctttaatgggccactgctttgcatttgggaaaggccccaaacacctcagggactcgggagttctctcagctctcctctcctgtcctagtttttggctgactaatcccctgcacttggcctatgaggaagagttggtagatgggtacagactctgtggctgggactctttggcattctaacctgttgtttcagccctgtgaccattaaaagtccactaaaatttagacgggattatccctaccctcacctctggtggattacttcttctgctgccctgccaggattgaatgcaattatgggtgtcttctctttgaaaggtttgtcacttcctggaatttagtttattttgattcctttgctttctggtgggggaaaaaaaactgctagcatgggaacaacagtctcttacagctttctacatcctaatcagattgcttgttgtttttacttgctagattttcttctgcttgaaataaaattataatttctctaggaaaacaggattctctgaacccttcaaagcacctagtaatactgtctcatacatggatggatctcagtaaatgtatattaaagctatatgaataaaataatagaatatctcagtgcaaaataattgcacaattctgttaagagagaaagtgtttccagttctctcccctacatccttgaataaacccatatgatatgctgtttctggtggatatttaatgatgctcctaattatgtccatagtcttaccttggaattgctaacatcctttcctatttttttcttggtaaatccaccttgagagtttccaacaattcattgtctaatttcattcttattggtgtagcattattttcatctctggcgctatgcccctttcatacacacatgcacacacacacacacgcacacacacacacacgcacactatgctttccatttttatttttatttttcaccagtgacttacacaagcatcctttaactgaaacatttatctcttatctaaccttcttatatctcttccctcattgcctctcatcctgattttttatttattacattggatttttattccactgatgcacactgtgtttacaatgagtcattatggcagctatcttgttcttgtgactatctaaggccagcttttacttagaagactacagtggatgctgtagccatgatctgcactgtttctcagcttctaactcaccatggtcagagtgagtgcagcagattttcagaatctcctgtaaaaagttataatgtggaaaaatcatattccatcttataattggctttgtttattttgaattgactagtttattttaaatttctgactgatattagcagaggaaggacctagaaatcaaaggcagagagacgccactctcagccatcccaggagcattaggatctgctgagccagcggaggaggacattcatttttcacctccaaaactgttcaacttttagagtgtgaacaaacttccagacttggaagcgtacttttctgtgagaaaggcgagcagatgtctcgctagtggccacttggtggaaggaaagccattctgaatatcttacggcatcacggtgcctggcctgctgactgcaggcagcctcacacctcagcctgagttctgaacctgtcagatggcatgttggagacacaatttcctaagcaggaaaagttggctgctcattaaacctgaaccacttgttgaaatgcttgaacataaaagcaggaattataaatgagctggtgtttaagatggattgagccctgctaggtaaataggaagaactgctcagcactgtcctgaattaccaacaaaggaagcttgcagtcaatcgtaggaaaaccttgagcaccgcagcctcctctgaaatttgagaaaagttgagactataggagccttaggaatatctctattagggacatatgcaagagaagaaaagggctaggatacattacccattttaatgacagcaacttacccagtaatcacctaagcacataagcagaattctacttttgtgtgtgagatgtttggcattaagccaagtactcagttgctctctacctggatgggttctccagtaacaggattcgtcacttcctttgcagaaattctcatccccaaggcaaaattagccactctttgagcatggtttccaataggcactggtacacctcctaccaccatataagcatctcctattgtttctacctgtcagggaaaaaaaaataggtattcagagggattccttcatgcactaaacatgtcactacactttttttcattttccatatatagacaaagggactatactaaagctggtaattgattctttgctaagggtatgaggagcatgagggaggaggtgagaaagaaaaggactcaggaaacaaccatgagagagccaaaaggcctttctgcttttggtggaaacaaatcccagaaaagacgaagctcctggggtagtcatgtgatgctatatatgagataacacattgtttagattcgattttctgctgaatttaggagtaggagaactacactctatgaaaacacctgacatctaggtgcccctcaagggcaccagagtgccatcttagcactgagcattgtaaaaagaatttctaaaaactagaattcctaaaatacttccaattccctttcagcttttattctgaccccacactcatccacaccaaaccccagaccagtgcagacagaggcaaagggagacttagaatcaagcactcgccctgcgtgagcacaccgtgaaacaccccacactgcacagacacttactttatagactgcgtgcacactggttaatctgtcaaacttggagtacatggaattcagcacgttcactatttgtataggttcacaggcagtacagatgttagtaaatgtcactacatcgctgaaaagaatcgtgcagcttttaaattctcctacaacagaaaccaggtatcagtgagaaacaaggagatcgactaataagtccatgaattctggattaagaggccctgtgagaatcaaacctgccctgtgccttgtgggaaaagtagctggatgccattccccattcagcatcacccagcacacgtttactgagtgcccgctgcaagctagtcgtagtaggagaatcatatcacagggggcaagcagaccaggccctcgcccccaaggagcccccagtctaatgaaggagacataaaagtgaacaaatccttccagtaaaatgtgaccagtgctgtgggaggacagaaagggcccctagcaagtgggccaagcagagcctgagctacaggagacctggggacagggctgacagagactggtcactgtgaagtgatgggtccctgtctttgaatggcaggaaacctaccttgtcctgaacacttgctcctaaatcatgcccctgattccaccttggcccccattcatgctaacttccacatagcagccagatgccctgtttaagtcagatctcccattcttcaatctcaaatctttcatgacttccatcacacttagaatgcaacccaaagtcctgaccatggcttacagaggggaccccccacctctgtccctgccacctctctgaccccatgtccctccggctccctccactctggccacactggcctcatggggtttctccagcatgccaagtgcctcctgccttcaggcttctacacttaaaaaaagaggtgtttcctctgcctgacacttttctcaaatatctacagggcctgttactcacatttcaaatgtaaccaactcagtgagaactctcctgaccaccctgtataaaatagcccctagactggctatccttttagcttgattgccttccacccactccatacatttgacattatatgtatatacatatatatatatatatttttttttttttttttttttgagatagagtctcactctgtcacccaggctagagtgcagtggcatgatctcggctcactgcaacctccacctctttggttcaagcatttctcctgcctcagcctcccgagtagctgggactacaggcacacgccgccatgcctggctaattttttgtagttttagtagagacagggtttcaccgtgttgtccaggctggtctcgaactcctgagcagaggcaatctgcccacccagcctcccaaagtgctggtattacaggcgtaagccaccatgcccggcctgatattttgtatggaatggtttatttggttattgtctaccaccccattggaatacaaagctccatgagacgggagactgtcagtttagatctctgccatatcccaagcacctaaagcagggcctggcacatagtaaatgctcaataaatattgagtgagtgaatcaatgactccttgaatgcagccgggtgccttctttgttagttaagcctctgatggtaatttcccctttgtggaactttcccttctccttggcttctggcctatcatcctctcttcatattcctcctacctttctgatctccttgttttatatctttccttggcttctcaaccttcttaagcactagatgttccctaaagagtaatactccactctcttctcacttcctgtcctctaggtgatcttatccaccattcagagtctatgattaaccccgcccacattgcaataactcccagatgtatagctccatgccacaatgttcctatgagctctcactaagattcctaccactgatcatgctgtgtggagtatcccacagacatctccagctcaatggttctaaaatggaccttatcattctcccccaaccctgctcttctttctggccctgtcttaggataaagcatcccatttttccatgcgagaagcctcagacccatgcctgcctccgctgtcttaccttccccatctggtcagtgaggaaatcctgctgattcttcctcaggctgccctaattcaggcctctaccatcaatcagctgcgcccttatggtctttcagcaccccctcatgcattcattacactgcagccaaaatcggatttataaaactcatcctgtcacttccataataagagaagaaacttcaatgaattctcactgcctacaaaagacaatttccttttccctaatagtccaaattcatcactgcatcacctgaaccccaccctacccactcagcgtcaccagaccccacttttccacataccccacgctctgggaacatgccccatggtattcgtttgcacattgccttaactttgactcttactagcccattctccaaaaatgcctttttcctctttgcttgctgaaattcagcctcaaggcccaactcaagtgtcacacacttttgagaggtacctccacaactccaacccacccccctatctcttatctcctgacatctatttattattaatttccctgtccccatgttgccatagcaccttgtgtgatggaaagagtatggattttggagttagatggccttaacgcagttagtttccacctctttcatttatcagctgcgctgaatgtcaatttgctcagcaatatggtatggacaacacctccttcatagaaatgttgagaaaatttaatgaaactgcacatgtaaaatgtctaacatggatcctggcacaataattgctccttaatgcaaattagtttcttttcctttggtcatttccacccccattaatttattctgcatatatctatcaaactcatgaggctgtaaactcctctgtgtccccagatctggaacagcaccctggcacagagtaagttcaccaggcgtgtctggtgaatgaacacaatcccatgacaaacggaaagtgagttcagggtaaacacagcatccctgcctccataaatagtatactgtcccagaatggtcctcagaggaaccctatgatttaactagtgtgcgagtgtattatttctagttaaagttaagaaccctactcattgtcactgagtaatgaggccagtctcaggacatatccttaaattcttagagaatttaatgtgtgtgtagttgacaaccatttttatataattcatgtttcactcctgtattatttttattattattattattaatgtagagagaacaaagctgagaatatgcaggtggagtaattaccccaagatcatgccacttacaagtgacagagccagaattcaaaaccacttctgtctggcttcaaagcctgtggccctgaccactaagacataccacgctctgctcagaggacgctgtggaggagagggtgccttacctgcagccacctttttgccctccctcagctggttggccacgtgtttgggcagcatggcataaagtaaggtctctgttttcttcttttcaatggccaagtgcttggagaggacctgtagctcctccttcttcctttccagctggttggacagctctatctcagccagccgctgctggttcaggaggatgagatccctggtggtgtcgttgggggcgatgtcagaaagatgcatattgagttcttccagctcttgcaggctgcggagcttcggagagcacaggtacaccatgcaccacatggactccatccagatcatctggccttgccatcatggagagaaatgcaacagtagagtatgtcaccagtagggactgagacgagctcgctggacaaccaatcatctcccacactgtgtgcttctagttactgcacagtcacgctctttctcttttacccaaggtctgtgagaccttacttatctcccctctgtccctagcagctgtgtccattgcctacattgaagtggctcccatctatcaatggcctccatgctaccgatgccaacacaagttccttggccttttctttactcagcctttctgctgtttgatgatgttaaccagacccttcttcccgaaatctcacttcctaggacttctctgacactgctttctctctgagatgtcccctaattctttgaatttttacttacattattttaatctcattccttaaatgttagtgttcctgagggttttgtcttggtattctcatttagcatcacacaactgcatcctacaccacgctgactgcatctgaatttccagagaaaccttgcttcctgaactcaatatgtgtatttctttaaaaatagatatgtttgttatgttattgtaaaagcagtacacattcattgcagaaaacaaaaaaagtgaaagaaaatagtaaaaatcacccataatcataccacatggataattactgttaatattttgtagtatatctttgttttacaaaaaaacagggattacatggcatcttcttttcataatctgaatttttcacttaaaatatataacatattctttcatagtattaaatatagatattcatcttaatttttgctggttaccttgctcatactgtcttttattaaataataagctagtattgattatattttatctagcttatcattgtataaacaacattgtgatgaataagcttgaggcagtctttgtgtataatcatggctagttagtttgttaaaaagatatattcttagacacgggttacttagacaaagaatatcctcatttttaaggcttttgatacgtattgccaaaatacactctaggatgattctgacaattaatacctccaggaacagtgtttttttttcttctgttctccctattaggtatctgttcatggatatctgcactgaactcaacttcgatcccctccacaaatcttctctttctattagttctttcattacatatgtagttagtccctgcgatgagctaggcacactgttttaagcattgaggatacagcagtgactcaaactggcaaaaatccctgcctcaaggacattacattatgtctttttttcagttaattgcaccttcatcacccagttacccaatcaaggaagctaataattatcctaacgattctcttccaccccccacatccagtcaccaagtcctgccttaattatcttgtgagtctatcctccaattgccactccagtgccactgccagagtttagcactttagagtttctttcctggactccagaagcagcctctgtctggcctcccaggatccattttctctacactgtgacccatccttcacacacctccagagtgatcattctaaacatcaaatctgatcatggcagacacttcagcatgtttccagctgcatgatagagttcaagtcctcatcttgccagcctcctctcccatcactccactctacacctcactcgggttcccagaacatgtcattctccccttggacatcccccgagttctgcctgtgcttatccctggaataactaaacatccctctaatagaaagatagctcagaatgtgtgccctttcaaggcatatgcaaaaatttgctcaaaaggaatcaaagacctaaatgtaagagctaaaacataaactcttaaaagaaaacatagaagaaaagtttcacaacatcagatttggcaacaatttcttggatatggcaccaaaatcactggcaacaaaaaagaaaatagataaattggatttcatcaaaattaaaatcttttgtgcatgaaaggacacaaccaacagtgaaaaggtaacatacagaatatatttgcagattatatatctgataagaggttaatattcagaatgtacaagaaattcctacaactcaactgcaaaagcaaacaactcaattaaaaatggacagaagacttgaatagacatttttctgaagaataagtagaaatggccattaaccacatgaaaagatgctcaatatcactaatcattagagaaatacaaatcaaaaccacaatgagataccacttcacacccattaagatggctactattttttaaaaagcagataataagtgttcatgaggatggtggagaaattggaacacttgtccattgatgtccatgatgggaatgtaacatagagcagccactatgaaaatcagtatggaagttcctaattttaataaattaaaaatagaattaccatataatccagcaatgccacttctggatatatattccaaataaatgatggcagggactcaaagagatttgtacacccacatttgtagcagtattattcacaatagcaaagtggtggaagaaatccaactgtccattgatgggtgaatggatacagaaaatgttgtatattcatacagtggaatattattcagccttaaaaaggcaggaaattctgacacatgctacaatatggatgaactttaaagacattatgctaatcgaaataggccagtcacaaaaggacaggtactgtattattccacttatatgaggtatctagacttgtcaaattcataggaacagaaggtagaatgctggttactggggaattgaggaaggacaaatgaattattgtttaataggcagagtttcagttttgcacaatataaaaaagttctggaaatggatggtagtgaaggtacaacatacaacgtgtgaatgtgcttaataccaatgaactgtacatttaaaaattattaaaatggtaaattttgttatgtaaattttactacaattaaaaacaaaatgtgggccctactaatagtgagttagatgatcatgttgctacataaaatacagacattaatttaataccaatagcacctcatgcattctgaaaattttggtaacatatcagaattttataattacataatgtatatacttgtataattatgtatgtaactatattacatacatagtttacgtctaagccagagatggttgaggaaataaaatatattctttacagatcaagtcaagtggaaacgtcagaaaaaagaaaacgtgttctcaacgtagcccctaccctactttttaggaaattggaaaactgcctcttccctttcggatcaatctctcaaacaggtggggagcaacaggaaaggagtgagtgattaccttgaagtttgagtgtagtccgactttgccatgctacaggcatcatttctcttcgtgtcttcaggacaaattgactgttgataaatctgcggatgctgaaaatgttgaaggtaacttgaggatgaatgatggagaaatactcatccagttgaatattctgggtttggagtcctggtacgtacttctgaatgttcactctggcttgcttcacctgtagctatccacagaggacagatataagctgaggaatagaaagcaacctcccttcccataaacttccccttggaaataacattctagccatgttctgtggctcactatcgggaaagggggtcagtaatggaatcaacatcatggaagtaataaatttttttgaaacaatcaaatctgtgctaatgtctgaaagagaaaagaataatacgagagtgctcagaggcttatttccgactaaagagaaatgaggttacagctctctgttgggctaatagttcctccttgctctctgagacaactctctctctcactctctctatcatttactaatgaagaaactagcaaattctatagcattggatctatcacccaggcctgggtgaagaaatccatcaagggggtgggggaatacctttcactgctatctccagtgaacacacagaaggaagaagtaaaataggtgtcctttaaatgagttcctaatcaattcagttgacatatattttatccatagaaatggattaacaatcaaacttaaatagttatgctcacaactcttacagagcagtggcttgagttggcatgaccccttccccatgttcaagaggcagaatgtgaagctgggtgggatggagacatacatggtggtcacaaggatgggaagagttcatgggtagaattccaccctattgttgctactgactgtgttctgctgtctctttatgtagtgaattttagtgtcacttccttttccccttttttctaatggtaaactttcccatgcattcactagttcaaacctccctttctaccctatcaagaagatcctgcataatggattctggaggataccacaatatgaaaagcaaatcaatggtcctgccaggataaagcctagtctcccaagccctgggaatttctcagggacttgaaaatctccactgttcatgaaggactgtaaatcatgctcacttccctggcttagccccaattctaagctacagagggaagagtctcttactgattcatcgaatacaatgtggaaaggaaaagcgttgcagaatgtcttctcttcaatccagagtctctcaggataaattggctcaaaggtgttcatgagatgccctggacatagaaaaaggaagtgctgatgagaagcagctcccgcctccacccttgcacagagcagagctcgggatagggatagtatcttaagtgtttcacaagcaaagtgcaatctcacttcttttgcatggactccctcagcatctccagatggccacagcaattcttcttccaaattaaaacaaacagaaaacttgctaccaggttgagaagccctcctgccccctgccaagtttctgcctgccgctgaagagtttctgggccaattgagtatgtctcgccatgaacacagagtcggcattgaaatggtgacagccagacaatgagctagcagagcagagcgtgtgctccgggcccagcatcagggacatttgccatggagctttttagactgacagttttgggtggcacgtgaaaatttaaccaacagtcctatttggcagggggtagagattcgaaatggagcctttttgatatgaaaatctcctagacaaaggatgtcaattgcgtgtttgactcacttgccatggcttgaaggacgcaaaatgcagccctttgagccctgcagaccttctcccagatgcgtgtcacctggcccattgagtcgtgacgcagagcaccctaactcccttctcccaatggatcagagcccttattcagactcaggcgttaggtgctaatcgttagacgggctcagtgcccacaggggtaccttagcaagcctaatgcctgcattttgcaaatgagaagatggagactcttgtccagggtcacacagctccttaggcacagagccagaaacttgctttcttggctcttgatctagtgtcctttgcttgggcgactagggttgttatccacagatctccagtccagaaatgtgtccaaatggagaaggcctgactgcagaagacgagctgtggaaaattcattgttcctgatggcacatcagtgctcatcttccttctctccacccatcacctgttgggagtgattccaattgtgtctccaaaaactttttcttaggacaggggagatgatgtctccatgtcacccggcacaaataatgagaggcaatggaaggacaattagagcctgacattttaaagttaaaaaccatggtcaccaaatccaagctttgcagaaactagtgccaacacaatcacagagggcttggccctgtcagtgtacactggccactactcctgagaatcaagcaatctttctgatctcagagctgagcttgggagaatcactcacttaccttttccaaacatgactatgcttctcacaacatcccagtgggattttttcacaggacaagcagagacattcaaatatttctccttcatcttgaggaaagctgcctggagggcctgcaggtggcagggagacaggtacctggtcacatgactggagaagcacaaaccccatttgctgtgatggggtccacctttaaataaggaactgtatccatggccagaggaacagcatgagggcttacaagatcacttctaccaagactttagcgttcccggtattttttaatcaaattagtcctcatgctgtttctctatcaaagaaagcaataactttttagaaaatctcaagagggaactaggatgatatctggcaagaaaatcatgcacgaacatttcttcctgtggttgaagattctgcagtgaacagactctgagatggactttgaaaatactctaaggaatcagagactaatcctaatctgggtattttcacaagctatgtgcatggagagctgttcagctaacatacatggtaacttaagcaggtaatgatcaccctatcagttgcaactggggtggccaagtacagagtcttgagttgactcaggacctatgactggttccagctgcagaagtgggcactgaagactggaaagatcaatttatttgaggaggattgaaaaaaaaaagccatcaaattcaaatttcaaatccttcatatggttattgttataggtgaaaaattgtccaggctcaggtgcatcccagaatgcttcccagtatatatccacttaaccttaacccagcaattctcaactgggaatgattttatccattacccccactacgcagacacttggcaatgccaggagacatttctttttctttcttttttgtttggccacaaatgaggggatgaggttctactagtaggaaaagaccagggctgctgctaagcacactatgacgtgaaagacaccccatcaacaccaaagaattatctggttcaaaatgtcagcagtgccaaaactgagaaactctgccttaattccactattagaaggtccagttggtctcccatccaagcactaaccaggaccaaccctgcttaacttccgagatcagtcacgttcagggtggtatagccgcagacactcgtaagtgggaggtgaacagtgagaacacatggacacagggagaggagaatcacacgccggggcctgtcagggggcagggggcaaggagagggagagcattaggacaaatacctaatgcatgtggggcttaaaacctagttgataggtacagcaaaccaccatgacacatgcatacctatgtaacacacctacacattcaaaacatgtaacccagaacttaaaggaaaacgtaaaaaacaaaaacaaaaacaaaaaggtccagttgattctgttgtttgcatagatttttccaagactcgtagctctacttaagtgcaactgttctttctaaaggcacagcaaacccagtacctcttggtctctctccatgccctgactgtcttgtaacctttttggctttgtctttctcatcttcctgtgagccttctgtacaatcagaaacacaacatgctccttcttccctgtcctctccacttcttcattcatgtcaagaatgtccatgattacatcaatatcaaagaagtctttggccacagcctcaatgatacctgcagcagaaggacacctattgtcgagggatggccgaaggcaactttatcagcaaaaatcataaaataatcaaatggcaaaacttctgatgaatattctgaagttcaccaagcccaggccctgcttcaaatcagacatcagtgacagccaattaaataaaaatatgcagagactgaagttatacatgtttggataccaaatatatccatgccactttaatttctagtttggcatctattcatttgtttgttatttcaggtaggcatttaactcattaaacaaacaaataaacctagagataatgtaagcaaaattcagttgtaaaagcattaaggatcaagttcaaaaaagtgttcccctgggaatctatcccagggttatatacaaaatatagggaaagagccaggcacggtggctcatgcctgtaatcccagcactttgggaggctgaggcaggcagatcacaaggtcaggagatcgagacgatcctggctaacacagtgaaaccctgtctctactaaaaatacaaaaaattagtaaggtgtggtggtgggcacctgtagtcccagctacttgggaggctgaggcaggagaatggcatgaacccgggaggcagagcttgcagtgagccaagatcgcgccactgtactgcagcctgggcaatagagcgagactccatctcaaaaaaaaaaaagaaaaaaatatataaatggaaagcatgtatgaagatgttcatgatagcactgtttacaaaagcaaacgattagtatcaatggaaaatttaataataggggattagttaagataattacaatatggaatatcattcggccacttaatatgtggttttaaagattatgtggaaacatgctttttctacaatgctaaatgcaaataaaaagctgatacaaaataatatacgcagaattatcacaactatgtaaaagcctgtatgatttaaaatgttgaaagaaaagtacaaattactcatttttgtggaattttggaaacttattttaaaagctcaaggacattgggagcagtggtcaagatgatatgaagtcacacattctaagagttttaacttcttacccgtagccagttattagccatcctggagaatctatggggaaaccttcctcacttcagaagccccatagctctgcggccagctaagccatttccatacctggtacaatgtggcacagaccacttctatccgagtagtaatggagaaacattttcccatctgctcctctctccacacgaaacgatggtgcattcatctcctaattaaaagacacacatttttcccagtggacacaaattgtgtaaattatgcttttgacgctttgtgaaacaatagtatttacccattacatcatacagagctatatgccaaccctctctccaatcacatagaaactcccactgtttctgctcctgtatgtcaggaattttatactatacctactgtactttaaacaactctatatggcaagtactagttccatttgaagaggaagaaactgaggctcagggaaggcaaacctaggttaatggtagaacaacatttgattcccaaatgagcctttgcaccgtgccatgctgtttctacccatattccaaaagcagctgtctgctggtaacaggaagccttagtgagtttccgccgcgcttggcctgtgaccaagtgaccatgggcatcttcactttccaacacatcagggaatcagagaatttgcaagtagaattaatcaatgtcttgttctgaaaggataatgtcttctgtgatatcaatttgaacatttagaaagtagaaccttccaccgggcgtggtggctcgtgcctgtaatcccagcactctgggaggcgaggcgggcggatcacgaggtcagaagatagagaccatcctggctaacacggtgaaaccccgtctctactaaaaatacgaaaaaattagccgggcatagtggcacatgcctgtagtcccagctacttgggaggctgaggcaggagaatcgcttgaacccaggaggccgatgttgccataagccgagatggcgccactgcactccagactgggcgacagagcgatctcaaaaaaaaaaaaaaaagtagaaccttcaaggatacatcagaagagatcctcccctttctccagaaatgttgacattcaagtacctatcatttcacagtaaatgagatgtatactaggaaagaaggatagagattttgcctaggggagtctctagctagttagagggcaactcagcaccctggacacacagcttttggtccaagtgagggaataggtaaaggagatgggttccttccaagatctttgtcgtcttccatggtgaaatgttgttagttaaaatgggtttcttttttttccccaaatacttttttatttttattttttttaattttttatttatttttatttttttgagatagagtcatgctctgttgcccaggctggaatgcagtggcacggtaacggctcactgcagcctctgcctcctaggctcaaatgatcttcccacctcaggcttctgagtagctgggattacagtcacgccacctccatgcccagctacttttttttttttgtattgtttgtggaaatgtggctttgctgtgttgcccaggctggtctcaaactcccgggcataaatgatcttgtccacctcggcttccaaaagtgctaagattacaggcatgagccaccacgcccagccctcaaatactatttttttctaattccaaaagtatgtacctagagaaagtacatatatttatctgtatgtatgtgtgtttacatcttgacaaaatgtaaagagtagttgaggcagcacatataaaaagcataaataaaataggaaattaacagttaatttaaaaattatatccaaatcctacatagtgaaaataaagtaacagaatacagaggcctgaaagaaagtccacgtgatcctgcttcatgcccctcactccttaccccctgcccagagacacttccaaaagttcatgcttttagttcttctggtcaatgtcactaagtctctaaataatataattacacttttatttcttgcttcaaatagggctttttaaaagtggagaattagggcaaagaataacagaataaaaaaaatgcttttgcctaaagagacaatctataatactttgcccagaataaagcactatatagctgttaggtatcattacagaacagaatagaaagcccagaaataaggctgtacacctaaagccacgtgatctttgacaaagttcttattattccaaagaataatgagaacagcacagggcaggatctttggagacaggtgtgggtttgggtccagctcagccaccatgcctgggtgatttggggacagttacttgaactttctggacctcagttttctcatccgtataacaggaaaaataagactgcctactcttatggcatcaagaaggtaagtcaatgttgacacattacttagcccaacacctgcctcataattagcactcaatgaagtttggccaaagcataacaagattaaaggctcagttataaccagaaatgtataccttaaaggcactgccaaattactagatagacacaaaaaaagtgaacattatcttactttgttatttttgcctaaagagacaatctataatactttgcccagaataaagcactatatagctgttaggtatcattgcatgtattttcttccaacttgtatattataatatttaaatattttatttacctcattatgtgcaaaatgtcctcaaataccaccagataagttctattctattgcttctctagcatcacttataagtgagagctaaatattgaatacacatagacataaagatggcaacaacagacaccgggaactactagaggagggaggaagggatagggtcgagggttgaaaaactattgggtactatgctcactacctgggtgttagcgtcaatcataccccaaacctcagcatcatgcaatagacccatgtaaaaaacctgcatatgtaccctctgaatcttttttaaaaaattgaaattataaaaaagcaaaggaaaaagatcataggataaaaaatatatgtgttataaaaaaatattaaaagggcctaactctatttctttatatcctaattgttgtgctttagctaagaaattgaaaggaagttgtcatgcaaattatcgttaattcttaaactggccatattgaacagagagaaaagaaaggggaaggaatagagttattatttatttatggaaagctgatttttctgggctgattgcaatgctagacttttccatcttatctcttgtaatccacatattgctatgaggtaagttatcttttccctatttattcctttttgtctctgtttgtgtccaataccttaaaaagtacttgatacatagtatcactcaataaatattagttacccaataaatattattaaataaaataaattgagattcagagacggcaactaacttgtccaggatcgcacagctgttaagtggtagagccagtgggacagtctcatgggcccatctgaccccataagcagggctgtttccactccctctacccttgagtagttcacatgataacaataggacaggcccagctattcatgcccaactattcatgattcataattgaagtcagttaaggcttccaagcctctgattccttatatgaaaaatggagaaaataatacttttcccatttatcgtctatgggggggtgtaagggttgctgaggctttttaacatccacaatcccattttgtccccatgacaaccctgaaagggtggatatgaacaccaatatagaaatggtgaaggaagatctcggtgaaatatataaggccttaaaattaaactatgttctctaaagcaataaactattattatgatatgtataaatgctctttcaccttttcttgtctaaaaaataaaagagaatctaggcatttgaatttccagtgatctctacaaacaagaaacccaaggaaagaactccagaaggatatatcccagtagggaaattagtttcctaacacctcagtcagtcacccatgggttaatcagagttggatggtttccgattctggctcttagccctgtcaagtcttcccttctgatacatgaataacatgaatctggctgcatatgcaatttatcagctccatcctggccaggaaaccttaggagagcttttgcaaatgcactgaaacctgactgttttccagcctttgttccaattgtaatgagtctccaggatttaattccaaatcaacaccacaccctatctgaaaaggccatcccttcggtttttgtgagccagtttataaaagtggccagcaggtgtttctttttcattctcttccaaaaagaactcctgagcccaccaacaccaggtaccaaggattctgcagatgggagggttctcctgcaaccgtgcctctgttgggggaggcggggagctggcccaggactgccacagcatttgcttcctcttgggcagccaagaccagactcaagtggccttacctgataagagagtgccaggtaactgtggagggcatccaggttttcaataaactccatgagatttcctcccagtgtccgtagcatcctgtcatagccagacatcttcagaattgaaagtattctccaaagagtttcaggatggcttccatggagacacctgtagaaaccaaagcataccccctaaataaaatctcctggaggtgtgtgttgtcctttgtgtggtcttcatttatttccaaagggttcacatcctggctgtgtgacactatcgagctactctctaagccgtcacttgcctcctcggtaaaatgccaataaccacattgatgtcatgggcccttgggaggagccccgtgcagcctggcactgagtaggtgcttgtgaaacataagtctccttgacaaatacttcctcaaagtcgagaaggggatgcagagatgctgtacccgcttagctgctgaagccagtgcccagaacaagcttcactctgggtggggagggcgcgaccctccacgaacactgccaacacctcccacatctttaaatgtaacagtcagtctctaacaagaatacaaggatgcctctgagaaataactaatacacaatgaaaaaactatgccttcaaggctacaggatcctgatttaccaaaaagatgataccaaatacttgcagtgtctttccctttctctcctgacctccctgtgaggcccagtgttcctgttccattctccataaagatttctctgaattctctcttcctaagtgttgcatttttttttcttcctaattcatggtaattctggagagaagcaacccgatcctacacgttttctgtgctaaacacagcataggtgcctgatgaacacctggaggtagatttgcggcattagttggagctgctgcccacctccccgctccccagtctacactgttggaatagacagtaagcaagtgtccactttatgggaaagacagcaaacattttaaaagaatgttttatagttctgacaacacacattaattactgttctgttactcaatgtttgcccagctcttataaggtagctaaccttattatcatgtcctttttacagctgagcctgttggggctgagtcatctttgtgaattgactgcagtcacatagagttgcagaggccagatttgttgaagaggctccaactctaagtttagcactttttataccacatcccccagcctctgaagcagcaatgagagaagcaaggagtctccccaagggaagcgctgcttatgcgttggcatcattgacacaggagacagggcatccatccatgctgctggtctggagatcctgtgagaaacaccctcttatttacaatggggctgtgacacatgtaagtcctgggggctggggcaaatgtctgtaatgcccaggtttatggaaggcctgaagagctcaccatcaccagtatctgtggttgcatccttgaaaaactctgtgatgctctggctggatttggaattcacagcaagggacattccaggtctcatgagctatccagggctaaatcctacagaggacagacgaaggaggtctgggcactctccagcccctgcttgcttcctaggatggtctgaagagcagtttccctacagctcatagtccacagccagaccatggggcagataattgttctgtaatctgagcaggatagagtccccactgaattggtctagttttgtcagagatgagttgtacatattttccaagatgagttatacatattttccaaaaattgattagtcggatctcaatctagacgaagcttgggatggtagagaagccagtggtaatggcctgtgttaattgcctccgttggcttctttgcttgtgggtgcatcctggccggcctcaggcaggcttgtctatacactggtataaattcaaggaccacctgctaacccctaggggatctgagacaaattctaccaagttcctttccagtgcttgagtctctgggagggggactgctaaaaggtaaacagacagatgggaaattgtccttctgctctcctgcttccatccctctgttacctctgatctagcttattcagactaagaaaaaacagctgtgctgtgcatcctggaggctggagctctgagcaggtgcatcctgttacctgccaggaaaagcaggggtcccagcggccccccttctcccaagaacctctgccaggaggactgggctgcgtgtaagccaagcaaagttatattcaagtaagagtggcagctttgggtaaaagactgcctgtttgactttcaaatctttaaacttaaaaaatccatgaagctgtttgttccaggctctggttattttgtttgtggatgcccagctctgttaaaaggaaaggacatctggctgagagatgaactgtttcccaaacaaggatcttgggtttgagtgtggtgttttccacctgtaatgggtttggagcttcttctagaattcttagttgagaatgcttgtccagcagggaataaaggccgcttttttaaaaaaatcagcacctgttttagtcttttatacagtttcacatcagtgtatttaagattccaagaacccgctaagtcataggggatccaagatatacaggaaatggttagaaactgcaagaaagaactaaactaacttaggtgccttaaaatgtttttctgatagtgcaggggagactttatactatgcttagtattctttaatgtaagaaagaagggaaaacaaggaaataatcatctatctgcctacttgtgcaaaattaaacaccagaaggataaacctggatctattgagattggttacctacaggacattggtagggaatggggtggaaagattagaaaaattgtggagttggggaaaatgacatttttctgagcataactttttgaacagttctggtttggggagtcatgttaatgtttcatatgcttaaaataaataaaatataagatcaacaaggatagagaaaacccctaagatggagtacaaacagaaacaaattcacagaacagcatttcaacagaacagttttgaataacataatcacccaggaaaaaaattaacccagtaatatttgaacatagtatttacactactgtgtcttcaggccaaaaacaaaaagaactttaaacaaatattttactgtagttagtaggcttccttttcacagcagtgtgggttagcaattctgaaactatgttctgaacaagtaaatatattgtggatagtgggagccaggtttttccctatctgagaatgaagttacaattatggaaaggggaggaatagaatgaaccctgtgcctctggattagaaaatctaacataataagacaatgaaatctatcatggttttagatatatctatattttatatatctatatctatatctatattttatatatctatatctatatctatattttatatatctatatctatattttatatatctatatctatatatagatagatatatagatagatatagattatatctatatatattatattatatctatatattatatatagatatatattatatatatagatatatatatagagagagaaagatggatgtatgtgtgtgtatgtgtgtgtgtgtgtgtgtgtgtgtgtgtgtgtatatgacatgtattttccagcactgtccactaagagggcctaaaagcagtgatatcccagtagcagtggggttgcctaatgtctagatcttagtttttaaatgctcttctcctgtaaaaggaatcagggccttggagaaatggcagattccagggctggggcagggaaaggatgagatcagcctataacatcttgttatgcaagaaggtaaagaagtgatcaaagaatgatggggacatgtcaaaaggacacaggggccagtttagggtggctctcactggctaactcttgcacaatttgagcatcaaaataaataataaaaggaaaggattacagcctgtttttaaaaaataagaatcacaaatctacattgatataagtaaataaatacatgggggagagggggaaattcttccttacagaaactcaatgaataaatacaaaaggaataatattcttagaaaatcaccatttgacttccatcataagtatcaattcagacaagaatcacaaataaatactaaaactatgaaagagggagtttgagaaatgacaagatatttgcataatctgaaagtatctcctcacaaggtactaattacaaagggaaaatgtaactttacagtggagaaagctggcaaattctacgtaaatcaagtgatcaaagttagcctcactaataataggacagatcaatgaatggaatatgcctcctgatatgataaactgggaaggaaaaagatcacgtctgtgatcttcctgccaggaaagcataacctgaattatatcatgaggaatatcagataatcctcaattgagggacattttgcaaaatgtctgaccagaactttccaaaaataccaattttataaaacataaagagactcagaaactgttccaagccaaagaatactgaagagacacgataagtgacatgattcaggattttcttttgttctaaaggacatcactgggtcaactggaaaactctcaataaggtctatagattagataatagcactatatctatgttcatttcctgagtttgattgttgtactgtagttatttaagagaatttttaaggacaagaaggcatcacatttgcaatatactaacaatttcaagaaaaaaagtataaatctagatataaagagaaggatagacactatatggtaaaatgtcaacatttggggaatatggataaatactacatgggaattctttgtactattcttgtaagccttttgcaagtttgaaattatgtcaaagtaaaaaagattctgttgattgctctgaaaagaccatagggaatcttacataataagaccgtaaagaccatgtttatccatggccagctgaaatacagctgcagcccaggcctctgtaatgttatgaattttgttagttataatcagggcattatcagtacatttttaatgtctttatcttgttagagactaatactgaaatatttatggatgaaattgtgagaaacctggtaattgctttaaaacactccagaaaaaataaaactagaaaaagagtggaggaatcagatagatgaaataagactggcaaaatattgttaattagtgaagctgggtggagggtatgtgggcttctgtacacaattctctctacttttgcgtatgtattaaaacattttttttaaataaataaaggagttgagttttttttggttggttgtttttttttttgtttggttgggtttttttcgtttgtttttttgtttgtttgttcggttttttgagacagggtctcactctgttgcccaggctggagtgcagtggtgctatcacggctcacgcagcttcaacctccccaggctcaggtgatcctcctgcctcagcctcctaagtagctgggactacaggtgtgtgccatcacgcctggttaatttttgtattttttgtagagatgggggttttgccatgttgtccaggctggtcttaaactcctgggctcaagtgatccacccaccttgacctcccaaagtgctgggattacaacacccacccaagactttttttccaggaggaaaatgatggtcacaaagcttctatgcttgattccccaggtgtggagacctctaacaagcttttacattggagtgttgcatgaactcaaactttctgacttaacaagcatgggtcttctttgtcactgggaaacatttgcttcttgctgggtttcagctcaaggtactggaaagagtagagttgggctgtccagggctgggggacagagagcgcctgttgaagccccagtgaggctggcagggacaccatagccaccaaagcagagcctcctggacaaacagcccactcagggccagacttgcaagacccctgcccacctcccgtcacccaagtcacaggcaacaagagctattcctcatggcactcttcctgagtcacccagcaaaacatgtgctcttcaacaggaaagagaagtacatgctctacatttgacaaagttttccgttgaaaatgggtaatttttcccccaaagcgttggtatccaaaggattactcttcagatacctgaaaagagccagaatctcacatactctttttctccaatgatatcactaatgtcaggcatgagttagtttatggggaaatattttggagtaggagaaagagtagtctaagaaaaggaaagaaacatctgcccatgtccatgctgtagtttgcaaggaggaagaagactctaaattaggagggttgggtttcagaagtagtcgtaagtttatacaggcacagagaaaaaataaactggaagtcgattaaggcagctcaggaaggtggtgctctgcagggatgaagcaattccgctgaagcctggtagagaagaagcctcctggttcccgtcaaaccttggaacagagtagtcagccctaccagggccacagcagggggccaggggtctatctggtggcaagcaggggtgagggacagggcgaggtaccttgttgtgtacccactcggtgtcaggcattttgctcaccttatttgatttcttctgtaggacagatgaaaccccctgggttgttgtcctacagaagaaatcaaataaggtgagcaaaacgtcacaggtatcattgctgcattaccaggggaacatttaccccaggttacattatcaggagccggtgtagccagggggctcacccaggtccgtctgattccaaagcccttgctctagacattgtcgacttcccctccagtctgtgggattaagcatcagccttggaatcagcagacctgaattcaagtctccattcgtggctggttgcacagcctgggttacttgtcccatcctcagaggagaatagtgaagagcaaacgttataatgcctgatttcaagacgttgtcaattttgtgttgttcttatttttaaagatgtgagtgcagagaggcttgctggcatttgctgatagctaactgttgaaacacattttactgtgggtgtcttcgcaagcaaagtctagacggacacagctgtgccaaatggctgttgtgtgttgttttgaattttgtcgcttcagatcactaataacccacttacacactaagtaggcacttattcatatacagaacaattccttatgcaatgctcaacctgccatctggtcccctcctgaattatgctaattggaaagcacagagctatgcagtggcagagcggtctggaaaagtcccagcaattgcttcaaggtagggaaattgcattctgaagcccacatggaaagcaaagccctcactagtggtgactaagcacactttttcccttgtcaaagggaggattttcaactgaccagtatattttgttagacagtaaaatgtccttcctgtagcctttcctttggatgggtcttgctctctcagactcatgggagttggagacatacagaatcacgacgggcttcctggggctgtcctgattccacatctcatacatgtgttcactcgattttgcatcccaacttcttgtttgaaaaatgcattcaccatactcatttactctttcagatagatataggccaatagatgttatggaaataaactacaagaagaaaagattcctgacattcaaagctaggcagagagaaaccacagtgatgtacgttggctttcggtggaaaggtgatgtgggccagcccacacattggtctgtagactggctgctgcctctacacatgttggttgggttgggaatgtgacggcagtggggcaggtatgtgatggcatctcactgctggaggtactgccacaccgtttgatgtacatgagcacagacagccacaaaaatggactggggtgatatgatatatacagagtatttctttctggagatatacaagctgattcaagttcttatattagtccactagggccaccacgacaaaatgccatagatggggtggcttaaacaacagatatttattttctcagagttctggaggtcggaagtctgagatcaaggtgataacatgattacttgacttatagagggtcaccctctcaccatgttcccatgtgacagggagtgagagagccagtgctctggtatctctcctataagagctccaatcctatcaagagggccccaccctcatgagttcatctcaacctaattatttcccaaaggccccatttccaaatatgaatttggggcatgggggcacaattcagtccagagcagttcttaggttaaaagatatttttagaatcttgaaaaagatctgcatccacccttgagagcatgaaatgaccaacttttcctgtgaagggcagatagtaaataataaatgttttcggctttgtaggtcatatggtctctgcgcagctactcagccctgccactgtaacacaaaagcagccatggacgatgtataaacaaaggggcacggctgtgttccaataaaacgtgacttacacaaacaggcaagggcccagatctggcccataagctgtatgtagtttgctgaccactaatcagagagctcagaacataatttttttttttttgagacagagccttgctctgttgcccaggctggagtgcagtggcacgatcttggctcactgcagcctccgcctcccaggttcaagtgattctcctgcctaagcctcctaaatagctgggattacaggggcaggccaccacgcctggctaatttttttttttttttttttttttttttttttgcatttttagtagagatggggttttaccatgttgcccaggctggttttgaactcctgacctcaagtgatccacccacctcagtctcccaaagtgctgggattacaggcgtgagccaccgcacctggcccataatttattttattttattttattatttttaagttccaaggtacatgtgcaggatgtgcaggtttgttacatacataaatgtgtgtcatggtgctttgctgcacagatcaacccatcacctaggtattaagcccagcacgcgtgagctaattttcctaatgctctccttccccccgacccccacaacaggccccagtgtgtgttgttcccctccctgtgtacatgtggaacataattttttaccacagccatttgaagtgaacagcaaagcctgtcttcttataagggacagtatctagaggtacaaaacatagaaatacccccatccttccttcagattcaacatttggctgacatttaccaaacacccagtatgtgccatgcatgttgctaagtgccttacatttgttatttgatttaattcattccttcccacaaccctgtaaggtattattccttttgcaggagatcaactctcagtgaaattctagcccaaggtcacacagctggtgtgacggaaaagaatccaccctccattctcattctggaataacaacgagatgttctttcgcagagggctcagaccaaatcaagactacacgatacagccactacgtccttctgctgctgggatcccttggaataaaatcaagaaaagactaaaggtgggcttaatttcactacccattgtaagcttttttgccgttttatttcctaagctctgtcaaaactccagattttcagctcaaaagtagtcatctctcattacagaatttccacctaatgatttgtattcttcctgtggaaggaaggttactagatgctcctcttacttagctagaagaaaggaggtaattgcaaaccactggacttgctcgtggacctcctgccctcactaggatcacagatgtgcagaattgtcagccacaagggcagcacctaggctttgcctatgtggggtggacatattaggatcaagaggggatctgtctgtctggtttgcaaaagcatatttaacatcgtaatcgcatacttttaaaaaaaattaaagtgatgcttaagaaaacaaaacaggtaatctctttggcaggtgtgtcaagcataaaggctgacaggtgaccctctggggtggctgtgctgctgccacctgttgaacaaaaaggccatagctggggagcagagctgagtcgagaacccaggtctccaggcctgcagcccctgggagcagcacagtgctgtaaagaggacacatcccgctctcagactcgagcgcagaaagctcgatgctgtgtgctttttgataacccagccccacagaaacctcccctggtgttagctgctggagagacaaaagggcctgggagtccccccaagacaggctggacaggataggggtgaggtttgcaggtatcactgacacttcccagttcctgggccagctttggcctagaatctctctctgtaagcttctttggagagcggagctggttggtggattcggggagaggcccagccgtgattcttgggaagccacgtgagccctgtctgccagctgcctgtgtcctccctctaagtgctgccgtggtggcaggctgggaactggctttaggaagcatccgggaggtgttgctgctcttggcgcctgagttccaggagctgaaggagcaaatgactgtttcactccttgtgccttatttccagcctcagacacaaccttggttctatcaaaagatgcaggtgggaagtgaccaggggctaacatacatctggttggaagttgttttaacaaccagttgggacaccagattcctcctagctatgatcaccatcacctgccaggcctcgttggcaactctggcccctgcttgtctctgtggctccaagagagcaacatgatgagatgagacagcaggtggcccagagtggacaggggaagcaggtggcccagagtgggcaggggaagcaggtgaccacctgttaccagagaggactctgagcaccacacacatccagcttcctcagcctcaatgacttccccctcccagcttggcagagactttgggcctctcctggatatggatccctggaaggtcttctgcatccaggagatgaccaggaacatgagaagagatgtagatatcagtcacagcgccatgtgaaagccatgggaaaagccctctcatctgtcagatccagttgcctgcaagtaaagctggcactatctttttaatcatcagataatttttctgaaatccaaagggaagggaaataagctcaatacctcacacgacacgggcactttacacatcactgctgcgctctggagaagctgcctgtccctgcgggcttagcattagctagctgccctggtgtgttctcaggcacgcctgctgggctgatgactgtgatacctgctactggcttaaacctatatcatttcacaaattgttcctgagaatggcaagccaatttgctaggccctcagaggcaccatgaaaccaactcaaaaccatggcccctgctgccagaccctctgcaggctgcataagagccagcttgcacactcccagggactgggcctagcctgacacttccaacagggctatacccggtgccaggtgacaagcatgaggcctgatgcagcgtctgagtgagatcatccttaaatgccatctcacactctcacagtgacccaaggcagcaccgcctatgaggaatgggtgaaggaagttcaacgggaagggaaagaggaacctcatcaaagatcctgggtacagaggggggcttcggcttcctgcatagatccctggagcctgggacggtggaggctgcctgcccctccctcccctcaggcctgccctggctcattgtgtactcagtgctggtgagaaggaaggataaagaaagcgagggtgtattgggttgaatagtgtgcccccaaattcatgtccacccagaacctcagactgtgaccttatttgaaaagagagcagatgtagctagttaaaataaggtgaggacataagggattagggtgggccctaaatccaaaggctgctgtcaatatgagaaggccacgtgaacacacagggaagaaggcctgtggagatggggacagagattggggagatgtgtctacaggctaagcggtgccagcaactgccagaagttgggagagaagcaagagacaagttatccctagagcttccaggggaatgaacccagccaacaccttggctttagacttctggcctccagaactgggagagaattgatgtttgttgtttgaagccacctggttgttggtactttgttacagcagcccaggaaacacaaaggggagggaaggaagaaagaagaaaggaagggaaggagggagggagggagtgagggaaaggagggaatgagggaagaagggagggagggaatgttttttgaaagcctattatatgccagataccacatatgatattttcacatatattttctcatttaatcctccaaataactctgaagattagatcttgttcaaccaatgagaaaactgtgactatttaggtcatttgtcctcggtcattaaactagaaagaggcagagctaatttcttttttttttttcttgtttttttttttttttttttgtcctgtaccttgtcccctctgggcctggggagtgagcagattaacaagataaaaaaaatccagtgctaatacatccacaggaaaaaccatcctgggaggacacgtacattgtcagtgggaccatccacacatggtccccctcctatgaccctgtcaatggcattttcatgtccaggcagatgggaaaatatgcgatggagagcagatcggggaagggccctcagcacactgcagagcaccccacgtccatttccaggtaagcacgagtgtaggtggcataggcggattctcaatgttgttcctcctgacacccagagataatcatagcagaccattctaaaggtattgcaacacctgtaaagccaacatcgaagccaaacatgatggcagtggtgcagacggtgctgctcatcatttttgtctgtaagaagcctaaggccactcaaatggaaagggtcatacctgagccctgtactgggttagagtgccccttaaaattcatgtctaccaggaacttgtgaatgtgacattgtttggaaattgggtaatcaagttaaaatgatgtcatttaggatggaccctaaatccaatatgcttgatgtcctaatgagaagatggaaatttagacacagagacacaaatacagggagaagacagccacgtgaagacagaagcagaggctggagttatgccgccactagccaaggaaagcctggggccacccgaagttggaagagggaaagaatttttcctgagagccttcagagagagcacggccctgccagcaacctgattttggacttctggtcccctgaaccacagagaacgaatttctgtagttttaagccacccaggttgtgatacagtcggtcctcattatttgaggatttcatattcacaaatttggctacttatttatctgtaggcccgaaatcaatactcacagagctatcaaggtcattcacagacacagaatttccaccggccaacatgaatgcttctagccaaggtagaacaaggctgtgctctatgttcttattttagtttgaactataaccaagtgtccttcttgcagtctatttagtgtcatctttttcacatttttctgcttttctgttggtgattttgctgtttagaatgacccccaaatgtaggctgaagtgccatctagtgtccctaagcacaagaagactgtcacatccttccagagaacaggcagtgttagattagcctccttcaggcatgagttacagtacagttggccagcagttcaatgtgaatgaatcaactatgtatattaaatacgtatttttttcacagaagcacacatgaaacaaagttatgcattgattggttggcaaaaatcttgtgaccagagactttcaggaaactaaccctgtatttcccctaggaacaatggtgcagtattcactaattcaggattgcagcagctttatagactataaccaatgcaaataatgagaatcaactgggttttgttacagcagctctaagaaagcaaaacaagttctttcatacttacccagaatgttgcaggcctcttggatgagcttaatggtgatgacgtcatcatacattgtgtaggtcatgaaggcatcttgtacttctgcagaagttctggaggataaatcgaggtgcagtgaatgctcatcagctggagctttgccccaggaatatatccactgacccagcaagatataatgtaacaataatcttcttgatcataaggaatgtgagacactggagtgtttgggtgtcaactcctccaagaagccttccctggacctcagtttgagcccggagaccccttctcaagtacccaggataggctatgcatttcctcaacttatataaagattgttggtcttacccactagctggtctccttgaggatgagcattgtgacctgtttttatctttgaacccccagcaagtggcactgtactgagcacatgttcagaacttaatatatggtagtaaactggaactcaatggtcatagagtcttgttctctgaatggtagagcagctgcttgagtttctcactgttttgcagtgtagttggctatgttgcaggagttatggatggactttagtcttcaacagatagccaagcctgctgaaaagaggcttagcctgggagtctgagacttgcacccttggcttggcccttatgtgagtcatcaaactgtagttggcaactgagttaacaaatgggggaaggaggttggtcagggaatgcttctctaagaaagggagattttgctgagactgaaggatggaaaggcaaagaagagccttctggacagagagaacaggcttctaggcagcagagaacatgtttgaagaacagagaggggtcagagcattcaagcttatccagagcacaccatagaatcttgacactgcgagaagtatggaattttctacatatccaattttctaaatgtccaatttcttactgcacgctatttctgactgctggttttccagtttcttcttgaatgcttccagtgacaacaagctcattcctttgcaaggcagcacattccacttaccaactgctctctttgatggaaacgtctttcttatgttcaaatgaaacccccttctgggccctcataatacctcctatttattaagcatgtgcttttggcccaagagatgaccaatttattacttatcattcctcgtactgttgagaaggctgatgctcagagggattaaatgtcttgctatggtcaccggttgacaagagaaggatctgggctctgaacttcaaagcccacaccactcctgtactgtgctgctgggaatttactcactggccttagttctaccctttaggaaaatgcagactgggctggtccctcctctggatacctaaccttctaatgtttgaggatccttattcatcactaaatttaactatctctttatcatctttctggacttcatcttcctctctgtaaaatgtggcaattattattacctgcccttcctatctgccaggagtgttggtaaggataaaacaggataacaaatctgaaagagcttggggaaaatgagaaccaccatgcagatcctaggagagctgtgatgacaatgagaacaaaggggctgcgtagtgagtaggaggtgaccagggctggggtttaggagactttggttccaagcttataccttacacaaataagctctgagggaaaaccactttccccctctgggccttgatttctttatccgtaaaatagaggaggtactgggcaagatttgtgtttctccatcttttttaacctctctgctacacacacatccactggggattctcagacagccccagaaacgcttgtgcacgcagttgaggatctaggactctagcttctaggactagaagctgcttgaattctccttcacctgtaagagttcctgttttggcccatgcctatacagtgctttctaagcatcttcggaggcagctgttcagagaaaccggctgtaggcctgctcgggcgaggagtgctgtacaccaccactgctgcctaagtggggcactctccaccatgttggagttgcctcttactcgcccccaggggcccacaagtctctgtgaaaacatgtgccctccttctgcacctataagcaaaacagaaacacgtggacgtgaccccagtttaaacttgacacattgtcataatgtgttctgaagaccttagaaagggttaagtgacctccaggaccgtcagaaatgtaacaaactctgtggcgctccctggccctctgatgggaccacccattcaccaatctctggatctggcagcctgttctttcctgtaggctgaactgatcatattttagtgtcaaatatttatttgggtttgtatatatgttgcacgttgctgggatgccagacgtgcccagactgttatgattatacagggattttcagccttgtttattgatctccacgatcctgcatataacatttcccacagagccagtgcacacttgcatatgtagtcattcaagctgctttagtaaaacagtatgttcaccaagaattttttttaaataaataaaccaattgatatcttccaatgagatgacagagcctctcatatgcagaggagaaagagagaaaaatgactattggaaagcattttgaagagatcgagttggagatgcaagaaatgtgggaaatgaagtaagagttagatgtttccagctcacacaaagaggagtacctgtcatggaacatgaaaagtgtcagccacataggtgcttgtatgcatccatgtgcaggagactgaggaatcagtgtttaattggcaccagcaggcattcaatatatgttcctctttagttagttccaactagcgatacccaaaatatctgagcagaaaatcagggccaggctgcctatagcagagcaactcacagggcaaaataaatacacagattcctgagccccaggaggtagtgtctgaaaatccatatatttttaaccactcgcctcagacgactgtccaggtttgaaaaccactgcacagaaacactttttaggattcagtctggcaaggcaacaggttacaaatgatacattttacgtggttcaaccttactaaactgatgtaatggttattcagagtccagggtgagccataaagcccataggaaaaatgaacagcactttgtagcaagattcaggccaagagaatgggatcaatttaagccataggaactcattttttcaacagctctcttaatggtaggtggggaattcatataacaaacttgcctgtcactgtgtgactcaaggtgtacttggggaaagagaggcccagagaggcaaaagatttgtcctggtgtcacaaccatctggaatttagaaaaagcaccagactgtctttctagcctgtcctccagctagcctgtctggctccccacagctttcctaataaaatctagacttcttaggtggacatacccagcctccacgacccagcctctgcacccactcctcacctccagccatttatcccatacatccattcctccagctactcaaactcctctcttccctgccttcccacaggctctgctccactagaaaagctctcactttccctgatctggctaacttgattcttccttcccaactcagtgtcagaatcccgattctggacattctcagccacttgcagatccgggcgtccctgctctgagccccccgtgctctctgtatcacctgtcttcgtgctaactgcgagtggaattgatttgcccatctgcatgcttcctagactaccaagttgaaggatcatgacaatgtcatttgatttaatatcttcaatacctagccctgtacctggcacacaacaagtactcaataaataattgtaagataatttcggtgagagacctaacttgacagaggctcacagactctgtgtgtcaggaggagacctaggagttaaccctggctctaccaccatctagctggatgacttggagcaaatctcactgtgcctccatttcttcatttttacaaagatagtattcaactaggtcattgtcatgaagactgtcatgtctggtcctccccttctctccctcagccaccaatgatgtctccttccttgacctctgattcacttagaaggatgcttaaggcatttaagccagcagttctcaaagtatgacccatggaacccctgcgaatacctaaggtgtttttaggaatccatgaggccaaactattttcaaaaccaaattaagacattatttgccttttgtactgattcatatttgcactaatggcacataagcattggtgagtaaaatttggtgccttatagcatgaatcaagacagtggcacaaaactattatattctttttttaaatcttcagtatattatttatagtcatcatatccctcattgtcacatatgtgcagtaaaaaaaaatgccagttttactttaggttgttcattttgaggtagtaaaaattactaatgttatgaaatcttgaccctgagtatacatcttttgaatattttgtgtaacagaatgggaagtacgcactcaaataaagtacttctcctatatgcaggagtgtgaatggtcacttccaggaaaagtacttacacgattgagttatgagatgaattagccactttttttaatggaacatcatttccacttaaaaaaccactgacagacgaactatggttactcagacttggatatttggcacacattctcttaagaaaataacaaagttagcctgtcacttcaaggaaaataactggcagaatgtgttgccaatgacaaaactcaagtttggggaaaaaagttgcatcttatactgtaagcttattagcatcccaatccttagaggctaaggtgatgatgatattgacaaatgcaattttgatattgtatagtgaaacatgtcaacatttgtaagattagcacaagtcagtgagctaatagtttccaaataactcatgcaagctagtacaaaatgatgcgaaaaaatttctatccaagtgtaacacagatcaagagattttaatataacagagtacgaagaaggtcatcagtacagttacagattcaacattataactgacctttgagaaaatacgatttgtcaagcttttgtgaggtttaaaagaatagccacaattatctgagaagagtattaaattcttcttccttccatattttcttcacaagtttcaaccaaaatcatatcacagaatacatacattgcggaagatggaatcccacttccattacttccattaagtcagatattaaaagagatttccagaactgtaaagtaatgccatcttgtcattaatttatttgaataatatagttatcataaaaatgttacactaacatgtactattatgtattacagcataattatataacatataattattttagataaatttaaaaatgtttttttaatttgttttaatttctaataccataaatacccatagattaaacaaaagctctgtggggtcttcaataatttatgagagtataaaggcttctgaataccaaagtgtttaagaacttctgatttaaatcaagagtgcttcaggtttgctttggaagctaatgaagctgaggtttccaggacagggaggaagcagcctcacctggccccctctagcttgaagccatccccagcctgaggggtcaccttatatgccctggtagtggtcctggatgcctgtgggtggggctgcagaccacccagtcctcaggaccacttgcttctggtagactcaacacacatccagactctactctaacccccaaaaaggcatctgaaagagaggctgcgcattcccagtggggaccgcctggtccaagaggacttgcgtaaaagtaggggagatgggtggaacaggtcgagggagatcaaacgctggagttttcccaggacttgccaacatgaaagaagcacacttcagcaagaaactgctgagaaagttatggatgtgcataaagaaatttgtctaagctaacaatgaaaacaaaatacaataaatacaattttcagccagccatgctagaatattcattctatcctctttatagaaaatgacattataaaatcattgtccaatgaacagaaaaagcaaaatacagccaaagatgcaggaaagtattataaaagagggttagttaatttatgatactaacaataaaaacatgtttccagcttttgatgtttatgttatctgtcagctttaaagttttcttccttaattctaagaagagtacttatttttgtagctaaatttttattggtaattatattctttttaaaggaggcttcccaaattatataagcttcaggcctcgtgatatctgtttctactcctactaagtttatcttccaggccctgcgcagtggctcatgccagtaatcccagcactttgggaggccaaggtgggcagatcacttgaggtcaggggttcgagaccagcctggccaacatggtgaaaacttgtctccactaaaagtaagaaaattagccaggtgtggtggagtatgcctgtaatcccagctactcaggaggctgaggcaagagaatagcttgaaccctgggaggcagaggttgcagtgagccaagatcgcgtcacttcatttcagcctgggcaacagagcgagactccatctcaaaaaaaaaaaaaaggaagaagaaaatttatcttccatatagtcatactaaacaaaagtatttctcaagctttacctttgacagcttttgttagaaaaaaatacttctgctttgtatatttaatattataatattcactatatttttagaatttcccacagatattctcatatgatcttttggaggctgagtcctccaggtgaaatgctctgaccagattgatttctaagggcccttctggctctgaggggctgtggtttcaggcagctagatgaaccagcaaaaatgtttgtggccaggaaagggacagaagtggggagacaagcaacatttttggatcaaagttaaaaataaaaactctctgctttcagctacttttaaactagactttatttatgggaaaagtagataacatggagggccaggggttttcagtcttgaagagagggtgagaaatttggtgagtcaattggatggacgagggatagcagaaaagggaatgaatgaattctgactttttctggctcaattagctttgcgatatactgggctcgaaggaatgcttctcaggatgtcacaatgttaacagccttttttttttttttttttttgagatggagtctcacactgtcacccaggctggagtgcaatggagcgatctcggctcactgcaacctccgcctcccaggttcaagcgattctctggcctcagccacccaagtagctggtgttacaggtgctggaccacacctggctaatttttttatatttttagtagagacgggggtttcactatgttggcccggccagtctcgaactcctgtcctcatgatctgcccgcctcggcctcccaaagtgctgggattacaggcgcgagccactgtgcccggccagcatttcctatttagcaagaacaaaaatcccaaggattcataatcagggttccttgattttttttagattgtagagttcttagagattctgatgaaaactatgaaccctctccccagaaaatacatatagtcacatgtacacgacattttaatagatgacttcggagggttctcagaccttctcaagcctatccatgaacctttggttaagaacccatgacatagagagaagccatgtaatcccacccacctctctcctaaatgggttggttgggcttggtagtcatccatccacctctcattcatttattcatcttccattcatacacacatgaatcatccaatcattcattccgttttcatgtatttatttatacaatggagaatatacgtcagtcctgatggctctacccattacctcttcttagagaccccaccctccaaagtccatctgaatgggatacatatggactccagaccaaagaccatcaaaccctctttctcaggcatctgcaattgaggcactgagaaactgagccagtctgatgatggtgatctcttgaatccaaagggcatatagaaaagcttggaagaaacagaaattaagtccaatcatggtggcatatacctgtaatcccagcactttgagaggctgaggcaagaggatcacttaaagtcaggagtttgagaccagcctgggcaacaaagcaaaagcctgtctcaccaaaaaataaaataagataaccaggcacagtgccatgtgcctcttatcctagctactcaggaggctgaggcaggaggatcacttgagcccaggatttgaggctgcactgacctatgaacatgccactgcactccagcctgggtgacagaaaaaaaaaaaaggaacagaaatcaaaagactttcagagagaagagataaccaggaaaatagagtaaacgtgaagggagatgcagagttggaaacagacctgctgactttctgtttcctctgagatttatctgtacttcctgcaattgagttctgttagagtcttctgaatctttatagtaactcctttaaacattagcttacatagtggattgctgatccttggaagtaaaatcctggactaagttctgcaaacaaagtgccaaggggatgttagccacctcacctatgctcacaagtggatgaggtgagcaccatgattatctccattcacaagtgaccacaccaaagctcagaaacttcagtaacccattgtcattagaagaaaagttcagctccttctcatcttctacacatttatatgtcctgatccctaaaaccctctccaccttcatctcctatcagactcctcacatatgatattccaagcatgttagatttttttcttcactgagttcagtctgacctcaggacctttgcacttgccattttctctggaacacatataacttctctgtcttgaggctgactccttccttcctttcagttcaaacattacctttgccaagaggttttctctaaccagctcagggcaactggcatcttctctgcccagtcaccactaaatactctaaatttagctctttgcacaacctgagatttatttgtttatttgcctgtttactgtcctccccattggaatacattcccagggaacacagcacttgcctattccttttgcctctattcccagtgcctgaaactttgttcagcacattctagaagctaaatacttgttgaataaatacatttgcccaagtcaaacagcaagtaagtgatccaggcaaaatgtaaaggtttatctgattccaaaggccttactcttcctaatccattagttccttctcattgttaaatttcaataaaggttttaaccaaaagattataaacaagcaatttaggccaggcacggtggttcacacctgtaatcccagcactttgggaggctgaggcaggaggatctcttgaggccaggagttcacaaacagactgggcaacatagagagattttgtctctaaaaaaaaaaattttttttttaaattagctggacatggtggtgcattcctgtagtcccagctactctggtggctgaggtggaaggatcacttaagctcaagggtttgagactgcagtgagctatgatcgtaccactgtactccagcctgagtgacagagtgagaccctgtctcttaaaaaaaaaaaaaaaaagagtgatttataattagaaatctacaaatctagactataagagaggaaaatactgcaagcaaaggaggagaaacatctgtttcctatttcatgttaagataaaatttatgtcataaggtctggaaacatgcttcattttacctaatcatttcttcttaaaatttctgtaggaattgatgggttttttctttctcagctgaaattctactctaaaagcattagggaatttgttatttaaatgtggcctaagcaaatccttttgcacagccaataatctcaccttaatttctcctttaaaagctgagttttctgcactagtttttttttcttttttctttttagtaaattctaatatgatgcaattttcatagctggtggacttcttagattggctttatttttggcttaaagatgcatttccaatgcaatcgtatagatgtctagtgctctgtatacaaacatcctgagacccagttaagcagataattgaaacttcaagatgaaagagataaaacctaatgacacaagcgcaggatgtaccctgctgggttctctattcccagacatatttctctggttcccttgcattcttgtaccctcattcaaatgtcctttatccccctggaggtcatgtggattcctgtttgtttgggaatgctatgagaactgctcttctaaaggaagaaagagatgacattccagcctttcagagaggtcgcaccaaggatccaaaaaggaaaaagtctcttccatccacttacacatggaaagctggagattttttcccccttgatttggaaagatatgctgaatatctcaaccaatgaaggttccagcagctggccatgctatctgtgttcagtcatacccggagggtgagagtccctccttaaacaacacatctcagctgcctgtcgtaggcagagctgaacatgtcattttacctctgctcatgtctaagtgctctggctatttctggctattttcaatgatttccagagccctggcctttctcctaggcaggacaggttcttctaagcagcagctgagctgaggctaaatgtcctaaccaggaaatcacatggtagaaaattcgtaagtcaaaaatcaatcaacaaaaatccatctctccccttcacggcctggtccctagcatttatgagggttcctcaaggcagggctagacagtggcccacactaggcgtcagggagatcagactgaaatgaggagtggagataaagccattcagcaaatcacactaactttaggaggcaaggtctcctctgggcaaagagaaagcctttgaggaatatctgcttcttcaagatggaaagcatcattatctgaccagcagcaaagtggttctaataatgtcaagtataatgtaatcttaatgtagcacctatatctcagagaggaggaaggatgcttactgagtttctactaggcacttctgtgtagattgcaccactcaattctctccttaaccctagaagataggtacattattccccctttatcaatgaggaaacagagcttcagagaggtgaagcaacccgctcaagatcacacagctctgagcagcagagcccagatgcaaatccagtccagtgggacgcacgccactgccccccacctctcccccaacccacgtgaggacgagcatcttgaaaataagccaataccaagcactgaagcagccattatgcaacagcagcttgcatttgttgagtgctcatcctgggccactcattttttctaagtgcctggtttgtatcatcaatctcagttaacacttgcaataaccccatgaggttagctgcttttattatttttcttttcagatgaaatacctgagtcgcagagtggttaagtgccatgccagggtcatacagactgtaggccttgcttctgggctttgagttcagcattgtagccccagagcccccgctgaatccaacgactgcttcctaaggacttgcaacaatgccgtgtttctgagaatatgagtatcctatttcccaagttggttccccaccccaccatgcagtgtccacccaacagcttggctgagcctgccatctctccttcctcctcctaagacgccttgccctctgcataggagcagctgatcctctggaaggcccaggtgtgcatggctggagctgacctgcccctgtcaagtttgtagcagaggaaacgatcccagtttcccatctgacatggcccttcagcaccctagttcctgtgttccaggcatacctgtaatgtttccacagattctaaagccatccaggccaaaaggcttatttgcttcttcaatcctccagtgtttttcatagtaccaggcctactatgggagctcagtaaacacatgtttaaagacacacctctcttatttcacccagagcccctgaaaatgaattcccacgtggtggcgggtgcctatagtcccagctgctggggaggctgaggcagaacaatcatttgaacctgggaggcggaggttgcagtgagccgagatcacgctactgcactccagcctgggtgacagagtgagactccgtctcaccaaaaaagaaaaaaaaaaaagaaaatgaattcccgttgccagttgctcttcctttccccaggtagaatggcctaatagaaaggagtctttgcagttaccgacctggatttgtgtccccaccccagcccccttatgcactgtgcagtcttcagcatcatcctctccgggactgtttcctctttggtgaagcagggcaataccttgccttgcagtgttcttgttgggctttcaaaagaccattatataagaggcatggccgaaagtaagtgcttaaaataagaagactgctctttcctgtcctctattcttactgagtttagcctttacaacgcaatggctgttacaaaaaataaaaaaatgaaaaagtcttcagatgcttctcttcccacggccgcatagggggctgaaaaggagcactttaaggttctgacagcgcatcctggccctgttgctcccttgctgtgcagtcttggccaagtcacttaacctttctaggcctcagtttcctcacctgtcaactgtgaagatctgggctaaataatctctcaagggtccacgagtccaaggtttccctgatcatagttactcagtgctcctacttaaaatatttggaaatgaatattcttcgcctctatgaggccagagctcctttttcccatctaaacttgtggagctgtaagcaatttaccccagagatgctgatttacccctgggctgccttcccgagaataagatggttgatggtgtcctgtgtgtgagcagtgggctgcagtgaccaggcctgtgcagggccatgggtctgggcaggacctacctgtggcaagtcactgtgctctcagctcgatttattttatttttaaaatgggggtaggaggaagaggagggaaagtttgcattaagcattttaagttgtttttacattacaaaagcaataaaaacatagcaaatttgggaaatagatgttaggaaaaaaaatcatccagcattttatctaattcagtcactattagttattattttggtctttctcttaaccctttttcatttgtgtaatttacctagtagatatgtaacttgtgtcttttttggtttttttcttattttttttaacagtattgtcataaaaatttgcaagttgcttcatgatctttgcaatcactatatcatgatgcatatttcttttgtcattctatgtgtttgttggtttgtttttaactactaaagacaatttttattttattatttatcaatataaagctacattatatctttttgcatatatatgcatatatgtgtgcacaaaggtgtgcatttctaagagaatagattctcgggaatggacttactgcttcaaaggatttgatcatttgcacagcttttggtacatgttgtcagattgctttccaaaggggctgcactgatttactatgccatcagcgattacccattttgctgcatcttaaccagaactggttattatcatttaaattttttggagatttaataggcaaagcagtgcctaattgttttaatttgcatggcattgatgaactgaggaagccaatcatttttccatatttttgttttcctctcccttcctaggatcaagtgatttctgaggcactttcatccccagcttctaacactttaggtctgggagcctctagggaagcagacagatagcacaagattgcaagagtcagacaggagactatatggagatataaatgatgacattaaggggttactggacagaggcagaggagaaaaactaagaattaaccaaagaacacctaagaagtgattctggtcaaacttaaaaggtatctcccctcttctgtttggcagctcccttgatgtgcaatggaaataatgcagttgctctctcttctgtgattagaaagagaaaatgagaattcattcatgagataaaagttaaaataatgttggtattatttacagtgagatcccatttaaggctgattttggtaatcaagactgataccttcatcgaagacagataaggtgtaccaggtgtttcctgtatctaattcatatgtttacggtacgggaattggtctccctagtaaatgaatctctttgagaaccagctgtatcttttatgatgggttcattcaactaactggcttaatcaaaaggtcagtaaaaagctgtaacctttaaaacactggaggcttaccagttgctccagagatacttcatcttccctttcacatacttacttcaatttttcccatgtttcttcaccaaatttctctatcacaagagattgcagacaggtgttgataaatccatactagaatacaaaaccagaagaaaaatatatattatgaggcatgaaatccccagtcatacacatcttcatgtcttttaggaaatgtgcaatggcatcctcttggagaaactaattataccttttccttgtttctcgtgatttaatttaatagctctgctcattcccaacttaggaaaaacctggcaccccaccgcttgggttatttctatatagaaaacatatgaactacatttgaaatcaaattgtaattagagaaagttaaagaaagtatttactgtcaattataatcctctccgaaataaggaactggtttgttagaacaaagaattcaaaaacacaccagtggcatggaggtgtttagacctggcagaaaggaagggcacacacttcatgtcgattccaaaaaggcagtgacaggatgattttttttttctttataaaaatgaatctatacctgggtgtgtgtgtggagaatataacgagtgcaggaaaacagaggaggaaactccaataagaaagacagcaccaggttaacagaaagaactgtcttctgggtttgctcattaatctgtgctctttcttcttcctccatcagagaaaaaaaaaaggaggacccatgaacacttctgcttagtgagggatagtgtgccccaggcaggccacctgccttccgcaactcggggctcctaacacaagcagggtgattgagttatgtttgaaagcactgtgtgagctcagctttcaaaatatttcttcctgaagggaagaattcttttgtcacacaaatatcaggctccagatttattttataagtttggattttcatatatataggaatttcttaaagtgaaagagcccagtgccaacaggaaggcgagtgtctaaactctggtagttattttccagaaatggaaatatttgtcctactgggctatatttccagttccccaccaccaatgtcatccttactccttactccatcttgtcccgcctctacgctccccaatatgtgcccgcaccctagcctggcattcagagcactctctagaactgtcttaatttgtttcattttatcacctactcctgctgccttaggctcatccaaaatgcctaccacccttccccaaacagagatgtcatttcttcaatggatagagtttcctcctttctcacccagtcagcccagggcaaggccaggctctgaggctactgggatactgcctggtctgcagaaccatttcctctccctctgccagacccagccatcattccctgtcaggctcactgctggatgcctctgtgtcctcaacaccacagagatggtgtgttaactatcacatgcacacgctcgggttttgtatctgtcaacacacacatatatatatacacacaggcatgtatgtatgggtgtgcatgtatttgtatatacttatatatattatgtatgtttatatgtggccatgtacacatataaatgcatatgtgtgtatgtatatatatatttttttcctgtcctttgttaaattgcaagctcctcagggtcaggaagtaagtgtcatttatctatattttgactaaagtgccaagacactgtctgctacacaggaggtatttaacaaacacttatcgagcaaggaagtactgaaatgaagcctcaagtctcatgaaaatctttaaataacccgttattcaacatcaatccaatgtaaacaaagatagcaattgttcaacttagcaatctttgcaaaagtatgcccaatcaaataaaacatcatgcccactgcccgagcactagagacaaacttctagtgtgtaacaagggaaactgaggcagtggggaatttgaagtctgctgctagttgataaccacatcacctacttctaggtcatgaccaccccgatagtgtgcctctgtttgatgaatttagggccattgagtcatgtggtccagcatttgtctttggtgttcagcagttccccaagctggtaccagagttaatcatttagagaccttgagcttatagatcagagagtggccccctcaccctctactgattataaacatgtccctttcctgtccactgaaatcaggtgactttctctgcccctggagagagcaaaagaggcaatgtatcccacacgatgtgtcgagcatatgcggggaccttggtgtttgctgcccacacccaggtggagggggatacttggtaggacacactccctacacatttgagggcctcactgaaataagtaagaatggcaagccagcaccaaagttctctaaccatctggaactagtgctgctcaaccagtgagatcagcaagcaggcagggactctcatttgctggtgacacccaaatctttcagaggctacttgggccatggctgcagcacccccaaaaacatctgcgttccaaagaagcaattaaaatgtctgaaaatgttaaggtttagccaaatctttctcctgtaaagatgttttcacattccatatccagtcctactcaccgtgcctgccaggcattggctggggaatgtggcttcaaaataaaatgcagtctcagtaagcccagagagggagtacagcttaggagaaagggtttgggctctggagccagaagggtttctgtttctgtgacttgtagctgtgcagctttgggtaaattgcctaacctctctgagcccagtctgctcatgagctaaagtggacataataccgtttgctgtgttggaggatggttgttggggttatagagtaacggttctgaagttagaccatgagggctcattgctgaccccaagtcttatttgctgtttgactcaagccagatcttactcaccctcagttgtctcatttggaaaatgggggtgagaatggtcccttcctcatagggttttagtaagcattaaatgaggtaatacgtgtgaggtacttggcacatagtaagcgctcaggaaactgtagcctcttagataacaggcattttgaacaataggtgctcaacaaacagaagcggaaggaaagtcagggccaagggtgctgagagctgctcaccatgttcctgccgcagctgctcctggggccacagggattgagatgcagcaccaagcgcccgcccttcctgccagcccctagtcactcaggagagaatccacagcgtctccagaagcctgtcttgtagaaatctgggcagtccacagtgaaattaggagctcatcactagcctccaagcaaggagcacactgttgggtcctcagtcacctgcggggtaaagcataaggccgccccctctggtgagcaagtgggacctgctgcctggcaccccaagtcgtgcacaccccagatgctaagctctcaggagttcagcctgaaacctgaagcttctccccgaggtgccaacggcacagaacgcctttctgcaagcacagaaaagcatacacccctaagctcctgtaggaagactgccttgtagatgaggctgtctattgagtgatctttttagtgtatctttaattaaaccacgttggatgccatccaagaacggcctgccttgaccaacacttggccctacagtgtcataatgggaagtcccctggtgccttgagccttatcctccatccccatcactgttccgtttcaggctctggtgggctgtttgccagaggtctatttcctgagtattacttgtggtcagaggtgagaaatccagccactaaccaggtccaacaaatgtcgcctgtagctgttccaacacacatgctagctttggtgtaaaaacagagaacaaataaatacatttagtaaaatcaaaggctggggtaagccctccaggcagtgtggaggtgtggggcactagagggatgtgactcatggttaagacagtctgtcgaggaccacaacgccacagactggggccgtccactgaaacgaacgtccaggcatcgcacgccctcctggaagacttcagcatctttcccttggcatccgaagtttgctgaaagattcttcccttctcagtaggcactccttcactctccgctgttggcctccctctcctatcctgcctgcccttctttctgtcactctccttagaaagacttcctggtcctccttccactcagcctttctggctcctttgcttttactctccctgcttaactcacgccagctcctccatagaaggacttgacacctggagagactggtttcagccccctcttctttctgaaatggggactttacttattctcaaaagctggactctatgtgctgctcctctgtggaaggaacatgtggtcaggaggagaaaaaaaaaaggctcaggaatagatgatttccataattacgcttcgcaaacccttgcctccattcagctgacactctttctttctgccctgccaagcgggcttgctctggcgctctctcacaaaccccctccccacccccaacccgctttttcaaacacatacaccagcaccctcacatttcacaataagtaaatggtttaaaaaaaaaaaatctccattttctttttcatgcggcagatggcagttctcaggaacttggtggaaattaggctttctgattttctgataaatttcaacatctcacacaaaaagcacaagctcattttgattctgatgttaagtaccatatggcatatcacccgtggaacgtggcagcttcataaccagggtaacaaggaagggagggtctttcctgtaacaacgaggctgagtgggaatgaaccaattggattcctgggtgaataccatttgataataatattgtatatgacagtggagtaattatccctcttttatggtatgtgttaattttcactgccagtttccctaattacaactgccacccaacggactactttttgtaaatactctgtaaacatttgaaaagacatagacagtgcttgtaccaaaaaaaaaaaaaaaaagtccctagattttgaaactgtctggaaaattggctgacgttttatatgtttttcaattgcatagacagccagggaggaaatttcactatatggaaattccccttctctcctccatgacataatggacctccctgccgatactgtgactgttgttttgagggatatttttcgctgttacctttttctatattaagtgcgcagtttcatgatctttgacaaatgtacactattgtgtagctcacaccctaataaagatatggaacatctctgtggtcatggaaatttccccggtaccccttctcaatcagtcctaccaccctcagctgcccctattccgattactatcatattatcgccacagactagttttgcttgctcttgaacttcacgtgaatacagtctgttctctgttgtgcctggcttaacttgttaactcacttttggtgcattgaagagttcaaacaccattccccaaattagtaacatgtatgtaaacacagtctcgcttgatgcgtgtcctgtgataagtgatgagatccaataagccacatctcatctcccgtgatctatgtatgatgtgcgatgagaaacacaaatcttttatttttcatggacttgcagggagggcgggataccattgggaggtcgctggagtaaacctctatcatttaaggaaagaaactagagggagaatgcaaggtaagagtgtctgagaggaagataggaccctgatctggtttttggtggtttgtttgtgcatttctgggaacgcagctgcctcattcctggtaggaagcctttcctgtggttgatttgttgcccccagtctacctcagactgcctggcttctgagccgctgctggctttctttccaaggcctacatcagcagaggaaggtgtccccggacacaagacagggtgtggctgaagctgggctcccagaggcccgtctgttaaaaaatacgcccccaccccccaccccccaggcctgccaggtctctgaaattctcattccttttagctacaacttgggaaacttctgacagaataaaaatatattcctttggctgaacagattagctagtattcacctaagaaggaaaaggacatagaacagttcaactttgatgtgtgtgcttcagagggactgagaggatcaatttccacatcagtccaaggcatagagtgctctctgagaggcaggctctgcagagggaggtctccatcacctagggaccgcagaggcacagaatgaaagagttcagctttactcgtgtggcaggtggtactgggatggccttgagttttctcccttggtaggattaatatctcattgaaagatgtcttgaggctgggataacctggctaaaggtggagctatgataaacagccagatctcttttggcatatttgcgtattagaaactttagtatgcagcaacaactgagtcagctatcagtaagaatcttcaggaaaaaaataaccagaagacagggcggtttgttttcctaaatgttcatagtaagtgcttgtactcttttcatgccagctgtaataataatcactcactttcaccaagcctcacaatatgcctggcacaaagcactttccatgttttagaatgagccacatgaaattgccattttttacaggtcaaagactttagaattgaacgaactgaaccacttgcatttcgttctacttaatattaattcagccttaccacaatcctatagtgtaggtcctattatcataaacacccttgactgatgggagcattgaggtgaagagacatgaagtagcttccttgaggctccaaaactagttagtgtcagagctggtattcacaaccaggcctatgtcctatatcaccttcaagagaagaataaaactagctgctgttaacccctctcttttttctggaagaggtttaggcctgtcttggagtcagacaatatcttcagaaaaaaaatctctttttccaggaatgtcaaaactctggcttatgtgagcccattttatttcatcagccacactggaaagtgaggtttgattcacacatgtggttgagtacaatgttgtgaaaaacacctgaaaatgggctctgaatgtggaattctgaatcctttgatttcagacaagaggtcctttgatttccccttaggatggatgaaaccagcaagaactgaggcatttcctacagggtggtaaccagctagtgaacccagctcacctcctcaattgctaacggccccatactcgttgacaatgatatctgtgtattctaagaactagagggcagggctctttccttttcagtttgattttcaaatcttcagcgatgcattaagaggaccagcgggattgctgagcgtaaagcgccaccgtgtggccaaagccccacatgccaacaggacgctgtgtaagtcattcccgcaggaagggaggcaggaggtgtgtggctctgaagactcacaaatcctgaccaggtgcaggatcatggctcagaggactgggctcaagtctgagtcttcaccctgcaactggtacttgaggtctggagtaatcatgaaaaagtcctctgtctttcccaagtgatagtgcccctcagtgtaaaatgaggctacaaccttctccaggtgcagtggtcccagaactgcaaagagaatatacatctgactttgtacattatgtacagaacccaggcaagaatggaggtgaggtctcgcaacactggcactcgaggtaagggctcctcaagaccaaagtcaacaatcttcaaatctaacctaatctatacttccatttgataaaggaaaagttgcaaataaaccaggtgatctggggactatatataaggaggcatgacaaaaaaggattgttacattgtaaccaactgaatgtaacttgcagatttatgtattttgagagccctaataataataataatatgaactgaatatttattgtgcttactctgccagacaccaggccaagggctttatgtgcattatgctatcaggtgctcatgagggtcccatgagcccaatcttaaccacaagtcggtgcagtgctgtcttcttcaaaacagctttctcaggagactgtacttcctccaattgaaacattttgagaatttctcttttacagctactttcagagtgtgtggcacaatttttgaatatcctaagtgatagcaaatcaacattctttcattatgacaatagttaacagttactatctaccaggcactttaacaggtgtaaattcatttaaccttcaccatgacactatatgttaggaaatgttattatcgtgcccaattcccatttgagaaaaataaggcgtagagggcctaaatcatctgcccacttttacacagccagggcctcaggcctgcagcttggatgagaccgtgtgagacagggtgaggctgggtagttttttctttgcatgagggggtactcgggatccagagtccatccgcactcccacccagtgcaggccagagaccactcagtgaaaggagcacctaagtcatgaatgacacttcagctgcccgtgggcttctgctacaggcaactgtctctcagcagggcttgagttttagaaacagtcagaaggagtgcagagctgggtctcatgagacaggttagtgagctttcagctgtggacagtccgattttgaataaaaattgagactgtttttctcacctggctgtgaagcctgctccaccaaccctgccggtctcccatgccgcttcccctctcgccctctgggctcagtccgcacccttggagcacttcctgctcattggcccactctttctcgaaccttgcttgctcctcctctgcttagcttctgcatgctggggtactccaggcctcaggtgtcagcttcctccctcttacatctccactcagcacctaggtgacctcacctccctgtggcttcaaattccacctctgcgaggatggccccgggattacaccctagaccaagccattcccctgagctctacacaaagatacctaatttcccatttgacatctctacttggaggtctacggaaagctctaagtaaacatacctaaaatagatctcttgatttccctcgccaccaaatacccctgcccatcagcccatccctcattcaactcaataaagggaacctctatcacgatcccatgtctccatatcgaattcacagcaaacctaaatactggaaggttctccttcagagttgatcctaaatccaatcatctttggttacttccctatccccaccctgatcaagctactccctcaggaccctacagagctgctcaacagctgtccccaccccacccccatccccagtcaaaacctcacccaacagccagaatcatcttttaaaaacgtgatcagattgtgttattcccttgctcagaaccctcgagcactcctgggcaccttccttccttctcctcaagatcccttgatgccgtttcacatggagccttcctttgcctgggcagttctcctcctggtctcctcctggtcctttgcctgggcagttctccttctggtctccattaatcccccatttcattccattaaagtgtcaccacctctgagaggcctccactgactgaactccccaccttccgcctctctacactctgtgcctttctccaccagacttcacagcatttcacccccggccctttattctacgtaaatatatatgcatgtcatagatgactacttattgcctatacacctctgcccccaaatttaaaatctctgaaggaagggatctggtcctattctgccttcagggcctagaagagtgcttggcaaatacgggtgctcagtaatgcactacagatcagtcagggccatcttggagctgcctcgcatgagccataatccctctagcacagatgccttgcatggtattccctcggcctgagtctctctccatggcccatggctcttgacttttttttttttttttgtactttaagttctagggtacatgtgcacaatgtgtaggtttgttacataggtatacatgtgtcatggtggtttgccgcacccatcagctcatcatttacgttaggaatttctcataacgctatccctccccaagcttcccaccccgcaatgggccctggtgtgtgatgttcccctccctgtgtccatgtgttctcattgttcaactcccacttatgagtgagaacatgcagtgtttggttttctgtccttgtgatattttgctaagaatgatggtttccagcttcatctttgtccctgcaaaggacatgaactcatcattttttatgactgcatggtattccatggtgtatatgtgccatattttctttatccagtctattattgatggacatttgggttggttacaagtctttgctgttgtgaatagtgccacaacaaacatatgtgtgcatgtgtctctatagtagcatgatttaaaatcctttgggtatatacccagtaatgggattgctggatctaatggtatttctagttctagatccttcaggaatcgccacactgtcttccacaatgggtgaactaatttacactcccaccaacagtgtaagagcattcctatttctccacatcctctccagcatctgttgtttgtgactttttagtgataaccattctaactggcgtgagatggtatctcattatggttttgatttgcatttctctaatgaccagtgatgatgagcattttttcatatgtctgttggctccataaatgtcttcttttgagaagcatctgttaatatcctttgcccgctttttaatggggttgttttttcttgtaaatttaagttctttgtagattctggatattagccagttgtcagatggatagattgcaaaaattttctcccaatctgtaggttgcctgttcactctgatgatagtttcttttgctgtgcagaagctctttagtttaattagatcccatttgtcaattttggctttcattgccattgcttttggtgttttagtcatgaagtccttgcccatgcctatgtcctgaatggtattgcctaagttttcttctagggtttttatggttttaggtcttacatttaagtctttaatccatcttgagttaattttgtattatgtgtaaggaagggatccagtttcagctttctacatatggctagccagttttcccagcaccatttattaaatagggaatcctttccccatcgcttgtttttgtcaggcttgtcaaagatcaggtggctgtagatgtgtggtgttatctctgaggcccctgttctattccatttgtctatatctctgttttgtaccagtaccatgctgttttggttactgtagacttgtagtatagtttgaagtcaggtagcgtgatgcctccagctttgttctttttgcttaggattgtcttggctatgcgggctcttttttggttccatatgaaatttaatgtagtttcttccaattatgtgaagaaagtcagtggtagcttgacggggatagcattgaatctataaattaccttgggcagtatggccattttcacgatattgattcttcccatccatgagtatagaattttcttccatttgtttgtgtcctcttttattttggtgagcagtggtttgtagttctccttgaagaggtccttcacatcccttgtaagttggattcctaggtattttattctctttatagtaactgtgaatgggagttcactcatgatttggctctctgtctgttgttgtataggaatgcttgtgatttttgcacactgattttgtatccggagactttgctgaagttgcttatccacttaaggagactttgggctgagacaatggggttttctaaatatacagtaatgtcatctgcaaacagagacaatttgactgaatgtagacagtcagagacaatttaactgaataccctttatttctttctcttgcctgattgccctggccagaacttccaatactatgttgaataggagtggtgagagagggcatccttgtttgtgccagttttcaaagggaatgcttccagtttttgcccattcagtatactattggctatgggtttgccataaatagctcttattattttgaaatacgttccatcaatacctagttcattgagagtttttagcatgaaaggctgttgacttttgttcaaggccttttctgcatctattgagataattatgtggtttttgtcgttggttctgtttatatgctggattacgtttattgatttgcgtatgttgaaccagccttgcgtcccagggatgaagccaacttgatcgtggtggataagctttttgatgtgctgctggattcagtttgccagtattttattgaggattttcacatcgatgttcatcagggttattgacctaaaattctcttttttgttgttgtgtctctgccaggctttggtatcaggatgatgctggcctcataaaatgagttagggaggatttcctctttttctattggttggaatagtttcagagggaatgacaccagctcctctttgtacctctggtagaattcggctgtgaatccgtctggtcctggactttttttggttggtaggctattaattattgtctcaatttcagaacctgttattggtctactcagagatttaacttcttcctggtttattcttgggagggtgttgtgtgtccaggaatttatccatttcttctaaattttctagtttatttgcgtagaggtgtttatagtattctctgacagtagtttgtatttctgtgggatctgtggtgatatcccctttatcattttttatgccacttatttgattcttctctcttttcttctttattagtcttgctagcagtctatctattttgttgatcatttcaaaaaaccagctcctggattcattgattttttgaagggctttttgtgtctctatctccttcagttctgctctgatcttagttatttcttttctgtgctagcttttgaatttgtttgctcttgcttctctagttcttttaattgtgatgttagggtgtcaattttagatctttcctgctttctcttgtgggcatctagtgctataaattcctctctacaaactgctttaaatgtgtcccagatattctggtacgttgtgtctttgttctcactggtttcaaagaacatctttatttctgctttcattttgttatttacccagtaattactcaggagcaggttgttcagtttccatgtagttgtgcagttttgagtgagtttcttaatcctgagttctaatttgattgcactatggtctgagagacagtttgttgtgatttctattcttttacatttgctgaggagtttttacttccaattatgtggtgaattttagaataagtgcaatgtggtgctgagaagaatgtctattctgttgatttggggtggagagttctgcagatgtctattaggtccgcttggtccagagctgagttcaagtcccggatatccttgttaattttctgtcttgttgatctaatgttgacagtggggtgttaaagtctcccattattattgtatgagagtctaagtctctttgtaggtctctaagaacttgctttatgaatctgggtgctcctgtattgggttcatatatatttaggatagttagctcttgttgaattgatccctttaccattatgtaatggccttctttgtctcttttgatctttgttggtttgaagtctgttttatcagagactagaattgcaacccctgcttttttttttttgctttccatttgcttggtagatcttcctccatccctttattttgagcctatgtgtgtctttgaatgtgagatgggtctctgaatacagcacactgatgagtcttgactctttatccaatttgccagtctgtgtcttttaattggggcatttagtccatttacatttaaggttaatattgttatgtgtgaatttgatcctgtctttatgatgctaactggttatttcacctgttaattgatgcggtttcttcatatcgtcaatggtctttacaatttgacatgtttttgcagtggctggtaccagttgttgctttccatgtttaatgtttccttcaggagctcttgcaaggcaggcctagtggtgacaaaatctgtcagcattaacttgtctgtaaaggattttgtttctccttcacttatgaagcttagtttggctggaaatgagattctgggttgaccctctccctctccctctccctctccctctccccacggtctccctctccctctctttccacggtctccctctgatgccgagccgaagctggactgtactgctgccatctcggctcactgcaacctccctgcctgattctcctgcctcagcctgccgagtgcctgcgattgcaggtgcgcgccaccacgcctgactggtttttgtatttttttggtggagacggggtttcgctgtgttggccgggctggtctccagctcctaaccgcgagtgatccgccagcctcagcttcccgaggtgccgggattgcagacggagtctcgttcactcagtgctcaatggcacccaggctggagtgcagtggtgtgatctcggctcgctacaacctccacctcccagccgcctgctttggcctcccaaagtgctgagattgcagcctttgcccggccgccaccccgtctgggaagtgaggagcgtctctgcctggccgcccatcgtctgggatgtgaggagcccctctgcctggctgcccagtctggaaaatgaggagcgtctctgcccggccgccatcccatctaggaagtgaggagcgcatcttcctggccgccatcccatctaggaagtgaggagtgtctctgcccggccgcccatcgtctgagatgtggggagcgcctctgccccaccgccccgtctgggatgtgaggagcgcctctgcccggccgggaccccgtctgggaggtgaggagtgtctctgcccagccgccccgtctgagaagtgaggagaccctctgcctggcaaccgccccatctgagaagtgaggagcccctccgcccagcagccaccccatctgggaagtgaggagcgtctccgcccagcagccaccccgtccgggagggaggtgggggtcagcccccgccaggccagccgccccatccgggagggaggtggggggtcagccccctgcccggccagccgccccgtccgggaggtgaggggcacctctgcccggccgcccctactgggaagtgaggagcccctctacctggccagccgccccgtccgggagggaggtgggggggtcagccccccgcctggccagccgccctgtccgggagggaggtggggggtcagccccccgcccagccagccgccccatccaggagggaggtgggggggtcagcccccgcccggccagccgccccgtccgggaggtgaggggcgcctctgcccggccgcccctactgggaagtgaggagcccctctgcccggccaccaccctgtctgggaggtgtgcccagcggctcattgagaacgggccatgatgacagtggcagttttatggaatagaaaggggggaaaggtggggaaaagattgagaaatcggatggttgccgtgtctgtgtagaaagaagtagacatgggagacttttcattttcttctgtactaagaaaaattcttctgccttgggatcctgttgatctgtgaccttacccccaaccctgcactctctgaaagtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggcctcagggtcctctgcctaggaaaaccagagacctttgttcacttgtttatctgctgaccttccctccactattgtcctatgaccctgccaaatccccctctgcgagaaacacccaagaatgatcaattaaaaaaaaaaaaaaaaaatacttgagattaaataaatctaaagaggacaactaaatgtactgagtgatgatagatcctgaaccagaataataattacttacaaagggcatcgttgagacaatggatgaactctgtatatagggattgtggtttagataatagtattttatcaatgttaaaaaaaaaaagaaaatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggtgttctctgtatttcctgaatctgaacgttggcctgccttgctagattggggaagttctcctggacaatatcctgcagagtgttttccaacttggttccattctccctgtcactttcaggtacaccaatcagacgtagatttggtcttttcacatagtcccatatttcttggaggctttgctcatttctttttattcttttttctctaaacttctcttctcacttcatttcattcacttcatcttccatcgctgataccctttcttccagttgatcgcatcggctcctgaggcttctgcattcttcacatagttctcgagccttggttttcagctccatcagctcctttaagcacttctctgtattggttattctagttatacattcttctaaaattttttcaaagttttcaacttctttgcctttggtttgaatgtcctcctgtagctcagagtaatttgatcgtctgaagccttcttctctcagctcgtcaaagtcgttctccatccagctttgttccgttgctggtgaggaactgcgttcctttggaggaggagaggcgctctgctttttagagtttccagtttttctgttctgttttttccccatctttgtggttttatctacttttggtctttgatgatggtgatatacagatggttttttggtgtggatgtcctttctgtttgttagttttcctttaacagacaggaccctcagctgcaggtctgttggagtaccctgccctgtgaggtgtcagtgtgcccctgctgggggggtgcctcccagttaggctgctcgggggtcaggggtcagggacccactcgaggaggcagtctgcccgttctcagatctccagctgagtactgggagaaccactgctctcttcaaagctgtcagacagggacatttaagtctgcagaggttactgctgcctttttgtttgtctgtgccctgcccccagaggtggagcctacagaggcaggcaggcctccttgagctgtggtgggctccacccagttggagcttcccggctgctttgtttacctaagcaagcctgggcaatggcgggcgcccctcccccagcctcgctgccgccttgcagtttgatctcagactgctgtgctagcaatcagcgagactccgtgggcgtagcaccctccgagccaggtgcaggatataatctggtggtgcaccgttttttaagcccgtcggaaaagcacagtattcgggtgggagtgacccgattttccaggtgccgtccgtcacccctttctttgactcggaaagggaactccctgaccccttgtgcttcccgagtgaggcaatgcctcgccctgcttcggctcgcacacggtgcacacacccactgacctgcgcccactgtctggcactccctagtgagatgaacccggtacctcagatggaaatgcagaaatcacccgtcttctgcgtcgctcacgctgggagctgtagaccggagctgttcctattcggccatcttggctcctcccaatattgggcttttataatgaagcttaaaagggaattgggctgggtctgttaggactagaacatcttgtgatgctgtatggttggctagataatggcttcccaaagatgtttccatcctaatccccagaacctgtgaatgtcattttatatggcaaaagatattttgcagatttgattaaattaaggatttggagatggagagattgctcaggtgagagtgatgtaatcacaaagatccttataaatgggccgggcacgtaggctcacacctgtaatcccagcactttgggaggccaaggtgggcagatcacctgaggtcaggagttcgagaccagcctgaccaacatggggaaaccccgtctctactaaaaatacaaaattagccaggcatggtggcacatgcctgtaatcccagctactcaggaggctgaggcaagagaatcacttgaacccaggaggcagaggctgcggtgagccaagatcgtgcccattgcactccagcctgggcaacaagagcaaaactctgtctcaaaaaaaaaaaaaaaaatccttataaatgggaagcaggagcacagactgagcaggtggagacatgatgatggaatcaataggttggagtgatgcaaggatggggtcaccagccaaggaatgcaggaagcccctgaaagctgaaaaaagcaaggaaatggattctcctctaaagcttccagaaggaacacagccctgccaacatcttgacctaacctggtgaaactgattttggttcttctgacttccagactgtaaaagcataaatatatattgttttaagcctttaagtctgtggtaatttattacagcagcaacaggaaactcattctctctgcaaaggcgaacagtggtgagaggaacacagtgtcctgttagagacactttgggctctgtgtctgagaatgggcaccaggaaggtcggtcttggcagcaatgctctcagttgcatggcacatggctgggtacacacgattcaaatcaaactagcagctccatgcatcttgccccatgaagcagaagacagtctgtagcgggagctagaaaccaggtgctaaaaaacaagccagatgccacggatgcacatcctctctttttgacattctgtctagggataggtagattttcatgtatcaaaactgagaatcctgggaaagccagagatctaacatagcctcagtgatcagcttgattccattgaataactggccaatccaaggaagaaaagaatctgtcaactcaactgggttttctgaattgacttttattgtttcagatttcatttatctcaaaccccaccagacaccatctcaagattccccaggcagagcacagatccttgggtttatcaccaacttcaaacacctaaaaatgatccccaaagacaagacaaccttctgtttcccaatcatggaatttttcaggctgtgtatagtctcatgaaagacaaaaaacatacaaaacaaagcaaaataagacggcacagcttcatgtgccataagcaataaatgctttttaaaaaatcaggactccaaacatcctcgcagtcatgtttattttttcttatctttaaaaacaaaatgtacacagtatcttcaccacataatttcagggtggatctatgataaactgtagtttgataagaggcagagtaaagacacctttatcctgagtttatccccaacaatgaacttttatagatgaggcttcaaacaaggccacatttagggaaaataaaagatctgtggtgataaatggcagtgctttaatgcagtttataaaacaaatctcctaaacatttactttccagtcaagcttctggctatagctgggttagtacaagcaacaaaatgaaagaaactttccaaacattgacattggcactcgaaaaataataaagagaggtattaaaacatttctagtatggtttcattctgaaaacatgttgagataaaatttctaagaatgcaatataattactagctgttttttatttgtaagagttacatattcttagattcatatgatcaggttcacataaacaaaaggttcttcctaaaaaatggaacaataagaatatcatcccacaggcatggcagaaaggaagcctctgttcagttcttagcctgaccttagcctagaacatccttggcttaattcaaatgattgtggttttctttgttttgttttgttttctgttttttgtctctctcccttccttctgcccaaagacccttatacatgcacagactggtttacaagaaaatgccaaaaaaagaagtgagaatagataaatttcagtatattctccaaaccagtggttctcaagcttgaatgggtacaactattgcaaaaatgtaaaaagtatttagaaatacaaagaatatattttaaatgtaattctgattcagatagttcctaaaatacagaaatcctttctataccaaaagaacgtaatgattctgattgttctcttaactggggaaagggaaaggtgtggcctgtcataaactggttccatggatatttaaaaagatttttctgggtaagaattagaagaaaaagaaaagaatcaccccatctcccttcttctcttgtcaattgcctatgtgaaggggagctgagttttggggcctgaggaaacagtgtggcccccaggcaggctcgtgacataccccttccctcaccccattgccagggcattagcctcatcttagcttaatgcagcaggagtttctggaaaactctgaaaagagagcaaaaggagctgctttctcaactgcattctgcacacaagacggcaacctcagtgcagatccagcatgtctctgagcctcatagaaagaggagctacctctttgaagctttggcccagaaatctacaggtgagttcatttctggtactgagcacattgctagcagccacctggacagacacgtggagaatgaggaccaggccaggtgaggtcaggggagtgagcccagacactccactcaagaccttccattccttcagctcttgaagaccagccaggctgtaagtccctggtcatcagcccacgcagagaaactcaagctctgagagtgtcctgagacctgtcccctgggaagccacaggtctgtttggcactggcacggcaccagcaggcagtgtgctgagtgggttgactgtgttacaattggcattttcaactctaccaaatacctcatgctgcgctgaaagcggacagcttctcagggacccagtctgagacacgtcaaggaatccagatggagtcagggcaccgtccgctcccaaagtctttctcgaagcagccactgtcctttggggttctctgtctcatagtagtcctccccaggagacaactggggctccaacgcaaagagctctgcatcccactccatatcttctcctgagaagttgaaaaggatctgtctggagctccccaggctagaaggaaggaatgaggcaggaggtttaagttcggcttggccggccacacagagggaagggatgctcaatgaccaccattctcatggagaccctcagattgctgccctagtcctgggtcttggggaggaccaaatggtgtcgccatgggggccatgggtggacctcagctggaccttggcctggccttgaaggggaaggacgggtggtgagggctgggttgtgattttaatatgtccagtgcatggtctgttactgtggaagggaaatgctatctagaaagcccctaaatccaacagggtttagtggcttttgtagaagcaaaggaagacagctgatgaggcttgacaggcccttccgttgtgacaggcaaggccctgcagcatggcctgggttgcccaaacccagaaagagcttactgctctgagcgagtggataacaggaatttgacggttagtgatggtaactaggcctgggggaggaggatctaaaaggagacaggccagaggagatggtggtaagatggcccaagaggggcctggccagcaagacgttctacatcttggagcctgcccggtgcattttagagaggggcatctgattcatttgatgttggtttcctcttggtgctatgctctgttgaacctcaaactcattaaaagtctgtagcatgccatgcgtcaatggcactggggggaaatccatgaaggtggatggcacagtgcatgggctaagtgggccagaaagaaagggaggcagacccaggaagaagcaagttaggagcagtgcaccaggctagagtgcagactaccaaaaaaaaatgttgaaactaagacctcaccaccaccagcaacaacaaatatatatatatatatatatatatatgaataatatttggcatgtaagatggggctggaggcaccttaaggatcaccccaagcgtctggaggccacgagaacatcttggtcatgctatttagcccaagcacttactcttttttgcaggctttgggcttaaatttccaggtgttgaaggccccttccacagccttgggcaaataaatggggtgcctctcgagtctcctctgagtgcccacggtcctgtgctcggtgctccttcgaaactggccgtctacagtatgcacagtgtgggcagcgatatcctcggagtgtctgcgcggtgcccgcaggatccagttagaatgcaagctgtgctccctggagctggtggccactagaagagaaaagcatgtgacccaggaaggaagggcttgccattgggaggcgcataaggcaaaggagagggcggattggactgaacactcacaggaaatgggtgtaggcaaccatgttcctaatagccaagcaaagcagatttgactctgcagttgtggtgcaggaggaatgcaatggaatatatgtccattaaaaatggggacataggccaggtgcgggggctcacgcctgtaatcccagcactttgggagttcgaggcaggccagtcacctgaggccaggagttgagaccagcctggccaacatggtgaaaccccatctctattaaaaatacaaaaattagccgggcgtagtggcaggtgcctataatcacagctactgggaaggcagaggtagcaatgagccgagactgtaccactgcactccagcctggatgacagagcgagactccgtctcaaaaaaaaggccaggcgtggtggctcacacctgtaatcccaacactttgggaggctgaggcatgtggatcactaggtaaggagattgagaccatcctggctaacacggtgaaaccccgtctctactgaaaaatacaaaaaattagccgggcgtggtggtgagcgcccgtagtcccagctactcgggaggctgaggcaggagaatggcgtgaacctggcaggcagagcttgcagtgagctgagatcgtgccactgcacacagcctgggcgatggagcgagactccgtctcaaaaaaaaaaacaaaaaaaaacaaaaaaaaaaacaagaagacacagatctatatttatgggcttggaaagtagcccaagatgtattgtaaattgttaaatgaaaggacatcctagttttatggcaaaaaaattaaaatgagtttgtgagtttgtgtgtgtgtatgtgagagtgtgtgtgtgtaagagagtgtgtgtgtgagagagagagtgtgtgtgtgtgtgttaaaaccacactcaaaaagacatatccccaaatgttaccggtgatgattatctctgggtggcagttttgcaggtcatattttttactttcttctttatgctttggtatgttttttgttatcagaggagaaaagtggtcatttcatgaacttaataaaaatgacttggtcacattcatttttattaaaaattataactctgaaaatgacccttgcatccttagtggattttgtcatcctttcaccaatatcctgaatttcctaggccccctcactcccaggggcagggctgctgtctgtcagggactggaggggctgcgtgggagaggaggaggataagaataagcttggggagcagagttaaccttctgtgaaactgcaaagaacccaatttgaaaccccaaatcccacagatacacatctatcaaggccagaacaacaacaacaaatcacaagcttctttcaagcattagagaaaacactcatgaattatttaatattggtaccaaaagctctaaccttagtataaggggccagtgagccccctgaataaaactatcattaatttacaccatggtgggcaagtcaaagattaaacaaactgtctgacagtcgcatgatggaatgtaaagggtgctcaactgatgaatgtgtttggattctttgctctccatcaggaggggtgcccaaggacacgccttggtgaggagggaagcatgaactcaggcctcaccccactccagctccagcagtccaggctgggtctgggcagccaccgtgggcctctcctgccctatgcaccaccctactacctagcctacgtatggtcagaagctggattctcaaatacagtttgtccatttcatttcttttttttaagttgtggtgaagtgtacagaacataaaatttaccatcatcaccattttttaagtgtgccattcagtcatgttcagtatattcacgttgttttgcaagcgatctctggaactttttcatctcaaaaaactgaaagtgtaccctttaaatgacacccctcatcgattctccttccttcatcatttccctattgctgtccttcttggagtcttaggaaagtcccacctgtctcagccgtggtaagtggaccacagggaaaacattgtccaaacatggcaccagagtgttggagaggcagcctagagccgtggcagcacagaaaactgaagtaagagatccccacagaggatgggctcagggccaggctccagcttggaggtgcagggtttccctttaatcagggaggtgggattcctgatggcctattctataagtccaccccagagcccccagcccatcctcacagcatcacagccccacccgccttcagccaccatcttcccactgccttcctggcactcaccgtcaaagtccacatcttcatttggcaggctggcctcagcagcccggggtcgtctctctgtatccagctctgcaatgatggagtcaaagaaggcaatggcctcggccacatcagcactgaactgcgagtatttctttggggttgctttctgcaagaggtgaaggggagaagagagagttgcctgagccagtaagccagagactcagaaaagggtgaaatgttgctaaaacgaaatgcgcgtggggttagggatttgtgaggtttcaaaggtaactatgaataagtgccctgtggaaggaaggtagatactccaggtccataattgctgtaggtcaatggatttctaattgtctcaagaagggagagtgaaaggacaacaagatctacttctttcttcatcacagatttgctgtcagacattaggcaaaataatgtcttcttttagccttgttccttgctgataaacacccaattaggagattgtacagttccttaagtaggtggtgagacgctcaccacaggaaagagatgatagatctccagatatgttgaaaatgctctaacagttgtcagtttctataataactcaattgtacatttttaaatagctgaaagagtataattggattttttgaaacacaaaggataaatgcttgaggggatggataccatgttttccatgatgtgattatttcacattgcatgcctgtctcaaaacatctcatgtaccccataaatatatacctactatgtacccacaaaaattaaaaataaaaatttttttaaataaagatgttttcagtttctaaaggaaccaaatttacactcaaatcgtggaataaattaaaattagtatggttgtttgaaaagtacaaggaataataaaatagagagtttcaagaatctattcagtagcttacgaggttccgggctctttcctgactgttcccttcatgatcttcacaacaatcccgtcatgagtgactgataccatggaagttcaagatccaagatgggtttcagtggagaactcatggtctctagaactgaccaaatcaatacgtgtactaataaaaaactctctgaggaatttaggaaataagaagacttgaggagaggaaaaaagggacagatgtgttaacatgggcattttgattcaatgtagagttattttattttatatgggcgttttgaaaataggatggtattaaaagtgaatatgatttatagactggtgtgtcaggaaagaaaacagcatctctatgtgtacaagatgtttattaagtgtatgcattttgtactactaagaaacatttttaaataggaggattttccttttatacttgcaaaatatcaaaggaaagctctaagagctttcttagaggaagatgttgaaggaccacaatatacaccttgatatgatttggctctgtgtccctacccaaatctcattctgaattgtaatccccacatgtcgagggagagacctggtgggaggtgattggatcatgggggcggtttcctccttgctgttctcatgatagtgagtgagttctcatgagatctgatggtttaaaagtgtggcacctcccctttgctcgccctctctctcctgctgccttgtgaagaagctgcctactctcccttcaccttccaccatgattgtaagtttcctgaggcctccccagccatgtggaactgtgagtcaattaaacctcttttatttacaaattacccagtcttgggtaggatccttatagcagtgtctcctggtgcttctgctccatcacattggtcacctctccacctgctttctgactggcagaagcttttggaaatctctcttccacagatggcctttctcttttaaaatgaaactgaggagaggaaaagtagaaacctcgagaacaaagagaacaagagaaaggccatccatggaagagaaatttccaaaagcttctgccagttggaaagcagatggagaggtgaccaatgtgatggagcaggaggaccaggtcccagaacatcatgggtggggtggcagctgagaagagggacaattcaaccttcaggaagtggagacgctctagactgggtgacaccaggcacaataagggctgggcatgggatgagactaaaaaaccaggaggctcagtctcttagtgcagcaggcccagctgccaggcatccttcttgaaggcaggtgacagaaggctcacacctggaggtaggtccacacttgtttattctccctgcattttctcttgctgcttcctttgccttggatgttctcattggctgactccgaattcatccattgaatcttggctggaactgctccttctccaggaaggctacccctctcctgggctaagtttccatcctctaggttcccatgggtctcattacctaacctaagtctatgatgacagatatcactttagagatttttggtgaagtggaggagagagaaacaaagaatggacaaagccattctttggctgacccagcctgacccctgaggaaggatgggtattatttaatagtaatgcaaggtccatggtggttttgcacctcaaaacccacctccacatggagggcacatctccaagtcttcagaaggcaactgtcatcagcgtttagcttaatgcaaaggtctcaatcttgtttgtgttcatcatattattttttatctgggttaccctattatttgatttaagtgattcagtcctaagtgtctctggagggagggtttggctagcagctcaaagcagcctcagtcggttgctgttaattgttaaagagttaggaaaagagtcaatgttggtgtcttagctattaaaggctaagaaagcatccggccattggctagcttaacatgaatgttgtcttgttgtgaatctcctgaatctcctcaagtattatcctctgaggataacatttataaactaaaaaaagaaaacattagcatagaaatcaccacctcagccactgaactctctgtcatccaagctagtggacaatagccctttcagctgcacctttgctagaggtgagattccaaatattcaaacatgtcgcctatttccaaaatttcagctttaggattcaagacttgtgtcactttcccacaccttgccatttctgcaaagctcagcagcaattaccatcccaggatcactctgaaacactgacaagtgagctccttggctgacactgaagagcctgttcttccaggtcccacttcccgggctctgctggcccagtcaatacatggtcattataaaactcgttataaaagatcgaaagatcttttggatcctgctgtggctggggagtgagtcagtggcggcacactggtgacgttatttgtggctgacccatatgtgcctgtgtaactaactctcatcacaaaagagggctttcctccacttgtccaattatcctcattagtccccccactgccttgccctaaatccttcatgggataaggcaggggcataaacaaatgtaagtgaataaacaaattgctttattctcctacttagccctgcctgccttccctgccccttgacccagtctgagatcccagtcctgagagtgataatgctatcccccatcagtgtcagggtgactctgtaacagtggtacctaatcccagtggttgttagactctcctggggtgcttttaaagaatatctatgctgcccttttcctaaaccaattaatttagacaattaagtgattctaatacacagtggctgaatcatcactctacagggacccgaacataggggagacagcaaaggggcccacgatctccacctcaatgactggtttagagtggaaaacctcaaatcctggttatactccctgggtttgcaagagcagacaggagtgtctccatgatgacaagaacacaggggacatgacacaaggggacaggatacaggtcattgagggacgagaacaaaactctgggttaaggggcccagactcctcatgtctttgtgtccttcctatggcttagcacacagagaggcccaggtaacgagactccatccatcccctgctgctctctcctattggcccaaagtatgagaacatctcacccacaggggcgcactttcccattctgatctcttactgtccaggggacaaaacatcctggcatgctcaggaatcatcccagtttatgcctgttatcccagtgggattatgcatagtacctcttttcactctccaacgtgtccctagttgggggataaattacctgttcctttatcatataaaccacaagttatgccacctcccccaagtctgttaccacctgcgataagctgcattttattatcaagttactgtaaatatgcataacattttcctaaattcttcactttaatccatgtttttgatcaccaatcttttgaataggatttattcatttgaattattcatttgttttcacctaaatcttatccacaatatctcatctaaaatttccggatttggtttatttaaagtgatctaggcacctgagaaaaaaacttgagtgtaaaatccttctagttctttataatttataatttttttcaaatctgtcacatttgcttattccaaacctcattttgttgctttttaaaaagcaattctctattagtgaatctttctaaaacactcaacttagtttccataaaagaaattatattttatcattcatatattatcatatttaattaaaatacatgattataaattataagaagtccaaattatataaaccagtttgggaacaaatataacttaattttaataagcaagtcattcaacttgtgaagctgagaagtacataggcatatcctagttttaaaaatgttttattataaaaaatttttcaatacaaaaactatagaaaatagaactatgaaccccatatactcatcatcagcaacaaccatcacctttctgccatttttgttcctctatcaacctctcacttttttttctgaaagctaatcctaaaaaaagataattttactcataaatacttcaaaatgtatctttaacagataagagttttcagcaacattatccacaatattattatactcaacaaaactgataatttcttaatatcaggaagtacctagtttatgttctatttttcttgactgactcaaaaatgtcttgtgcaagttggtttgttcaaattaggatccaaacaaggtccacatttagttgctacctgtttaagtctctttaatgatttatgcaggtgatttaattgaagaatctgcatctcttgttccatagactttctcacattctggatttgactgactccttcttctgggtattggttcacatttctctcttcctcaaattccctataactggtcctcagatctggagcagggctgtccagtaggactttctgtagtgctgggaatgttctacatctgcactgtccaatatggtagccactagccatgtgagtggctattgagtacttgcaaagtggctaccgtgattgaggaactgaacttttaattattaaatttaaatttaaatagccatatgtgactggtggctactgaattgcaaagttcagatttaaaggtttaattcaattcagatttaattttttaaataataaggttagtggtgctgtgtatcacacaccaggaggcacacagtgcatattttcctgtttcgtgcgatgttgacatcgattgggggtttatgtgatgttggcttgatccatctactagaaaatttgccatctaccttttacttaatgcttttagcaatcattgtctagattcattattttactactagttgcaaaatgttgcttttccagttcttcaaccttcctgcatttattaactgtgcttttggtatgaataactttccctcatcaaccacatagtctgtttaggaatggcagaatacttgctctttttttcccatataataaattgataccctagaaagttttcgaggtaaccaataaggttcacttgcttgtttgttttgggggggtattatttaaaattcatgtatttttaacatatttgatgtcttgtcatcagttgtaattattctttttgatgctcacactgtcctgcattttgacagcaagaactctttcatggtggatccggagtctctttgacacaatcctggtatctttgagaacctctgaacttttagacataacaaatgcccaatattcatcttgtacattttctactccagacctggattctgttacttctccaaagaaaacttaatttttagttggaagtggcatttagacagcacaatatacatgttacggattttattgctacagggttgtcattacttctaggccttttcagtgcaataaatgaggaaatactaatcttttagaaataaaaaaatcttgagttcatactgatatttgcaactcaaactaaaacggtgtgttcacggttcctcttcccacactttgtattattgctacaatacatttcacttttaattatgttgtaaacacacaatatattgctaccctctttgctttagacaattagttacaatttagagaattttaaaatgttttaaacccacaaattgtatttttaccttttcccagtcctcctcacctctttgtgtggatctaagtttctatctggtaccacatttactcttcaaaaagtatccttaatatttattgtactacaggtctgctgaaagatgaattctcacagtttttgcttgtctaacaaatacttcttttgctttcatgttttaaaagatatttccactgagtatagaactctgttgataagtattatttttctttctttcagcactttaaagataccacttttaatatggtttggctgtgtccccacccaaatctcatcttgaattgtagctcccataattcccatgtgttatgggaaggaccctgtgggagataatggaatcatgggggtgtgtctttcccgtgctgttttcatgatactgagtctcttgagatctgatggttttataaaggggagttcccctgcacatgctctcttgcttgctgtcatgtaagatgtgcctttgtttctcctttgccttccaccatgattgtgaggcctccccagccatgtggaactgtgagtccattaaacctctttcttttataaattacccagtcttaggtatgtcttcattagcagtgtgagaacagactaatacaactccattgtttcctggcttgcatcatctctgatgagaaatttattgtaatttttatcttagttatgctgtgtaatgagtcatttttctctttgtccttttagcaattttattatgatatatgtaggttttatcactgttgttgctgttgttgttattgatcctgcttggtttttcttaacttcttagatctgtggtttagtatatgtcattaatttgggggaaaatctcagccattgttccctcaaatatttctcatacccccctctctatttcttcttctctgggattccagctatacttatattagaccccttgatgttgtcccatagttcttggatgctctgttttttatttatttacttatttggttttttttttaactatatcttctttttgtgttagttttggtcatctctttggacccatcttcaagtctgctgattttttccacagctgtatcaagtctactgatgagcccagcaaaggcattcttcatctctgttctgtgctgctcatttccggtcttttcatttggttctttcttatggtttccatctttctgctggaattatccatctgatcttgtgtgttttccacctgttccgttagggcttttaacatattaattataattttttaaaattttcctgtctgatagttccaatgttcgtgtcatatctgagtctggttctatcagttgctttgttgcttggtactgcattgttcttttcttgctttttcacataattcataatttttttgttgaaagccaggcattttatgtaggtcagtagacactgaggtttttatgcctgcaaatggtctttcctttggctaggcctttagtttggttttgagtcaatctagataagattttagctgggactgggactgttgttgctatggttactcgaaatacatcacagattttaaatctctctagaaataccttgtgtttaaagtacaggctaattttccagagagtttgtcctcaatgtctgctgcatcctcagctttaggtctttcctttctgctttcctaaagagagggtttccctcctcacttttgcccctctgttagcagtattccactgtcagtttctacctgatgcttgttaggatggtggtgagagacaagagggcattcactgttttctgataaagccccagtctcaggcaggcgctgtgtccctggggatgtggccttctccatggccttgtaaggttgagagtgacattctttcctgctctccacatcctgagcagaaactgacagtctctctaattcaaattgaatagtagaggtttcacacttaacttctttagttcatatttgtatctctattaaactgaatatcttggttccatgcaacattaacaagattatttatttattttaccctactatatacaatcatttcaaaatagtaacttcaacattccaatagtaagcccactgaatgcagtttaagatgtgtgtgtacatctgcgtgtgtgttttgtccttggactgtataaaccaaaattctgttttaaagtctcttgaaataatgcttttctgtgtgattatgcctttgacttcgtaatttgttagattcctatgcttcagttgagtttcatgtttaaggattgcttttttctttttgctttaatattttaaaactatgtaaataatatgcatggctccaaaaccaaaactataacaaacattcaagagagggcttgctttcatgtcagtcccttctcctcatttcctctatctttgctttagtattttgtttatctttctatcatttcttcgaaaatacaagcaagcatatttgtatttactgctttttaaaaaaacaaaaaggagcataccatgtacacctgtgagtactgctttcttcactcaacgtatcctgaggatcactctatagcagtaaatagagatcctcctcatcccttttaatagctgttctccattgtacagacatgcatagatgcaaacaacaatcccttattgatagatctttgggtagtttgcaatcttttgctattagtgcagcaatgaaaagtcttgtcatatgtcattttgtattttgcctgtaatactatagttagagataggcttccatttataaatacccagcttgttctgggtgtcttaatgagggaatggtgagcatcaagtaatctggcaagttagttaagtagggtttggttaatagagcttctattgtccttttataaattatacttttaaaggtcaccaaatggattctatgatgattttctaagtaccaagtctaaactaccagtcaggggctgagccttttctatttctggattgaactcatgctgagctcagctttttctgccttctcacactttccatggggctttctaacctacactatgacattcccgcagagattccttcagggctcaggctattgtcacaggaaaatctactttacaaagaggtggttgtgcaaaatgagatttcagtcatcaatacccctaggtgaaacccaaaagtcttccctccctgaactcacaactccaagcaaaagtggattgcttccctcccaatcttgatttttttttttttcctagcccagaccttttggtctttggaaatgccaaatgtaatgcaggctgtttcctgctgcagccttcccggctgagtttcacagggtccatgtccctttgccatcagccctgaagtagcccagggagacaaagctttctctaagagaatctgtatcttattgccagctccactccagtttgcctttcacatttaaccctccatggccttagggttatcattttccgagtcttccctgctccatctccctaccctaggcctgagcctcggattacttttctcagatggaatcctttgcactttccaaacaaaactcctttgtgtttctcatttcaatttccaattccttgagggcagtttctaattttatattatttatcttttttttcatttcatatcagtttgccatcctgcttggcttcaccaccctccgggtacctgagatgctcccttccccagtctgttcattttcttctgggctctgtcagtatttttctgcaagagatctaaattctacaaaataaacttcccgttgtaaacagcaacattgtgtcagaaaggagaacccagccaatgccaaggagaccactgctaagcatccagccccctctcacctcttctacttggcaattcccctcatctcctcagagggtcaactcatgtgtcatctcctctctgaagctttcaccaattgccgcagacagacccaggcacatcttttctatgctcattttctatctcattggatacatccacatcgcacactgtattaattcatactggaccaatgatcctcaacctcttctgtgag

SEQ ID NO: 173 - DNA, 91743 bp, Homo sapiens
tgaaaaacttccctaaacctccatcaatcaagtgaaaaaaagattgaatttggcagttgtttcttttaaaaatttaatgctgttggttgtatattttctcttttgaaaatacctagttttaaaagagagagaggccaggtgtggtggtacacacctttaatcccagtgcttttgggaggccaagcagggaggatctcttgagaccaggcatttgagaccaccctgagcaatttggtgagaccctatctctacaaaacaaaattgtttttgtaattagccaggagtgatggtacatgcttatagtcctggctactcaggaggctgaggcaggaggatcatttgagatcgggaatttgaggctgcagtgagctgtgattacactactgcacttcatcctgggcaacagagtgagaccctgtttctaaaataataataataataataataaatttttttaaaaaagatgttttagtgactattatgacctttttaccctcctccaaaagtgttacttgcttcagatgtgaaattgtttacagtcaacatgttagcttatcatatgctgttccttgatgtatttctacaaagtagaggttccactttaatttcaggatggtttttccacatgactctttttttcttcctctctagacttctccagagaaccttggaacagtaggtggagtgcaaagctgcattgtgtaccttcctgcttttttttggttgccttcctgctggtttttttttttttcctttctttaaattcttggccccgccttggctctcctttctctgccattaaaactaactaactaaaccctgcatgcatggtcattatgaggggttcatggccttttatttcagttctgcacatgtatcatgtcagttatgttttatgtcaaatccttaatattatggtgtgtgtgtttgtgtgtgtgtgtgtgtgtgtgtgtgtgtgtgtgtgtgtgtgtgtgtgtttgagacaggctctcactctgttgcccaggctggagtgcagtatcttaatcacagccaactgcagcattgacctcccaggctcaagccatcttcccaactcagcctcctgagtagttgggactacaggtgcacaccaccatgcccagctaatttttgtttttgtattatttgtagagacagggtttcaccttactgccctggttgatctcaagctcctgagcttaagcgatctgcctgcctcagcctcccacagtgctgggattacagaaatgagccactgtgctcagcctatgattgtctctaaggcactactatggtaaacaaattggaatctcacctctactttctgaaaacatttccctccaatttaatgtacccgctttctaatgcttctgccccgcaaccctgagcactttccaatacctagggtccttttgtgaagggagaaaataatttgatgagcagatataagtaaggtactaacaatgtgttacctctccctgaactatttatatcctgaaaagggcagggaaagggcaatgtttaatagagaaaatgattcactcactaatgaggcaggaattccctgcctcagtaaggcaagatctcatgcatttgttaagatatccacattttgtatacatgcgcctttaaaagattttgagccggctctgatcatttcaccagattttgtcctaaaatgatgtcagcttggtttggttcctttttctccttagtagtttatctgttaatggattttgatgtttggtgtccatgtgatgtccaggagtctccctgtctgcatgattgtttatcgttgctccgatcctttccaactaccacaggaagagaggggaagggacattttagagattatgctgaaataatacatttgcttccttccctctcttcttttcatgtaacagaggaagcagaccagcccactacagagccaggcatggtcctggacagtgtggaagcaggagacacaacacctcctaccaaaaggaagagcaagttctcaggctttggcaagatcttcaagccctggaaatggaggaaaaaaaaaagtagtgataaatttaaagagacttcagaaggtgagatattaagggttaaatgtgtgttctgagttagaattctctatgttagatgtatttaatttttccttatcttcccaagtttctgtagtcctctatttgaagagggtatttaatgttttattctttccttcttctttttttttttttttttttttggtgagacaggatctccctctgttgcccaggctagagtacagtggcgcaatcacagttcactgcagattcaacctcctgggctcatgtaatcctcctgcctcagcctcccaagtagctggaagtacaagcatgagctactgtgcccagttaatttttaaattctttgtagagatggggtctccttatgtttcccaggctggtcttgaactcctgggctcaagcgatcctcccacctcagcctcccaaagtgctgggattacaagcatgagccactgtggctggccagagtttaatcttttagaattaaacatcaaaatggtcatgtactaaacctaatattgtataccctcattcccaggtttgtattttgatggcatataagtatctattgagtggtgaatggagttcctgaactgtcgcaaatctaagatgcttctttccatcagaacttggtgaagaaaatgactgaatgagttgatacatacataaataaaatgcttattttctactctgcccatccacacaaagttcatccgtaaataacttactaatgaaattttctcttaagttacaattatgtaaggctagttttttggaagtgatgctttcctgacagcacaggttataaaagaaatttaagagttttaatttgaagttagtctgctagttattttctttcctgagaatataaacttaaactactttattcttttacctgtagaattagaatgctaagtgtaaggttgactttcaactgtcacatttctgagtgccattttccaatttaatgttagttttagaacggaaaatatctatgcgaaagccaagagaagagctggttaaaagaggggttctgttggaagaccctgagcaaggtgagtttacaaataaatagcatatgcctgtctctgtgcacttggtctttgattgggtctgacgagatatttgaattttctttctttcttttatattgctatttttgggttggagggtggcctttaaaaaaaaaagttcacccttccttccttggggcaaacattcctttcctctgtgtacatcctcaactttgtgccagctacaatattgcgtgtcttttttttcccccccttgagacagagtcttgctctgttgcccaggctggagtgcagtggcacaatcttggctcactgcaacctctgcctcctgggttcaagcaattctcgtgcctcagcctcccaagtagctgggattacaggcacctgtcaccacccccagctaacttttgactttttagtagagatggggtttcaccatgttggtcaggctggtcttgaacttctaacctcaggtgatccgcccgccttggcctcccaaagttctgggactacaggtgtgagccactgtgcctggctaattttttcatttttagtagagatgaggtttcaccaagttggccaggctggtctcgaactcctgacctcaggtgttctgcccacctcggcctcccaaagtgctgggattacaggcttgagccaccgcgcccagctcattttcttttttgaacacatttgtccccatgcccatatcactgcaccagtctaccagtcattgtttgtttaataatgtcaagactttcttcaatgtgtgactctatgaagcaagttattgcaaatgtgaaagtatagtacattggttgcatctcatttctcttcatctgagttatgttgcatgaggcaaaatctgaaagccatattgtatactggccaggcatggtggctcacgcctgtaatcccagtattttaggaggccgagacgggcagaacacttaaggtcaggagtttgagaccagcctggccaaaatggtgaaaccccatctctactaaaaatacaaaaaattaggagggcatagtagcaggcacctgtagtaccagctacttgggaggctgaggcaggagaatcacttgaactcaggaggcagaggttgcagtgagctgagatggcgccactgcactccagcctgggcaacagagcaagactccttctcaaaaaaatttaaaaaatcatatcctttgaagaataggggaaaggaaccaaatagatggagtattactgtatactttttgggctttaaaccatgcgaatatattgcctattcaaaaaattaaattgtatgtattgaagatttattatctcaactgtataaaaactaaccagagacaacaagcttgaaggagcaatttgaaatattattacaattggttacctctgaagttgaggtgggaacatgggtgggctttttttttgttttttaattgagacagggtctccctatgttgcccaggctagtctcaaactcatgggcagcacaagcagtcttcctgcctcagcctcccaaagtgctgggattacaggcgtgagctgctgtgcccaggtgctatgcgatgttttctttctttctttttttttttttgtatgtgactagttatgagcatatataacttttgttttatataactctatttgtttttttacattaggacacaaaatcttctcagtatttaggtagttacgtactactttaatggtttcactgtagcacctctttggcccttgctttgctttcttttttgagacagagtctcactctctctcccaggctggagtgcagtggtgtgatcttggctcactgcaacctccatctgctgggttcaagcaattttccagcctcagcctcccgaggagctgtgattacaggcatccgccaccacacctggctaatttttgtatttttagtagagttggggttttcaccatgttggccagactggtctcgaactcctgacctcaagtgatccagccacctcagcctcccaaagtgctgggattacaggcgtgagccaccatgcctggcctggcccttgcttttttgatacagctgttccactttccatggcctttcttttcacctttcttgctcacttatcataaaccacatacattactcatttcttgtttttcaccttcagtctcttttgccctacactcacggcaacctctgcctcctgggttcaagcaattctccttcctcagcctcccgagtagctggaattataggcatgcatcaccacacccagctaatttttgtatttttaatagacagggtttcaccgttttggccaggctggtctcaaactcctgagctcaagtgatccacctgcctcggccttccaaagttctgggattataggcatgagccaccacgcctgatgatcttttgccctatactttctattagcccctaatccaagttgtttttagcctacaagttcacaggcccaattaataaacgagttgcagccattggacaagatgccattctgccaaccagataaatgacctaagctttattctgtatctaaaaacagggatgggcctcatgctggcttatagatctgcattttaggccaaaagtagtgtttgaaccttgaagtcctctgcatacttaaagggaacttttggctggcctggcgcggtggctcatgctgtaatcccagcactttgggaggccagtgtgggaggatcccttgaactcagtagttccagaccagcctgagcaacatagtgagacctcatctctataaaagattttttaaattagccaggtatggtagtgcaggcctgtagtcctagctacttgagcccaaaagatggaggatggcttgagcccagaagattgaaggctgcagtaagtattaattgcaccactgcactccagcctgggcgacagagtgagaccctgtttttttttttaaaaaaaggtggcttttggcttgattatagtgctaacttgactgtactgtaaaatatttaattgattttaattgattttctgggtttagggagaacattcagtgatgttaaagccccatagtactactccacttcattaacattgcagaaccctctatatttaatataagaaatgatactgcaaagtagacatccctgattaagtaacttgagataactgatcacttttgcatgtatttcactagtgtgtgctgagtagaaactaattaacactgtcttaaactttattatgttgttttcacaaagagcagcctttgttgactttgaaatcattgcttcagtattctagaaaatcttgtttttgttaaacatgggcagtaacttactatttttgtatagttgttgtcatcttacccccaccctgttttaaaaataaaaagtagttgtcagattactttggctttagaagtaccttttcacttgccttagaatcttcattactttgagcctacactccacctcttattggaacttcatgaagaatgatgttggatttcactctgtcacccaggctagagcacagtggtctgatcatggcttactgtacccttgacctcctgggttcaaacagtcctcccacctcagcctcccaggtagctgggactaggcatgtgccaccacacccagctagtttttttacttttttgtagagacagggtcttactatgtttcgcaggctgatctcaaactcttgggctcaacgatcctcccgcctcagcctcccaaattgttgggattacaggcatgagcaccactgtgcccagcccataaccatttcttttttttttttttttttgagatggagtctgttgcctcagcctcccgagtagctgggattacaggcacctgccaccacacccgaataatttttgtattgttagtaaagacggggtttcaccatgttggccaggctggtctcaaactcctgacctcagatgatccacccgcctcggcctcccagagtgttgggattacaggcgtgagccactacacccggccccccataaccatttcttatgtgaatctattctcctgccagaccaaactagttgccagtgccccaaacacgttgaataacttcacacctttatacatgctgtccttcttccaaacagactgtctttattcagtgtggtaggctcctactccttcaagatccagttcaaagcaaggcatggtggtgtgtgctatagtcccatctactagggagtctgagagaggaggactgtttgagcccaggagttcaaggcccattctggtaacatagcaagaccatctcaactccagctcagatactttctgtgatgccttcctaactctattctcactccaggaaaatgatttcttcttcattcctaccacagtacttcactaattagagctcttgacatttaacattgtagttacttatatataagtttgccctattcgtttgtctttttttttctttctttgagttggaagttttgctctgctgcccaggctggagtgcaatgacacaatcttggcttactgcaacctctgcctcctgggttcagttgattctcctgcctcagcctcctgaatagctgggattacaggcgcttgctaccatgcctggataatttttgtatttttagtagagacaaggttttaccatgttagacaggctggtctcgaactcttgacctcaggtgatccacctgcctcagcctcccaaagtgctgagattacaggtgtgagacactgcgcccggcttttatttgtcttattcatataacaacgtacttggcacatagtaggctatcaaacatgtattggaaaaagaaatcacttgtttctgtttaagcatccagataatctagatctcaataataaactaaaacaggaagacgagggaaagaagataagaaaggttagaaatcaccaaccctgggccgggcacggtggctcacgcctgtaatcccagcactttgggggctgaggcgggcagatcacgaggtcaggagatcgagaccatcctggctaacacggtgaaaccccgtctccactaaaaaatacaaaaaattagtcgggcgtggtggcaggcgtctagtcccagatactcaggaggctgaggcaggagaatggcgtgaacccgggaggcagaggctgcagcgagccaagatcatgccactgcactccagcctggtctgtgagaccctgtctcaaatcaccaactctggccaggcgcagtgattcatgccatttatcctagcacttcgggagaccaaggcgggctgattgcttgagcccaggagttcaagaccagcctgggcaacatagtgagaccctgtctcaatttaaaaaagagagagaaagaaaaaaagaaattactaactcttctttctatctgttcatgccaacttcatcactttgtactcttctttcaccttgcaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggtaagaaactctggatttttgagtttaagagccacgggccagttattctccttacataaggggtttgcaagagaacagggaaaagtgaaatctagagagaattacattctcctttaacaataccttaactagcaacttcaaggggaatttcctcccccaccccgcttttattcactaaatacctaaatttgtgatcctcaagaagggaagaggatgttaagtatcagatacctataggattttttccagctacacattccacttctttcacccaaggaattttgttgtggctctcctccagtagcctggcccttgtgtgaagaatcactaccacaatgagcatctcttagtgagcctttcttactgacatttcttaagtatggggaggttgggaggcattgagaatggtaacctataagctaatctataaattaattggtgaaattggccacaaattcatagatgtgttagctttttcagtttctcttgttactctctcttccctttttataccatacatgttattacacaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattggtaagtaagtctttaggcttccagtgttttgggtttggtttgatgttggatggttattttatttgataactggtacaacattgatttggtctgtgagaattttccatatcttgtccctttgaatgacctcaatatggagaaaagtcttaggttaagaaaaaataggccaggtgcggtggctcacgcctgtaatcccagcactttgggaggccgaggtgggtggatcacaaggtcaggagattgagaccatcctggcaacatggtgaaaccccatctctactaaaaatacaaaaaattagccaggcgtggtggcacgtgcctgtagtcccagctacttgggaggctgaggcaagagaattgcttgaacccaggaggcggaggttgcagtgagccaagattgtgccaatgcaccccagcctaggcgacagagagagactccgtctcaaaaaaacaaaaacaaacaaacaaaaaaagtcatgaaactgaggcagatggccataaatgtaaacatcactaagattagatttaagttttgggggttttaacctattttttaatctaatatttaatctgtttttctaaaacaatgattccaaaacactatacatatttgtgtgtgtgtgtgtgtgtgtgtgtgtgtgtgtgtgtgtaattggactggatatgtgaaaaccataacagattccacctgcatggaattatctgtggcacttgctgaaaaattagaataatgcctcagctcacaaggggcaaggcaaacttttcaaatgaaaatttttaaatctacttaaaactacctatgccttccataagcattaatgagtctagtagataaaaggatgattctgtagatgccagtggaatttgggattcagtgtctggcatagttatcttcacagggaactgcagaagctattacttaaattgttctgataaaatcatgttttatcttgggagaattaagaatgctattcttatgttaaaataagtgatggtagagaaagcagggaatataatcagtaaaatttgtatgggtttagtaaattttttgcatttacccaaagttctatttaagtctactttctttatataaatgcacaatttcttagaagaattttcaagaaagggagaggaaagctaatgagtgcttcaaagctaataaaaatatagttttttcaggaaaaatgatactaggcttagtattgcttaaagttcttgttcacgattgaacgaatgaataaaaactatactcattaaatatttaatatcaccatgttgggtggagtgattcaaaccttgaaaaacaggcttagaatattttatgagtatgacagtttggagtagcttgatgaaaacaggatgaagttgttattaccaccactttggatggatagtgtcatgttgacttatctgtgaggaacttggggagctttcacatacttattttcaaaactaccttgtgctgcaggaaaccaattttatcttttccataggtagggcaattagaacatgaagacattgtgactcattcaaggttgtaggccaggcgcagtggctcatgcctgtaatcccagcactttgggaggcagaggcgggtggatcacctgaggtcaggagttcaagaccagcctggccaacatggtgaaacgccatctctactaaaaatacaaaaaattagccgggcatggtggtaggcacctgtaatcccagctactcgggaggctgaagcaggagaattgcttgcacgtgggaagcagacgttgcagtgagctgagattgtgccactgcattgcagcctgagcaacaagagcaaaactccatctcaaaaaaaaagaagaaggttgtagttagtgaaagatagaaactgaacataggcttttcaactctcaggtccagacctctgttccttacagtagtgtttgcaaactggtgttctcctcaggatcacctagaaagcttatgataacagactgctggacactacccgtagagtttctgattttagtaagcctgggatgggcttgagaatttgcctttctaataggttcccagatgacactgatgctgctctccagggagcacacattaagagcctctgctctacaccagtggcataccacccttttcaagttaaggcaacatataaaatgataatttgtgtatgataccctggactaaactgcagagctcattcttagcttgaggtaaatagcccaaaacaatagaccttgtaactgaggaatcagtattagtccatgaggggtcctcaacaaaagaagaaaaatagaacagttcacagagcatttcttagagctaaatagatttaatttaaaggactctcttttattctaaaattacaaccttcctaatcctttggtgttaaaatgccatttctttcacaaaaggattatgatcataaatggtttacttaatatcaagccttatttggaaatcttagaaaatgacaacctcaaaaaaacactagaaaaaaaaccaacaatctgaggttgatcaagatttttgttattgttttggtcactgaaatccaaaagtttggaaatcattgcttcagaagtactactgtcttctcatccatataacatggagtattacgactaaggaaaaaccaccagcaatagctgaacgggtgaaagggaattattacccatcccagaaacactctgaaatttttccacagaactacagccagatgctgttgtcagggtatatataccagaatttacttccttaacatatatgccttcctcaaattaccaaatagaatttattttattaattcaaaagtaaaaatattcatttatggtctcatcaggaatgagttttgttgtagatggaatagctaacagctatttttagagaatcagcaaaaatccaatctttccaaaaatatctctttcactgctcctaaaattcacatttttagaatctttttgtgtgtgtatgcagtgtttttctagaaagccttttttaaaatttatttatggggccaggcatggtggctcatgcctgtaatcccagcacttcgggaggccgaggtgggcagatcgcttgaggcccagagtttgagaccagcctgggcaacatggtgaaaccccatctctactaaaaatacaaaaaatgatctgggtatgatggtgcatgcctataatcccagctactcaggaggctgaggcaggagagaatcacttgaacccgggaagtggcggttgcagtgagccaaaattgcaccactgtactccaacctaggcaacagagcgagactctgtctcaaaaaaaaaaaaattatttatgatgagagacattaaaacattacaaaattaggccaggcacagtggctcaatgcctataatcccagcatttggggaggccgaggtgggaagatcacttgaggccaggagttcaagaccagcctgagcaacgtagcaagaccccatctctataaaatatttaaaaattagctgggcatggtgacatgtgcctgtaattctagctacttgggagattgaggtaagaggattgggtaagcacaggagttcaaggctgcagtgagttatgattgcaccactgcactctagcctgggtaacagagcaacatcctgtctctaaaaaaaaagaaaaggctaggtacagtggctcacacctgtagtaccaacactttgggaggctgaggcaggtagattacctgagcccaggagtttgagaccagcctaggcaacatggagaaacccatctctacaaaaaataccccccccaaaaattagccgggcatggtggcacatgcctatggtcccagctacttgggaggctgaggtgggaggatcacctgagcccagggaggtcaaaattgcagtgagccgtgactgcgccactgcactccagtgacacagtgtgagaccctgtctaaaataaattaatttaatttaaaaataaaaataaatttaaaaagaaaagaggctgggtgtggtggctcacatccataatcccagcactttgggaggctgagataggtgtatcactggagcccaggacctcaagaccagcctgggcagcatagtgagaccttgtctctactaaaaattaaaaaaattagtcaggcatgggggcatgggcctgtagtcctagctacttgggaggctgtagcaagaggatcacttgaacccaggagatcgaggctgcagtgagctattgttcatgccactgcactccagtctgggcaacagagggagaccttgtctcaaaagaaaaaaaaaaaaagaattataaaattagctagccttggccgggcaaagcggacatgcctgtaatcccagcactttgggaggccgaggcgggtggatcacctgaggtcgggagttcaagaccagcctgaccaacatggagaaaccccatctctactaaaaatacaaaaaattagccgggcgtggtggcacatgcctgtaatcccagctactcaggaggctgaggtaggagaatcacttgaacccaggaggtggaggttgcagttagccgagatggcgccattgcactccagcctgggcaacgagtgaaactccatctcaaaaaagaaaaaaataattagctagccttttactttgaacatctccaattttggagatttaggacaaatacagttttatttaagggaagtttttgagagtgtttgagaatactgagtgggatgaaactaaagggtttgagtagaaggttagaggttggtgatcaaaagaactactttttttttttttttcctgtcagcagggaaaaaataactaccctttaattactttaccagttttactcctgtgtgatctgatgatccacttcttacaggtcatctggagccctccaaagggactttgctgaaacaacaccaacacctttgctgagtcattgtgggctttggtgaaactataggaatatatactgtcatgatacagggtgaaggcttctcatctaataaacatatattgagggtccactagatgccaggtactgtgcacagccctgtggatgatatgttgatggagacaaggttgccctgccatcaaggagcccatgatatagtggagagtgaacatgggaagctgaggtgcaaagggaacataagaggtgtgcataccaataaaaattagagacagtaggccgggcgcggtggctcacgactgtaatcccagcactttgggaggccgaggcgggcggatcacgaggtcaggagattgagaccatcctggctaacatgatgaaaccccgtctttactaaaaatacacaaaaaattagccgggagtggtggtgggcgcctgtagtcccagctacttgggaggctgaggcaggcgaatggtgtgaacccgggaggcagagcttgcagtgagccgagatggcaccactgcactccagcctgggcgacaagactccgtctcaaaaaaaaaaaaaaattagagacagtaggatgcagtcaaatagtcagagacttggataccagctgagtccatgccagtttgtagtatgatcttgggcaaagtcacctagcttctgtggccttgccttttccttctgaaaaatggtaaagatgctatattttttcccctgtcacctcaggtggtataaggagaatatgacttcaaggacaaaaaacactttgatttcttcaaaggactttgcaattgctataaaaattcaagatgtcagtattgacagttttataacacagagctaagatatctagataccattatcaggatatggtaacaatacccactaatacttattttatgctatctgaatgtttaaattttttaatggagtactgttatacaaaataacttttttttttttgagtcagagtcttgtgctgtccagcctggagtgcagtggcatgaccttgactcactgcagcctccgcctcccaggttcaagagattctcgtgcctcagcctctcctgagtagctgggattataggtgcccaccaccacacctagctaatttttgtaattttttttttttttttttagtagagacggggtttcaccatgttggccaggctggtctcgaactcctgacctcaagtaatctgcccacctcggcctcccaaagtattgggattacaggtgtgagccaccgtgccagccacaagataactttttatcagattttttttgtctctattcatattaactacaccaagatcaagttacaaaaagttgtcagccgggtgccatggctcacgcctgtaatcccaacactttgagaggccaaggcaggtggatcatttgaggtcaggagttcgagaccagcctggccaacatggtgaaagcccgcctctactaaaaatacaaaaattagccgggccgtagtggcgtgcgcctgtaatctcagctacttggtagactgaggcaggagtatcgcttgagcccgggaggcagaggttgcggtaagccaagatcgcgccactgcactccagtctgggcgagagagtgagaccctgtctcaaaaaaaaaaaaaaaaaaaaaattgtcatatctgttgccatagcaatgaagtaagctactcatcagtcttcctacacctctgtacatttattaagccttctatttgaataaatataaacttcatttcaggataaaatatatagggaatggcaaaactatgaaattatttaacttgcttaaaagattaaaactgaactcaactttaattctaggccctgggccggcccttcaaagcattggaaagtcgtgaaattgatgtgttgctctctcttttccagctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagtgtaagtgcctttaaagcttgcctcttatttctcctttactctagatagccctgcttggaaaaaattacttataaaaagaaaatgtgggccgggcctagtggcccacacctgtaagcccagcactttgggaagctgaggcaaatggaccgatcacctgaggtcaggagttcaagaccagcctggccaatacagtaaaaccctgtctcgatgaaaataacaaaaattggccaggcgtggtggcacatacctgtaatcccagctactcgggaggctgaggcaggagaatcgctttaacagggaggtggaggttgcagtgagccaagactgtgccactgtactccagcctgggcgacaaagcgagtctctgtctcacagaaaaaaagaaaatgtgaataatttttttttttccgagatggagtcctgctctgtcacccgggctggagtgcagtggcacgatctccgctcactgtaacctctgccgcccaggttcaagcgattctcctgcctcagcctcccgagtagctgagactacaggcatgtgccaccacattcggctgatttttgtatttttagtggagatggggtttcaacatgttggccaggctggtctcgaactcctgacctcaggtgatccacctgcatcggtctcacaaagtgctgggattgcaagtgtgagccaccgcgcccagcattgtgaataaatttaaagtacaaagaatactctgccaaaagaataagttatagaatttggactctttctttttttaatcttaccttaaaactttatttttatttatttatttatttatttatgtttgagacaggttctcactctctcactcaagctggagtcagtggtgcagtcttggctcactgcaacctccatctcctgggctcaagcaattctccctcctcagcctcccgagtaactgtgactacaggcgcatgccatcacacccagctaatttttatattttttgttagagatgggattttgccatgttgcccaggctcaccctgaactcctgggctcaagcagtctgcctgcctcaacctcccagaatgctgggatcatgggtgtgagccactgcgcctggccaaattttgattttttactcttgtgattttttttttttcatggagatttttgtgatgacacaaaatttacaaaattatgtacatgaaaaattacaaccgctagttttatatactacagggaaggcattgtataatgttgtgcttaagagcattcaccttggagtgagatagccctgggttcaaattgcagcactaccactcttagcttatagtagtgttaagttactgaagccttctgctctttagttatatcatctctaaatgggaataatatttactctgtaggcttgtgagaatgacattagacaaattctggaaagcaccagtgcctaataagtggtaaagctgggatctgaacccttagattaatacctgctaaaaagtttcttagtaagattgttaaagttaagggagagaattaattataagttacttcatccatagatttttttgtatttatggttatttcagtcctttgtcttttttttttttttgagatagaatctcactcttgtcacccaggctggaatgtagtggcacaatctcggttcacttcaacctctgcctcctgggttcaagagattctcctgcctcagcctctcaagtagctgggattacaggcacctgccaccatgccaggctaatttttgtatttttagtagacacagggtttcaccatgttggccaggctggtctcaaactcctgacctcaggtgaatttgcccacctccatctcccaaagtgctgggattacagccatgagccaccacgcccagtctttatttcagtcctttgtcttaaaagtcagttatcctcttcatttctaaaaggaaaatataattatgttaatttgttagtccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtaagaaagggagggaaaagcaaaacagagaattcttttccagataaaactatttgctgatcttagcaagtgtcaaaagagatatggaaacaggtaccttctcccattaagtcatctggctaactgatgttggaagccactgtgaaggactccttgtccctattatcacccctctgttaaaacaagccaagacagggatccaagtagattgagtcactcaggttttaggttttttgtttttttttgttttaatttttttttttttttttggacaaggttttgatctgtcacccagctggagtacagtggtgcaatcgtcgctcactgtagcctccaactcctggacttaagtgatccttacgcctcaacctcccaaatagctaggacagatgtgtgccacaactggttaggtttctttgattttttgttttgttttttgtttttgtagagacagggtctcgttaggttgcctagcctgttctttttttttttttttgagacggagttttgctcttgttgcccaggctggagtgcaatggtgcgatctcggctcagtttaacctccacctcccaggttcaagcaattctcctgtctcagcctcccaagtagctgggattacaggcatgtgccaccacacctggctaattttgtatttttagtagagatggggcttcaccatgttggtcagactggtctcaaactcccgacctcaggtgatctgcctgcctcggcctcccaaagtgctgggattataggtgtcagccaccgtgcctggccataaaagatatatatataattttttttttttttttagacagagtcttgctctgtcatccagactggagtgcaggggcacgatctcaactcactgcaacctccacctcccgggttcaagcaattctcctgcctcagcctcccaagtagctgggattacaggcgtctgccactaggcccagctaatttttttttatttttagtagaggcggcgcttcactgtgttggccaggctggtctcgaactcgacctcgtgatccgcccacctcccacagtgctgagattataggtgtgagccactgtgcccagctgcccaggctgttattgaactcctgacctcatgtgatccccctgccttgacctcccaaagctctaggattacaggcatgagccaccgtgcctagcctatttttaatttttatagatatataatagtaatatatatttatggggtacatgagatattttgatataagcatgtgtgtatgggtaattaggctatccatctcaagcacttatcatttgtttgtattgggattattccaaatctacctttctggttatcttgaaatatacaatgaattattgttaactatagtcaccctattgtgccaccgaacactagatcttattcctttttttttgagacagtgtctcactctgcaggctagagtgcagtggcacaatctcagctcaatggaacctccacttcctggctcaagcaatgctccaacctcagcctcccaagtagctgagaacacaggtgtgagccaccacgcccagctcatttttgtatttttttatagagacagcgtttcaccatgttgcccaggctggtctcgaacttgtgagctcaaagtgatctgcccacctcagctcccaaagtgctgcgattacaggcatgagccaccacgcccggcctagatcttatttcttctatctaattctgtttttatacccattaaccagtctctctctcccccatcccctctacccttccctgcctctggtaaccaccattttatttattacctccatgagatcaacttttttagctcccacgtaagagtgagaacatacaacatttatctttctgtgcctggcttatttcacttaacgtaattgtcctccagttccatccattttgttgcacataacaggatttctttctttttcatggcagaataatcttcaattgtgtatatacaccacgttttctttatcccttcatttattgatggacatttagtctgattccatatcttggggattataaatagtactgcaataagcatgactgattgatttgctgatttcctttcttttggatatgtacccaacagtgggattgctggatcgtatggtagttctattttttttttaatagacggaggctcactctgtcaccaggcaggagtgcagaggcacgatctcagctcactgtaacctccgcctcccaggttcaagcgattctcctgcctcagcctcccaagtagctgggattacaggtgtgtatcaccatgcccagctcattttagtttttgtttttgtttttgtttttgtttttttagtggagacagggtttcaccatattggctgggatggtcttgatctcttgacctcatgatccacctgccttggcctcccaaagtgctgggattacaggcatgagccaccgtgactggcccggtagttctatttttaagggtgttttgtttgttttgttttgttttttaagtagagacacagtcttgctgtgttgctcagactgatctgaaactcccagcctcaagcaatcctcctgccttggcctcccaatgtgctgcattacaagcatgagccacctcatttggcctattttcagttttttaaggaacctccatagtgttttccacaatggctgtactaatttcaggtttttgtttgcccccaattttaaaactattcacctaagtgcctctaatcccagcactttgggaggccgaggccggtgaggtcaggagcttgagaccagcctggccaacatggtgaaaccccatctcttctaaagatagaaaaaattagccaggcatggctggccacggtggctcacacctataatcccaacactttgggaggccgaggcaggcggatcacctgaggtcaggagttcgagatcagcctggccaatgtggtgaaaccccatctctactaaaaataaaaaattggctgagcatggtagcaggcgcctgtaatcccagctactcaggaggctgaggcaggagaattgcttgaacccaggagacggaagtcgcagtgagccaagactgtgccactacactccagccggggtcacagagcgagactctgtcgcaaaaaaaaaaaaaaaaagccaggcatggtgacaggcacctgtaaccccagctactcaggaggctgaggcaggagaattgcttgagcctgggaggcggaggttgcagtgagccgagatcttgccactgcactgcaacctgggcaacagagcaagactccgcctcagaaaaaaaaaaaaaaaaagaggccaggcgtggtggctcacgcctataatccctgcactttgggaggccgaggtgggtggatcacctgaggtcaggagttcaaaccagcctggccaacataacgaaacccgaaacccggtgtctactaaaaatacaaaaaattagctgggcgtggtgacccacgcctataatctcagctactcaggaggctaaggcaggagaatcacttgaacctgggaggcggaggttgcaatgagctgaaatcgtgacactgcactccagcctgggcaacaagagcaaaagctctgtctcaaacaaacaaacaaacaaaaaaaccaacaacaatatggagtagaggaaaggtggcacatgggctaaggtgaaaagataaaagtgatgttttccctttggtctaatgaacttattgccacagggcagagaaaaataaacattttcataccctcacatctttgcaaataattgagtcctgattaattgaagtagaaaggcagctttaaaaacagatagactatgaggtgttagtatgaaagcctttatgttttaattcagagggctgtcccatgcttagattctctctcctgtagcaactcttaccaaggaggaaaaatgtagaggcctgatagaagagaaaagataccttttaaccatcttagtccacctggctaaaaagatttttaggtgtctttagctttacccccacctcagtgttcagctggatcatttgaggccaggtgggaactgggaattaaatattgtatttgttcagactcttgactagctccaggtaaggttgaacctttggctttaagcctcaagttctacatttttttcttccccgtgtgcaaaggtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggtaggcctttgcttagatttgcttgattgatttggttatgccagtatttgtgttagatgttgttagatgtgttgtttttttgtgtgtgttttgtttcgttttctgagacagggtcttgctctgtcacccaggctggagtagtggcgcgatctcggctcactgtaacctccacctcccaggttcgagcaattctcctgcatcagtctcctgagtagctggcgttataggcacctgccaccacgccaggctaatttttgtattcttagcaaagacagcgtttcgccatgttggccgggctggtctcgaactgctggcctcaagtgatcacccaccttggcctccacaagtgctgggattacaggcatgagcccctatacctagtctatatgtttactttgttgtggagtattcatttatcttttttagtgtgatttttttttcttttcagacagagtcttgatctgtcacccaggctggagtgcagtggttcaatcatggctcaccacctccaactcttgggttcaaggcaccctcccacctcagcctcttgactagctgggtcctcaggcatgcgccaccatgcactgctaatttttgtaattttttgtagagacagggtctctctgtgtttcccaggctggtctcaaactcatggcctcaaacattcctcccacgttgccctccgaaagtcctgggattataggtgtaagccaccacacccatcactttgagtataattttaaaaaatacatattgggttttgcatgaaaggagagaaggttagcactccacttgacaaggatggaagaggccctttgggcctgacaacacacatacaaggcattgccacctactacgtggcatctaactatctttacaaaaaaagaaaaagaaaagaaaagaggctgggtgcagtggctcatgcctgtaatcctagaacttcgggaggctgaggtaggcagatcatctgaggtcaggagttcaagaccagcctgaccaatatgatgaaaccccatctctactaaaaatacaaaaattagccaggcatggtggcatgcgcctatagtcccagctactcgggaggctgagatcggagaattgcttgaacccaagaggcagaggctgcagtgagctgagatcgcgccactgtactgcagcctgggcaacagagtgagactccatctaaaaaaaaaaaaaagaaaagaaaagaaacaaaaaaatatatattggacacagttgggtatcctctaagaatttggaaattgaagatgtagctgcctgtgagagttttattttatttattttatttttgagatggagcctcgctctgtcacccaggctggagtgcaatggtgcaatctcggcttactgcaacctctgcctcccgggttcaagtgcttctcctgcctcagcctcctgagtagctgggactacaagctcataccaccacacctggctaatttttgtatttttagtaaagatggggtttcaccatgttggccaggctggtctcgatctcctgactcaggtgatctgcccgccttcgactcacaaagtgctgggattacaggtgtgagccaccacacctggccagcctgtgagagctttaaaccatgagatagacatatggttttgcaaaagtttctacataaatcagaatggttcccagaacagaaaggctcctctgtcactttttttatctggttgcttaaccataagatgccaacccaattaacagtcacacccatatttgcattatatctgtttcatatgttccgtgtaactgcctcctttcaaagtgttggtatatttttcaagtcaactggaaccaaaagtatagagaaactgaatgcaagccagctttctgcatatgtaacagtgtaagaatccaggttgtatagatgggtttttgtttgacacagatgtttctcccagtaaagagaggataaggagctggaactcgtggcacagttccctacaaaataattaattgatcatgtctactaattaaaatttctttttctgtactattgcagatacctggttttggctgggcaaggtggctcacacctataatcccaacattttgggaggctcacttgaggtgggaggctcacttgagcccaggagtttcagagcaacccgggcaacaaagtgagatcccatctgtacaaaaaattaaaaaattagctgggcatggtggcacatacctctagtccagctattctggaagcttaggtagaaggatcacttgagcctgagagatcaaggccgcagtatgctgtaattgcaccactgcactccaccctgggtgacagagcaaaaccctgtctcaaaaaaaaaaaaaaagagacacctggctttactgtgtatgctgtacctcagggcaagttttccctttgtcttctaatagacactttttggatccagaaattgttctctgcaatttctttacttaaacataattatcagcctgtatgacctctgtggtctgactactttgaaattaagggagaaggctgggcacggtggctcactcctgtaatcccagcactttgggaggctgaggtgggcggatcacttgagcccaggagttcgaggcaacatgacaagaccctgtctcgacaaaaaaacaaaaaacttagccagacatggtgacacacgtttatggtcccagctactcaagaggctgaggcagggggattgcttgagcccaggaggggctcaaggtcggcccaggaggtcaagacccaggcgatcaaggcccaggaggtcaagactgcagtgagctgtgctcatgccccactgcactccagcccagtcatcagagcaaaaccttgtctcaaaaaaaagtaaagaaagacatgtttattatatggtagtttgaaaaattacaaaaaaaagagataaatcatggccggacgcggtggctcacgcctgtaatctcagcactttgggaggccgaggcgggtggatcatgaggtcaggagatcaaggccatcctggctaacacgatgaaaccccgtctctactaaaaatacaaaaaaattagctgggtgtggtgctgggcctgtagcccagctactcgggaggctgaggcaggagaatggcatgaacctgggaggtggagcttgcagtgagctgacatcgtgccactgcactccagcctgggtgacagagcaagactccgtctcaaaaaaaaaaaaaaaaaaaaagagagagataaatcagccataatcctataccctataagccaggatttggcaaacttcttctgtaaagaaccaaatagtaaatattttaggatagggtgcagtggctcatgcctataatctccgtactttgggaggccagtgtggaagaattgcttgaggccaggagtttgagaccagcctgggtaacatagtaagactctatcactacaaaaataaaaataggtcaggcacagtggctcacacctgtaatcccagcacgtttgaaggccgaggcaggtggatcacatgagatcaggagttccagaccagcctggccaacatggtgaaaccccatctactaaaaatacaaaaattagccaggcgtggtggcgcccacctgtaatcccagctactcaggacactgaggcaagagaatcacttgaacccaggaggcagaggtttcagtgagctgagatcacaccatggcactccagtctggacgacagagtaagactccatctcaaaaaataataaataaaatagccaggcatggtagcatgcccctgtagtcctagctacgtgggaggctgtggcagcagaactacttaagcccagtagtctatatactagacagggcataaatatagttatatttaatatatttaatatatgtgtgtatgtgtatatatatgtgtgtatgtgtatatatatgtgtgtatgtgtatatatgtgtgtatgtgtatatatatgtgtgtatgtaatatatatgtgtgtatgtaatatatatgtgtacgtgtgtgtatatatgtccatatatatatatggatttgatggccatataaactctctctttttttttttcctacctttaaaaatataaaaacatgggtcgggcgcagtggctcatgcctgtaatcccagcactttgggaggccgaggcgggtggatcacgaggtcaggagacagagaccatcctggctaacacggtgaaaccccatctctactaaaattacaaaaaatttagccgggtggtggcaggcacctgtagtcccagctactcgggaggctgaggcaggagaatcgcttgaacccaggggacagaggttgcagtgagctgagttcacaccactgcactccagcctgggcaacaagagcaaaagaaactccgtttcaaaagaaaatatagtttatacatacagtggaatattatttaatcttaaaaaagaaggaaatcctccaatatgctaacaacatagtcaaaccttgaggacattaatatgagtaagccagtcacagaacaataaatactgcatgattccacttctgcgaggtatctgaaatagtcacatttatagaagcagagagtagaaagatagttgtcaggggctcgggattgaaggcaggggtgatagggagttgctaataaataagtataaagttttagttatgcatgatgagtaagttctagagatccactgtacaacattgtgtttatagttaatactgtagactgggcgcggtggctcacgcctgtaatcccaacactttgggacaccgaggcaggcagatcacgaggtcaggaggtcaagaccagcctggccaacgtgatgaaaccccatctctactaaaaatacaaaaattagccgggtgttgtggcaggcacctgtaatcccagctagtcaggaggctgaggcaggagaattgcttgaacccgggaggcagaggtttcagtgagccgggatcccgtgccactgcactccagcctgggcaacagagtgagactctgtctcaatcaatcagtcaatagttaatactgtattggccaggtgtggtggctcatgcctataatcccaatactttgggaggccgaggcaggcgtatcacgaggtcaggagttccagaccagcctgaccaacatggtgaaaccccatctctactaaaaatacaaaaattagccgggtgtggtggcgcatgcctgtaatcccagctactcaggaggctgaggcaggagaatcgcttgaacctgggaggcagaggttgcaatgagccaagatcacgccactgcactccagcctgggcaacagagtgagactctccatctcaaaaaaaataataataatactgtattgtacacttaaaagtctgttcaaaaggtagatctcatagtaagtgttatcactataaaataagattgaaatttaaaaaaacacacacaataagagaccaccacgagtacactaggatggctaaagttatgcaatttaaaagactgacaaggccgggtgtggtggctcacccctgtaatcccagcactttgggaggccgaggcaggcagatcacctgaggttgggagttcgagaccagcctgatcaacatggagaaacttcatctctactaaaaatacaaaattagctgggcgtggtagcacatgcctgtaatcccagctacttgggaggctgaggcaggagaatcacttgaaccggggaggcagaggttacagtgagccaagatcgggccactgcactccagcttgggcaacagtgcaaaactctgtctcaaaaagaaaggaaaggaaataaatacaggagtgatatgttcattcttgcaattgtgatgatgatttcacaggtgatatatggcaaaagtggccaaattgtacatgttaagtatgtacacagttgtacatatttacagtattattgtgtcagttatatcgtattaaagctggtttgttttttgttttttgttttttgtttttccgaagaacatttaaaaaggaaggcccaggccaggcatggtggctcatgcctgtaatcccaacactttgggaggctgaggtaggaagatcacttaacgtctggagttcaagaccagcctgaccaacatgctgaaaccccatctctattaaaagttagctgggcctagtggtgcatgcctgtagtctcagctactcaggaggctgaggcagggcaatcacttgaacccaggaggctgaggttgcagtgagccaaggtggcgccagtgcactccagcctgggcgacagagtgagactctgtctcaaaaaaaaaaacaggaaggtccagctgggtgtggtggctaacatctctaattccagccctttgggaggctgagctgggggaatcacttgagcccaggaatttgagaccagcctgggcaatatggcaaaactccatcactaccaaaaataaaaaaattagccagcccagtctctaaataaataaatacatacatacatacatacgtactttttaaaaaataaaatggggcggggcacagtggctcacgcctgtaatcccagcactttgggaggccgaggcaggcggatcacaaggtcaggagattgagaccatcctggctaacacggtgaaacgccatctctactaaaactacaaaaacttagccgggcatggtggcacgcgcctatagtcccagctactcgggaggctgcggcaggagaatctcttgaacctgggaggcggaggttgcagtgagccgagatcaagccactgtattccagcctgggcggcagagcaagattctgcctaaaaaaaaataaaaataaaataaaaataaataaataaaatggaagatccttgaggtaggaggatcatttgagcctaggaggtggagctgcagtgagctgtgatcgcaccactgcactctagcctgggtacagagtgagaccctgacacacacacaaaaaaaaaaaaaaaaaaaggaaggtcttgttcagaaagaaaagttgtatatagaatgggactggaagttccttatgcaagcaacagaagagttgaaaattttgcaagtactagctaattagcccaaatactgtctgagaagtataaattaaaagtaagaaatgaataactttctgatttcaaaaatgacaaattgtagttttttgttgttttttttttttttttttttttttttgagatggaatctcactctgtcgcccaagcaggagtgcagtagcatgagcttcagctcactgcaacctccatctcccaggttcaagcattctcctgcctcagcctcccgagtagctgggactacaggagcacgccacaacatccggctaatttttgtatttttcagtagagacagggtttcaccatgttggccaggctggttttgagttcctgacctcaggtgatccacctgcttcagcttcccaaagtgctggggattacatgcatgagccaccacacctggccaacaaattgttattggtgaataacatctcagaactgtgatgaggtgagataactttatcaaatgcttcacagagaagactgagatttaaatcatagaattatagaatatcacacagaaagagacaaacttaaattccagtggttcctaaaccactgatttaaaaacctagctgggcatggccaggcgtggtggctcacgcctgtaatcccagcactttgggaggccgaggcaggcggatcacaaggtcaggagatcgagaccatcctggctaacacggtgaaaccccgtctctactaaaaatacaaaaaattagccaggcgtggtggcaggcgcctgtagtcccagctacttggaaggctgaggcaggagaatgtcatgaacccgggaggcggagcttgtagtgagccgagattgcaccactgcactccagcctaggtgacagagcaagactccatctcaaaaataacctagctggacataatggcttgcgcctataatcccagcagtttggggggccaaggcgggaagatagcttgagcccaggaggagttcaagactatcctgggcaacagagtgagaccctcatctctattttcaaaaaattgtaaaaaaaaaaaatctaaagaggggcatctgagtcatagaagaagttttgtgaaaaaaaaaatctatatatagatatatgtaatttcatttttcatcctgattttctgaatcagaatttctgttaacgtttcttgggaatctgtgttttctaaaaagtctctaatgcttctgaaggagcaaatttgtttaggagccaccagttcggtccaaaccttcgcttcacggatgaggacactcaaggtctaactgaacttttttgtgctaatagctcttatcaaggtctagaactagaatcctggccacttgtttgcatatacagttcctttttataatgtgatatctgtgttaacacttttaatgtgaaattgttttataaacaatcataaataaatgaaatatatcagtttgaaaatttgttgatttcttacttatataggggctaatatatactgtgaccaaaaaaatctttataaacaagattgggaggtttaacataaacattacctttatttatctcatttttaggcgactgagtcaaagaccaacaccagaagaactagaacaacgcaatatattgcaacgtgagtccagttatggaaataaagttgtatagattttctttgtatgtttctgactttaatatacataaaagaaaaaagaagcgtttgctacaagggctaagggagagtgttccagccaggcaaggactatttatttccccatgaaggaacagagcttaccaagcttcctttggaagatgctattatggtattgtttagtgtgctgtgatactctagaaagctttgtttcagtgttctcactgtatcctggaactgccttgggcatttgggaggctttgacagtatatgggagatgtgcccaatttttctgttttcagggagctaaggaggtagctgtgcatatggagaccttcctattcctagaatgtgagggctggggcccaaagcaagtcccaaatgcagcagcttttctcttggtttaatcccttaagactttcttacctctgtagttaccaaatgggaccatatatttaatttgctgtctgtgtacataattaatttcctgaaatagcattctaatctagtacatatttcatttgtttttccagaatatagagtgaaatttggccttaaaagtctcctcactgagaaggtttgggcttccttggggctatttgtgagcatgttcagtctgaccaatccatcccctgttctctcagcactacttgggtatacacaacttaataacttagtacattttctagtgtgggagcccttataacgtatcacacaaaactcagtgtgatcaccattgtccattcttagcagttactcttgagcaagaatctgcaggcttttccttaaagcatacatagtaaacattttgggttttgcaggccaaaaagcaaatgaacaactatacgtaataggtccttacaaaaccatttaaaaatgtgaagactattcttagttcatgggcaggaaaaatacaggcaactggcgagatgtggtgccatagtttgctgactcttgcttttaagtatttgtatcgttgacaagaaaattgttttgtttagccatccccaaagttagtattttattctgatttgggcctataagaaatatctgggccgaggcgagtggatcacaaggtcaggagatcgagaccatcctggctaacatggtgaaaccccgtctctactaaaaatacaaaaaaattagccgggcatggtggcgggcgcctgtagtcccagctactcgggaggctgaggcaggagaatggcgtgaacccgggaagcggagcttgcagtgagccgagattgcgccactgcactccagcatgggcgacaaagcaagactccatctcaaaaaaaaaaaagaaaaaaaaagaaatatctgggctgggcacggtggctcacgcctgtaatcccagcactttggaaggccgaggcgggtggatcacctgaggtcaggagtttgagaccagcctgaccaatatgatgaaactctgtctctactaaaaatacaaaaatcagctgtgcatggcatgtgcctgtaatcccagctactcgggaggctgagacaggagaatcgcttgaactcgggaggccgaggttgcagtgagccaagattgtaccattgcactccagcctgggcaacaagagcaaaactccgtctcaaaaaaaaaaaacaaaaaagaaatatctgtaatgtaattactaaaacgtttgatatgcaaattgtcatttgtgagtaatattccttccttctgattgtcaactgtagctaaaaatgaagctgatcgtcaggcagaaaaacgagaaattaaacgtcggctcactagaaaggtactactgcctgtgtgttcagttaactatatgtgttatatttggatggcctatttgattggaaatgaattcacagctgggcacagtggcttgcgcctgtaatcccagcactttggaaggccatggcaggaggattgcttgagcccaggagttcaagaccagcctggggaaaacagtgaaaccttgtgtctacattaaaaaaaaaaaaaagaagaagaaagaaaagaaaaagaaaaaaatgaatttgcagcctgggcaacatggcaagaccccacctctacaaaaaaaaatatatattagccaggcatggtggtatgcgcctgtaatatcagctacttgggaggctgaggtaggaggatcatttgagcttgggaggttgaggctgcagtgagctgtgattgtgccactgcactccagcctgggtgacagggcaagaccctgtctcaaaaaaaaaaacaaaacaaaaaaccacctgataaccataatcactgggggtgggacctccagggatcaatagtgtctaaagctcccccaggtgattccaatgaagattgaagcactgggttagaggcaatttgaatgcatgattgatgcctaattattggcttggtgaactaagaggctccgtttccttcagctcagtcaaaggccaactgtcgctgaactccttgccaggaagattctgaggtttaatgaatatgtagaggtaacagatgctcaagattatgaccggcgagccgacaaaccttggaccaaactgacccctgctgacaaggtacctggaaagcactctcttgctttttttctctttctctttttctctttatttggaggatccaagatactaactagaagggagaaccataaacaaaacttctagttttaatataatattaaatttcaaatcaagatacaaaatgccaagttgaacaagtcaaaatgttatactaactcagtatgttttggtaactccaccaccaatactgaaagaaagaaaatccctgctatctcacagagtaaaaatactggaaggaataaatacatttcaaacagtggttgtttggttagagggagtttgggctatatattttagtaattaccaatatttcatttttataatgctgtgaaaaactataaaagctggccaggcgtggtggcttatgcctgtaatcctagcactttgggaggccaatgcagagggatcactcgaggtaaggagttcgagaccagcctggccaacatggtgaaaccccatctctactaaaaatacaaaaattagctgggtgtgatggcatgcacctgtaataccagctacttggaaggctgaagcaggagaattgcttgaacctaggaggtggaggttgcagtgagccaagatcatgccaatgcactccagcctgggcagcagagtgagactccacctcaaaaataaaaataaaaaattaaaattaaaaaaaaaacaaaactagccaggtgcagtggctcacacctgtaatcccagcactttgggaggccgaagcaggtagatctcttgaggtcaggagttcaagaccagcctggccaacatggtgaaaccctgtctgtactaaaaatacaaaatagccggacgtggtagtgcgcacctgtaatcccagctattcgggaggctgaggcaggagaatcgcctgaacccaggagctgaaggttgcagtgagctgagattgcaccactgcactccagccccagcaacggagcgagattccatctcagggaaaaacaaaaataaaaacaaaactataaaagctacaatatatctttcaagattttcaagtattttgattaaactaaaaattttaggtttattatgagacagatgggtatcattgtgttgacctggtgtctgggttgcctgtgaggggttgcagtgacttacaaagttaaacacagtacagaaaaatgacaagttacactgctgtgcaaagcagccagaagaagctgaaacatttttgtctctactccacaggctgccataagaaaagaattaaatgaatttaaaagctccgagatggaggttcatgaagagagcaaacattttacacggtaagacccaaaagacccaatcatatatgtgctaggtagagttttccaaaaaattgttcagatatgaagggctctaatgacatcagtaaaaaggaaaacactcagtgttgattgcaagactgcattcaaagggatgaaaagtaagaagcaatagtaaatgcctaggccaggtgcggtggctcacgcctgtaatcccagtactttgggaggctgaggcaggtggatcacctgaggtcaggagtttgagaccagccggaccaacatggcaaaaccccatctctactaaaaatacaaaaattagctgggcctggtagcaggcgcctgtaatcccaactattagggaggatgatgcgggagaatcacttgaacccgggagatggaggttgtagtgagctgagatcatgccattgcactccagcctgggtgacaagagcaaaactccatctcaaaaaaaaaaaaaaaataagtaaatgtgtattctgattatggcatttcatgtatattatttaatccttgtaataaacatgcaagatgtgttaacatccccattttatcactgaggaaatggaggctcacaatggttaagtaacttggttgacttgctagtaaattgcagaaccaggattcggagaaagaaatcaatgacttcaaggatgtgaggtgctctcttccttgtaccttactctctcaggttataaatgaggagactgtgctaagttagacaagatcttgccctctctggttcagttctgtctagcacagttgatcttaccaacttaatgtataaacaacattttaattagctgtcttcatgaaacaagccaagaaatccaacaaagccaacaagccaacaaatcaagtgttttgatttggaattacggttgtgattaaggacccacccatatccaaagaatcagctagccacaaatggaatcagtgaaagtatctttacatgattcttagaacatttacaaaaagaggcaaatgaggctgagtgcagtggttcatgcctgtaatctcgacactttgagtggctgaggcgggaggatcgcttgagcacaggagtttgacaccagcctgagcaacatagtaagactccatccctacaaaaaaaaaaaaaatctattttttgatttaggcaggggcctggtgcagtggtacacacctgtaatcctagcactttgggaggccgaggtgggaggatcactttgagaccagcctgggaaacacggtgagccccatctctacaaaaaataaacttaaaaaaaaaataagcaaggtgcagccaggcgcagtggctcacacctgtaatcccagcactttgggaggctgaggcaggtggatcacttgaggccagttggagaccagcctggtcaacatggtgaaaccctgtctctactaaaaatacaaaaattagccgggcatggtggcatgcctgtagtcccagatacttgggaggctgaagcaggagaatcacttgaaccccggaagcagaggttgcagtgagccgagatcgcgcaactgcgctccaacctgggcaacagagcaagactgtctctcaaaaaaagaaaaagaaggaccagcttaagcaagacgatgggagagaggaaaacacatggtgtttctgggtaacagaaaatgtagctggatcagaggatgtttggggcagtgtggtgaaaataaactagaaaatgggttgcagtccctcgcaatgctttgactgttatgctaggatgttggaaccattggcagttcataagcaggaaattctgtgtatttcagaacaagctctgatgcaaacaacaaagatgatatggaaggatgaagagactagcagcaaggaaaacaggaagtatctgaaataatcttagtgagcatagtggtagctcacaccagagatagtgagaatgcaaaggtgatagatttgtaagacatttcaagcatagaatcaacaagatgtggcaatttgttggattccagagatgaaataaaggagtagtcaaaatgactctgatatttttaacttgtattttttgaggtctttgaaggtgataagtttagctgaacagtttagtttattcaacaaatactgagcacctaccacgataggtatagtgctaggtccttgggctacagcaggaaataagataaagtctctgtcctcaatgaggctttattctttttttttctttttttaatagagatggggtctcactatgtttcccaggctggtcttgaattcctggcctcaagtgatcctcccatcttggcctcccgaagtgttgggattacaagtgtgagccactatgcctggccaagcttttattctaaaagaagaaggcagacaatgaacaagctagaaaataaattgcatgtgtttagtttgaggagcctatgacacatggagatacctagaagaccattagatatgcagcctagaatccagaaagaaagcaaagtctcaagatacaaatgaaagaagatagtggacctttaggggggattttatttttatttatttattttttttttttttattttttgagacaaggtctcactctgtcacccaggctggagtgcagtggcatgatcgtggctcactgcagcctcaacctctcatgttcaagccatcctcccacctcagcctcctcagtagctgtgactacaggcacaggccaccacacctggctaactttttgatcatttgtagagacagggtctccgtatgttgcccaggctgctctcaaactcctggtctcaaatgatcttctcaccttggcctcccaaagtgttgggattgattacaggcatgagccaccgtgactggccaaggaaagttgttttttatttaaagggtagacagaggaaaatgaaccaggacagcatactgagaaagatcaattgaagaagagagaaaattatggaaaagatagtgttacagaagccaagagaagagttcttttttttttttttttttttttttgagacggagtctcgctgtgtcacccaggctggagtgcagtggcgcgatctcggctcactgcaaactccacctcccaggttcacgccattctcctgcctcagcctcgcgagtagctgggactacaggtgcgcgccaccacgcccagctaattttttgtatttttagtagagacagggtttcaccgtgttagccaggatggtctcaatctcctgacctcttgatccgcccgcctcggcctcccaaagtgctgggattacaggtgtgaaccattgcgcccagccgagaagagttttaagaaggaagcagatgaggagtatcagatgcaacagaaaggtcaggtcgaattagagcagaggaaaggcagtgttaattaggtataacatttcattactactgatacattaatagcaaagcaatgtacatcatgtggtaacttgtctcttttttaatctcttttagctaccatcgtccatgatgccaaaggttgagagaggaatcaacatggctgctttgctgcttccttctccaaagtgacatatggagggaactttagcacttcccagcacagccagaattgcatcctctgggatcttctgaggtggacagcactttgaatgtagcatttcactggaacagagtcttatgtgctgcaccgggggcaaaacaacactttgtcagtgcttttgaacctttcaatattgtagcatgcttgaggagtttttcccttactggccaccaaagttctgaaccacttgcaggttccaggttttactggctgcaccacaccccttcccctagatgactgcctgtgcagagacacagtttgcaccattagccttacctgccctgccctgattgtgagacccaaatgtgtaggctctaaattccagccatcaaatccaattcctggtggggaaaaccttctggagacccccaaccttctgataaaagagtctctacctccagggaaagccttcttaccacactggcatatcagatgaaagcattgcactgtacctctcgtaacacagcaatacagtcctcttgaggcactcaagcctgagaggaagctcaggatctgacatgttcttccttttcctcacaagtcatcatgattttttattttaaaataatctggaagtaatgggaacttagtttttcctgaactccaaccagaatccaaattggttagatgaggccaggcgcggtggctcacgcctgtaatcccagcactttgggaggccgaggtgggtggatcacctgaggtcaggagttcaagaccagcctggccaacatggtgaaaccccatctctactaaaaatacaaaaattagccaggtgtggtggcgcctggttgaggcatgagaatcgcttgaacccaggaggtggaggttgcagtgagccaagatcatgcctactgcactccagcctgggcaacaaagtgggactctgtcttaaaaaaaaaaaaaaaaaaaaaatcggttagatgagaaagcatgtatattttctatatacaaaaacaagaaaggcgttttgagcccctgtgctcaggcccactcccacactgtggagtgtactttcattttcaataaatccccttattccttccttgcaaaaaaaaaaaaaaaaaaagccttagccagattcagtggctcacgcctgtaatcccaacactttgggaggctgaggcgggtggatcacctgagttcaggagttcaagaccagcctggccaacatggcaaaaccctgtctctactaaaaagtaaaaaaaattagccgggcatggtggcttgtgccttgtagtcccagccactggggaggctgaggcgggagaattgcttgaacctgggaggtggagattgcagtgagccgagatcgcgccactgcactccagcctgggtgacagagcgagactccgtctcaaaaaaaaaaaaaaagccttaatattaatgctaacgtggcagaaaactagcaggttacattttataggctattgtagttttatttaccaaatgatattctctaaatcacttcgaccaataaatgtattctcctccttaaagcagagttgtatcaactctgtgggagcatttatgagctgtcagtccccacacttctagccagaatcacaataaggtctggctgggtgtggggtgctgcataggaaagggtctctggagaagcaagaagggcacaatcatggcccactgctcccctcttcttctcagtgctctttgccctctcctgctgcgtgcttcctcttcactccagtgctgatcctcctgctctctctggcagcttccacctcacccgcccctcttccacactataaccagtatggttggtgctggggcattgactcagcccccctgctttctgcatttgtaatagatattaatatgatttcctaaaacagaagattttgttgctttctttgaacttgtattgaaaaccatacagtctcactgttttgctttaattcctatccacactataaatggaagaaaaaaattaatagcttctgtttaatctgatgaatgtggctttttttcccttcactttaatgttcaagaagttgtggctatttcatagatttcttctgatttattctgtgggtccctgttatctgttctttatgtaatctttcagtagattttcatcctttcatatccacattcttatgtggacttgctgaagaaacagaatatcagttcaaaacaaaacctaggccaggcatggtggttcacgcctataatctcagcactttgggaagccaaggcggtcaggagtttgagaccagcctgaccaacatgatgaaaccctgtctctactaaaaatacaaaaattagcctggcgtggtggcacgcatctgtaatcccaactactcaggacgctgaggcaggagagtcgcttgaacccaggaggcggagattgcagtgagccaagattgcaccactgcactccagcctgggcaacagagcgagactccatcaaaaaaaaaaaaaaaaaagaaggaaggaaggaaagcaagccctgaatccacatctccttgaagttttttttgttttattttgtttttgagacagaattttgctcttgttgcccaggccggagtgcaatggtgcaatctcagctcactgcaacctccgcctcccgggttgaggcgattctcctacctcagcctcccaagtagctaggattacaggcatgagccaccacgcctggctaattttatatttctagtagagatgaggtttctccatgttggtcaggctggtctcaaactcccgacctcaggtgatccacccacctcagcctcccaaagtggtgggattacaggcatgagccaccgtgccgagccttccttgaagttttttgtttggttttgatttgttttgttttgttttgttttgttttgtttttggagatagggtctcactctgttacccatgctggagtgcagtggcacaatcttggctcagagcaacctctgcctcccaggctcaagcaatcctcccacttcagtctaagtagctgggactacaggcacgtgccaccaggcccagctaatttttgtgttttgttagagatgaggttttgccatattgcccaggctcgtcttgaacaccggggctcaaggaatctgcccatcttcgcctcccaaagttctgagatagcaggtgtgagtcatcatgcccagcctccttgaagtttactaacaattgggataactgagggaagagaagtgacaattccactcagtctattagaggtctggatataaggtagccacacaataactctaacttgacttctaaccattctatcttattgatttggaggctgtcttctgccagattttttgtggcttgagatgatattttcgaacccttctttcactacctttcttacccttaatgtgccaagcttgaaacaggatttgatttcctgagctacttgttcgccttctgtgcgtcaccaagtaatctggttcatctttcgtctcattcatgttattttcaagtgaaacaagacattttgggggtcaagtctctttgggtgttttgtttttatgtatataaaaatggattttgtgttccctttccatgtaagtaccaacttatatggaaactcacaatcataatgtaaagaagaaatgaaagcctggtgtattgtacttcaagatgcctccctgatgtatagaatctccttgtaaaataaataattgcattgtatatcagtcttcccatcaatattaattattaaatattttagaatttttaaataccaactatactattctggtgtgaggtattttcttttacattacactctatcccaaaagattaaatccagcttaaaaatgatatgtaagccaggtgtagtggctcacacctgtaatcccagcgctttgggaggacaaggcaggcggatcacctgaggtcaggactttgagaccagcctgaccgacagggagaaaccccatctctactaaaaatacaaaattagctaggcgtggtgacacatgcctgtaatcccagctactcgggaggctgaggcaggagaatcacttgaacccaagaggcggaggttgcagtgagctgagatcgcgccactgcactccagcctgggcaacaagagcaaaactccgtctcaaaaaaaaaaaaaaaagaatttatattaaccacatataattggacccccaagatgacattacaaaaggacacttagtactttttcttttttttttttttccccaggacggagccttgctctgtcacccaggctggagtgcagtggcatgatctcggctcactgcaacctctgcctcccggattcaagcaattctcctgcctcagcctcctgtgtagctgggagtacaggcgtctgccaccacccacggctaattttttgtatttttagtagagacggggtttcaccatgttggccaggctggtctggaactcctgacttcaggtgatccgcctgcctcagcctcccaaagtgctaggactacagacatgagccactgcacccggcccaggacacttagtacttcatgttatcttttccagcaagcagcccagtttcagtccaggtggcctcagcaatgactcacttctatttgtcacttaagagactggccttgtttagtgcaccaccctttaccaagagttaaaagaaaccatgagtcagaactccttgtgtccacctgcttccagattgtccttctactagccctccaaagaagcctcaaattgctattgcccttttgaggttaaattgtctccagaaagctgttttgaagatgaagattgcccagtgtttgccaaaacaatgaatgaattttgggtctctgtggatttatataactgtaccccaggaaaaggcaggtccagcccggtgcagtgatgcacacctgtagtcccagcagcttgggaagctgaggtggaaggatcagttgagcccaggagttcaataccagcctgggcaacatagaccttgtctcttgaaaaaagaggagcaggtccaatggacactgaataggcaaaggatgaaataataagcataaaaagatgacaatgtgcaacaaagaaaatcctatccttgaagccaaaatacagccagcaccactgtttcaacgttctattccatttcagccctaggaggcatgaagggaaaaccaggaatgaccagcaacccagacctcttgctccatctgtcattttgtgtggatattgttaatttcttccccaaagaattttgcctcctatgtagagcatagaggtcatctgacaggaacaaacagctttaatgttccttcatttggcactgaggacacacagtcctcagtgaggattgtgggagggggagcattaaataaattatttaatgcttacctccttcctaccctcacccgcaacaaagacacaatcttcccgtgaccccaatttctcttcaatctattaccctctctcctgcttttcctatactcccttcacacaatctattccaatgttaaacaacccaagttctcaggccaggcagctgggctaaatgattgacagaggaagaactagtgatggagatgtaaactgaacaggcttcttggccttgcttcataacctctggtctgtgcacattgttttccctacctaaggccatattcactcagctcattaaaatctaaacgaaatccaaaccaatatggctttcctgtggtcaccagggatttctcagccttcggttattgcacttggctgctttgcaacatttggtgctttggacaatgttctagtcctcaaaactcttcttccttggcttctgaggcaccgctgtcttctggttctccttccctgactgacctttctctgtgctgctggcttcttcctcgaacaccatttaaatgctgggttttcggccaggtgcgatggttcacgcctgtaatcccagtactttgggaggccgaggcaggtggttcacctgaggtcaggagttcgagaccaacctggccaacatggtgaaaccccatctctactaaaactacaaaaaaattagctgggtgtggtggcatgtgcctgtagtcccaggtacttgggaggctgaggcacgagaattgcttgaacccgggaggcagaggttgcagtgagccaagatcacaacactgcactccagcctgggtgacaagagtgagactccatccaaaaataaatgaataaaataaaataaatgaatgctgtgttttaccgggtgtggtggctcatgcctgtgatcccagcactttcggaggccaagattggcagatcgcttcaggccaggagttcaagaccagcccgggcagtatagtgagaggccatctctaccaaaaatttaaaaaattagctgagcatggtggtgcatgcctctagttcccgttactcagaagaggctgaggtgagagaatcgtttcagccctggtggtccaggctgcagtagtcctgatcacaccactgcattccaacctcaacaacagagcgagatcttgtctcaaaataaaataaatgctggggtttcatgtcttcccatcactctcctcattcttccaagacgactttagccaccatgctaattcttacaacttctaaatattttatcaccaactcagatttcttacaggaagcccaaccccatatatctaattgctctttggacttatatacaaccagatgttactcaggtaactcgtatatactccaatgtggacattactcctcccccactgcctgcatttccacttatcaaggttagagaccatagtatgttcagcctcctaagcctgaaactctggtatcctcaagttcttctcttaccttgcaattccagtgggacgacaaaccctacatcagaaatgtcttttttttttttttttttttttttttttgagataggttcttgctctgttgcccaggctggagtgcagtggcatgatcacgactcactgcagcctccatctcctgggctcaggtgatcctcacacctcataagtagctaggattacaggaatgtgccactacactcagctaacattttttttaaaattttgtaggccggggtcgggcgcagtggctcaagcctgtaatcccagcactttgggaggccgaggcaggtggatcatgaggtcaggggttcaagaccagcctgaccaacatgctgaaaacccgtctctactaaaaatacaaaaattagctgggcatggtggcgggcgcctgtaatcccagctactcaggaggctgaggcaggagaattgcttgaacctgagaggcggaggttgcagtgagccgagatcgcaccactacactccagcctgggggacagagtgagacttcatctaaaaaaaaaaaaaaatttgtaggccgggcacggtggctcatgcctgtaatcccagcactttgggaggtcaaggcgggcagatcacgtggtcaggagttcaagaccaccctggccaatatggtgaaaccccgtctctactgaaaatacaaaaattggtggggcatggtgacacttgcttgcagtcccagctactcgggaggctgaggcaggagaattgcttgaacccaggaggcagagaatgcagtgagccaagatcgagccactgcactccagcctgggcaacagagcaagactccatctcaaaaaaaaaaaaaaaaagaattgctgcgatagtaaataatgtacgtaataaagcattcagaacaaaatctaatatgtaggaggaacaccataaacgttactactcaagatagcccagctgtgatagctctgtctctctagccaacgtttttccaccttacaccacactaaaaattccatcatatttgcaacatttcttatgtatatatatcgtaagcattctttacttgcctacttcatattcagagggttttgtgtgtggtaaaatatacataaaacttgccatttttaactagtttaaaatgtatagggggccaggtgtggtggctcaggcctgtaatcccagtactttgggaggccaaggcgggcatcacttgaggtgaggagttcgagagcagcctggccaacatggtgaaacccggtctctactaaaaatacaaaaattagccgggcatggtggcatgcctatagtcccagctactcgggaggctgaggcaggagaactggttgaacctgggaggtggaggttgcagtgagccgagatcacaccacttccttccagcctgggcgacagagcgagactccgtctcaaaaaaaaaaaaaaaaaaaaagtccaggtgcgctggctcatgcctgtaatctcagcactttggaggccgaggcgggtggattgcttgaggtcaggagttcgagaccagcctggccaagatggtgaaaccccgtcttgctaaaaatacaaaaattagccaggcacggtggcgggcgcctgtaatcccagctactggggaggccgaggcaggagaatcgcttgaacccgggaggccggggttgcagtgagccgagaccgcgccattccactctagcctgggtgacagagcaaaactccatctcgaaaaaaaaagaaagagtatagggcagtgcttttaattacattcattcacactgttgtgcaatggagttttttattttttatttttatttatttttatccgggccaggcctggagtttttaaacttttatctgattcgtctaggggcactttcatcttatttaccttcacatttatcaaattatttctttcacaggtgacagagcagattcaattccttttgatactccgtatttctctatatgtatttttttcattctgcattcttattattccaacgttttacttatttatttggagagagagtttcgctctgtcgaccaggatggagtgcatcggcgcgatctcggctcactgcaaccaccgcctcccaggttcaaacgattctcatgcttcagcctcccgagtagctgggactggaggtgcgcggcaccatgcctggcttatgttctgtattttttgtagagacggggtttcgccatgatgcccaggccggtctcgaactcctggcctcaagcgatccgcccctcacggccttcagagctgctgtaatcacaggcgtgagccaccgcgttcgactcttccaaaaactttttggccagtttatctaagggcatatcctacagactgagtccagtgattgcacagaagtaaacgtcctctgcagctacatacctacaaacctatttctgtaacgtacattccccagcaaggtcccgcgggaaggatccactaccgcgagaggcctcccagccaggaaggggtggggctcaatctgcagtagattcccagaagcctcagtgagtttctgattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggtaagtgtgatccttggtaagtgtgatcagatgcttgccaccggagttgtgggtctaatgctatagatcagtagccgagcttccctaggaagatcatatagtattttatttatttactttttttttttttttgagacggagtcggtttgtcactcaggctggactgcagtgctcgttgcaacctccgcctgccgggttcaagcgattctcgtgcctcagcctctccagcagctgggattacaggcacgtgccaccacgcccggccaatttttgtattcttagtggagacggggtttcgctatgttggtcaggctggttttgaactcctgatttccggtgatccaccaccctcggccttccaaagtgctgggattacaggcgtgagccaccgcgcctggccggaaatcatgtaatttaaaactatatatgggtgtcttaggcggcatcggtcccaactctaaagtacgcgttagacgggcctgggccagaagtgggccatggagacctcgggacccgcagggctgccgcccgacccagcgagcctctgaaggtgcaccgccacccccactgtttatcttactgcctcatagtaggcacattgtcgttctcaatataattgcacacagttttattctggatcctcatttgcctttaagaattttctcaatttttctttttatttgatcgcaccactgcaacctccgcctgctgggctcaagcaattctcctgccgcagcctcccgagtagctgggactacaggcgtgtaccaccgcgcctggcttatttttgtatttttagtagagacgggatttcaccatgttggccaggctggtctccaacgcctgaccttgtggtccgccacgccaggccgaagattttcataatttggaagcattgcgtttcgtaattatgctttctcgtatttttgtgatttgggtcatttttatttttatatttttaggattacaggcgtgagccatcgtgcctggccgatttgggggtaattaacaagtccacgtgtttcatttgaatttaggatagctgggcctaattgttgtctttgcttctgcggtaccttccacatagtactaaccgcctattgtaaagtaattagaatagctgaatatgcatgttaccagtctagaaaccgatttttttttaacaccccactgtggacagggtggaaactcgtttgctttcttgtttaagatctgtagtaacatgaatggatgaaattgtttcctattggattctgtaaatttatgcgttacactgattgtccaacgtggatacacccgggaggtcactctccccgggctctgtccaagtggcgtaggggagcatagggctctgccccatgatgtacaagtccctttccacaacgttggaaataaagctgggcctcgtgtctgcgcctgcatattcctacagcttcccagagtcctgtcgacaattactggggagacaaaccatgcaggaaacagccttctagagcactgaatctggattgaagtctttttttttttttttttttttggagatggagtcgctctgttgcccaggctggagtgcagtggcgcactccattgcctctgcctcccgggttcaagtgattatgctaagtgattctcctgccttggcctcctgagtagctgggattacaggcccccgccaccacgccaggctaatttttgtatttttagtaaagacagggtttcaccatgttggtcaggctggtctcaaactcctgaccttgtgatccgccagcctctggcctcccaaaatgttgggattacaggcgtgagccaccacacctggctggattgaagtcttaatacatgtttaagaaaaattggctaaaaagtagccaggcatgatgataggtagctggaggaaggagaatcgctggagcccaggagtgacctatactcaaacctatactccagtgccactgtactccaaccccaggcgatagcatgaggcccctcgttgaaaaagtttagggttttgctgtactaatagattaatatcttgttttgcaggatttgttaaggattccaagtaactcttatttggtgagtaaatctgctaattgttttttgcttatcagctctttgtcaatgatttctgtaatggaaataggattgaagagacttttattctagttggtcaggatttacctctgaggcatttaatcattctcagagcaatagccaaatatcgactttgctgcatttttgtaggcatgttgacataacttcaacatatgctctgttctgtaaaaattgctttttttagtcagctcattaaaagtgcaaagtagtaaaagctgccctagtgaactgtaggaagcctaattggctttatctacatgtgtagcctgagctgagaaagatactagcccttgaaaatactgtgggtgattagcaatattggatttgtcggttactccaattcctcactaatgagcattccaacgtggataccctgggaggtcactctccccaggctctgtccaagtggcataggggagcttagggctctgccccatgatgtacagtccctttccacaacgttgaagatgaagctgggcctcgtgtctgcgcctgcatattcctacagcttcccagagtcctgtggacaatgactggggagacaaaccatgcaggaaacatatctagtatactagattttaagttgaagtaggatcttcaggagtctaatcattatttcttttcttttaggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaaggtaaagttacctactggcataggggaggtgggacagccgttaagccatttggaacttgatggagacaggtttgagggaggtgggtgagattggagtttggtggactgtagagcttgcttgccaaggtgttgaggtcagggttggtttgagaatggaagctagttactagctatgattgtgggggaacacagcttgatttttcttacaagctaagaggagtgaggcagtgtttaagagggcatgttaaatgcagccaggcttggtggctcacacccgtaatcccagcacttaggctaaggcaggcggatcacaacatctagagatcctggccaacgcggtgaaaccctgtctgtactaaaaatacaaaataactgggcatggtggtgtgcacctgtgggaggctgaggcagaattgctggaacccgggagatggaggttgtactgagctgagaccttgccactgcgctccagcctggtgacagagttaagtctcaaaaaaaaggcatcttcctaaagcaattgtatttgtgcttacctgtgccaggcactgttctaggtaagcactaagtgggctttaatacagcatattccaatggggaatcccaggaaccaaaagactaattgtccaagtccacaactagaagtggcacctctgcagaaacaagcatcaaattccctgctcaggaagaagccagatgagtcagccccattcgtctgtatgcccagtcccatccgtgtcctgctgtaactacatagatctcacctgagtaaagtgatttttttctgaaccagtggttttagtatgttttcaatccatatactcaggtgggtttgggtaactgcagtgctgggcaggaaatgaatgaatttctattgacttgcaaggtagaggtgaagcaaagctgtcagtaggtgttcaggtcccactctgctaaacttcagcttgcaataccccttttttagactttccaaacaggcacttctggccttgttctttgtgtaggcagacagtattggttgcctatcttaggagtactagactgggtttgaatcctgatcccaccacttgctgttcatgagactttgggtgagttactcagcccctctgcctcaatttcatgttcacaaaataagtgataaactacctcatagagttgtaataaggacaaaggagttggtatttgtgaaaagattcttagggtctctagatggagtgcagcagcatgatcacttattaaataacattcttttgtgacttctcagaaaccaaggatacagtatccaattttttgttttttgtttttttttttttttgagagggagtctcgctctgtcgcccaggctggagtgcagtggcacaatctcagctcactgcaagctcagcctccccagcagctgggactacaggtgcacgccgccacacccggctaatttttttgtatttttagtagagaaggggtttcaccatgttagccaggaaggtctccatctcctgacctcgtgatccgcccacctcggcctcccaaagtgctgggtttacaggcgtcagccaccatgcccagcttttttttttttgagatctaatctcactctgtctccaggagggagtgcaatggagccatcttggcttgctgcaacctccacctcccgggttccagcaattctcccacctcagcctcccaagtagctgggattacaggcgcacgccaccatgcccggctaattttttttgcattttttagtagagacgggtttcaccatgttagccaggctggtctcgaactcctgacctcaagtgatccacctgcctcagcatcccaaagtgttgggattacaggcgtaagccactgcgcctagcctcaagcctgatccttttttttttttttttttttgagatggagtctttgcctcccaggctggagtgcagtggcgtgatctcagctcactgctacctctgcttcctgggttcaagcgattctcctgcctcaacctcccaagtagctgggattacaagcgcctgcaccgcacccggctaatttttgtgttttttttttcagtagagacagggtttcgccatgttggccaggctggtctcaaaactcctgacctcaggtgatccaccacgcccggcagagccttgatctcttaaccactatcctcacctcccctttccctaaggatccacaatggcctcactggctcttgaaggcaggctggcaccttgatcattcttcctggtcattagtattctgatctggttattttccattttatgtccatctaacctacttggaggatcctcaagagactgcatatgtaaactcagtacttattcttgtactgtgcctgccatatagcaagcactggctgatttaatttttctgtgttcttttttattgatttgtttttatctttattattttctttgcttattttggggttagtttgctcatctattcctagtttcttaagctagtagctgagctcattgattggagacctttctttttttctaatgtaggcatttagtgctataaatttcctccagatactgttaacaacacacaaattctggtatgttttgttttcattttaattcatttcaaaatatttttgagttccttttctattctttgatctatgggctacttgaaagtgtattattgttgttgtattagtgttgttcaaatctatccttgctagtttctttttttttggagactgcgtctccaaaggctggagtgcagtggcacaatcttggctcactgcaagctccgcctcctgggttcacaccattctcctgcctcagcgtccccagcagctgggactacaggtgcctgccaccatgccctgctaattttttgtagagatggggtttcaccatggtctcaatctcctgaccttgtgatccacccgcctcggcctcccaaagtgctgggattacaggtgtgagccaccgcgcccagcctcttttttttttttagacaagagtctcactctgttgccaaagccagagtgcagtggcacaatctcagctcactgcaacttctgcctccggagtagctggaattacagtcacgcaccaccacgcccagctaatttttttgtatttttagtagagatggggtttgcgcggctgaagtgcagtgatgcgatctcagctcactgcaacctctgcctcccaggttcaagcaattttcatgcctcagcctctggagcagctggtactacagcatgcaccaccatgcctggctaatttttttgtattttagtagagatggggtttcaccatgttgcccaggctggtctcaaactcctgagctcaggcagtccgcctgccctgacctcccaaagtgctagaattacaggcatgagccaccgtgcctggccttattttaaaattttatttcttgtaggtaacatgttgggtttttcagtatgacagtctatgtcttttaattggagtgtttaggctatttactttttttttttaagacagggtctcactctgtcacccaggccagagttcagtggcaagattatgactcactgcagccttaaactggaactcctgggctcaagccatcctcccagctcggtctcctgagtagtgaagaccacaggcatgtgccactatggctggctaaattttgtattttttgtagagacaaggtctcatgatgttgtcccagctggtcttgacctccagggctcaagcaatcctcccaccttggcctcccaaagtgctaggaatacaggcatgagtcaccatgcccagccatattatacatttttaacttacaatagtccacattcaattgatattaaaccagttcacttgtagtataagaatcttccccagcctggccaatatggtgaaaccccgcctctactaaaaatacaaaaaaaaaaaaattagccaggtgtggtggtgctcgcctgtagtctcagctacttgggaggctgaggcagaagattgcttgaacctggaagcagaggttgcagtgagctgagatcgtgccagcctaggcaacagagcaagactccgtctcaaaaaaaaaaaaggcggggcccggtggctcacgcctgttatcccagcattttgggaggccgaggcgggcggatcacgagatcaggagatcaagaccgtcttggctaacacggtgaaaccccatctctactaaaaatacaaaaaattagccgggcgtggtggcgggtgcctgtagtcccagctactagggaggctgaggcaggagaatggcatgaacccaggaggtggagcttgcagtgagccaagatcgcgccactgcactccagcctgggcgacagagcgagactccgtctcaaaaaaaaaacaaaaaaaaaaccttctggcggcctggtgtggtggctcacacttgtaatcccagcactttgggaggctgagactggcggatcacctgaggtcgggagtacaagaccagcctgaccaacatggagaaaccccgtctctactaaaaatacaaaattagccgggcatggtggcacatgcctataatcccagcaactcgggatgctgaggcaggagaattgcttgaacctgggaggcagaggttgcagtgagccgagatcatgccattgcactccagcctgggcaacaagagcaaaactccatctcaaaaaaaaaaaacaatcttccggctgggcacagtggctcacgcctgtaatccatcccagcactttgggaagccaaggcaggcagatcacgaggtcagagcgagactccgtctcgaaaaaataaataaatatttcttccatttctcactatatagtctttgatattgtcatgtgtcttacttttatatatgttataaaacccacagtacattattacagccagaacctccatatcagccagttgcgatggctcactcctgtaattccaacactttgggatgccaaggcaggctgactgctgaggctcagaagttcaagaccagcctggccaacatagtgaaaccctgtctctaccaaaaatacaaaaattagatgggcaattagctggacgtggtggtgcacgcctgtaatcccagctactcgggaggctgaaacaggagaattgcttgaacccaggaggcagagattgcagtgaactgagatcacgccattacactccagcctaggcaacagagtgagactccgtctcaaaaaaaaaaattagctgggcatggtggtgcacatctgtggtcccagctactcgggaggctgaggcagaggttgcagtgagccgagatcctgccactgcactccagcctggatgacagagtgagactcttgagacaaacaactggggctgggcgcagtagttcacacgtgtaatcccagcactttgggaggccgagatgggtggatcacttgaggtcaagagctcaagaccggcctggccaacatggtgaaaccctgtctctattaaaaatacaaaaatgagccgggcatggtggtgcgtgtctgtaatcccagctactctggagactgaggcaggaaaattgcttgaacccagggggcagaggttgcagtgagccgagattgcaccactgcactccagcctgggcaacagaatgagactccatctcaaaataaaataaaaaatacaaatacaaaactaaaaaaataaaaataaaggccaggtgcagttgctcatgcctgtaatcccagcactttgggaggccaagatgggcaggtcacctgaggtcgggagttccagaccagcctggcaaaaatggtgaaacccggtctctactaaaaatacacaaaatggccaggcgcggtggctcacgcctgtaatcccagcactttggtaggctgaggcgggtggatcacctgacgtttaggagttcaagtccaggctggccaacatggtaaaaccccgtctctactaaaaatacaaaaattagctgggcatggtggcaggcgcctgtaatcccagctactcaggaggctgaagcaggagaattgcttgaacccaggaggaagaggttgcagtgagctgaaatcgtgccattgcactctagcctgggcgggtcaggagttcgagatcagcctggccaacatggagaaaccccatctctactaaaagtacaaaaattaaggctgggcgcggaggctcacgcctgtaagcccagcactttgggaggatgaggtgggtggctcatgagatcaggaattcaagaccagcctggccaagatggtgaaaccctgtctctactaaaaatacaaaaattagctgggtgtggtggcaggcacctgtaatcccagctacctgggaggctgaggcaggagaattgcttgaacctggctgcagtgagccgagatcgcaccactgcactccagcctgggcaacagagtgagaccccatctcaaaaaaaaaaaaaaaaagagttgaggtctccttccaccacttgtgtgaagaccccagaaaacttgctttacctctttaaacttcagttttcttatcttccaactgccatgaggtttttgtgaggaacaaatgagctgacatggatgtttctgtagttaacaaaataaagggtcttacaaaataggcaataataataataatcacttattattattacatgaagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggtaagaaaccctgaagacaggggagtgctttgtggcaggctctgcatataagaattcagcctggccaacatggcgaaacccagtctctactaaaaatacgaaaattagccaggctttgtggcaggcacctgtaatcccagctatttgggaggctgaggcaggagaatcgcttgaacctgggaggcagaggttgcagtgagccgagatctcaccattgcactccagcccgggtgacaagagcaagactcgatctcaaaaaaaaaaaaagttcagttcagttggtaagaactcatcaaaagtgtccatctagactttgggtgccgtagaatgactcagagtctgaatcaacatgaaatcgagaaaacgtcctttgcaagggtttcagggaacacctgaaatcctgaagaactgtttgtatccatcctgaagaatgggtgttaataagagacagccttttcttggtacctgttttccatctctaacccaaccccaactcacacccttctattttatctggtctctctcattcctcttgctcctccccacttggctcccgttttccccaagtccattctctattttgttctataagatctgatcatattaggatgctcttgtagctcataagaagatgactgggtgttcacacgcatatgagatgtgcctccctcaaaccttgttaagacatgggcacatacccatctgatgttaactcacggggaaaaaaatctgatcatgccattcccgtgcccaaattcccatatatccctactgcctcaggatagaggctggaccccttagacacacaagaccctgtatccatgatctgtcactcccacaggcaccctctactcccatctacttggcagtttcccacaacctccctgggttctcgtggttccctgtcattgcaaacgtcgcttctcctaggatgtcctgcccccctagacttaacttggaaagctgttcttaagccccggactgagtcagatgcccctctgggtatccctgtcatagcgttgtgtggttgttgatagtctgatttttcaaccttctccatgccctcttgagggtagggaagatgagtatcttttttctccgtacagaccctaccgcacaagattttcctaaacagaccgaactcaaggagtctttctggttgttagtccacgtgtcccgatttggggtttccaaaatacacgcccactggaaccgggccaggggagccagcctggccaagggctcccccagcccggccaagggctcccccagcccgggagcgcgccacatgcagatcctgggatggccgccaggggccgccgggctctttgttttcctttctcacccgggtcggggccagaggcctgcagagcgcatgctctggggcagttcgcggcccggcggggagcgccggagttccttgtggccgacgtgcaccaaggtaggtctcgcctgggacgcgcggagggtccgggcagagggcggtaagcggagcggccacagccggagcacgggccggtccacgcgggcctaagtcgctgcccgctctcgcccgtgtcgcgcggcgccggccccacgtgaagcccggaggcaggaaggcgcggtgcgggctcgcgattccccggccccgcggggcgctccagcagcggctgggcgctgcctcgctggagctagggccgcgcggcccctccgccgccgcgcctctcacgcccgcaccgcggcgcccgcgcaggcgggagattcaaactgcgcgagcgcggcgggccgggtgcgcgcggccgcccgggcgggggatgggtctctgccgcgaggaggatggttttgtccggcatgcgcttggagaaggcggtttgcagatcggggagggagccctgcccgggagagggtgggtcgtaggagctcgagggtctcccgctgtggacctttgggagccgtgtgtcttgaactccgcagcagctcagtctgtcagcagattatttgctggccatttattgcgtccctctcttgcggggctgggggacagtagtgagaagagcaggcccgtgtcattagcgaactatgcccttgaacccaggcgacggacgctactggcaagtcattcatacgtcacatattgacctaacttcgaccacgtgtgacttgtgtgccctagcagaagttgagtgtgtggggtgttacggggagccctcagggggatcccccaccctgcccaggaggctcagggatggctttccaggtgaagtgactcttgaatggggttttgaaggaacagagtttttcaggcagtctgagggtagtgggattagggtgatacaggcagagggattgcacgtgcaacggcatgaaggtataggtattgtggtcagggataccacaggtcttgaggtgactggaggaggagagtaacaagatgatacagcaggggctgggtcacgaagcgtcttgtgtgcaagactaaggaactctgcggggtggaggaggcagggaagatttcccccaagaagggtatcagagtgaaacctggacagatgaattaggagttcacgaggctcctgtttcaaagacatcccaagagcaggaatcctgttctgttcatcgttacaactttctcatcagatgcccttgggcaacccacccagtcccccagagcattggtttccttatctgtaaagcaatggtagggggcatgtggtgaggatataatttttttttttttgagacggagtttccactcttattacccaggctggagtgcagtggcgcgatctcagctcactgcaacctccacctcctaggttcaagcaattctgcctcagcctgctgagcagctgagactacaggaacacaccaccaggcccagctaatttttgtatttttttttttttagtagagacggggtttcaccatgttggccaggctggtcttgaactcctgacctcaggtgatccacctgcctcagcctcccaaagtgctggaattacaggtgtgagccaccgcacccggccaattttttttttttttctgatacagaatcttggtctatcgcccaggctgtagtatagtgtcgtgctctcagtcgctgcagcctccacctcccgggttcaagcgattctcctgtctcagcctcccgaatagtaatatcctataattttcataaagcagtgaagttgtgtgtcccttcccccaggaaaaatgaacacataggcccaggcacaggttgtatagaacggggatcccaggtgagaaactcctagtgtgaaatataccacctgtgtgcctggcataacagcagctcaccaaatgtatattgttgacacatgagccctctcctcccttccctcctggggaccttacacacagagatttttcagccttagtctggcaggcaagttcttcctcctggtgtgggggacggagggcacagctgcagtggcctgggagggctctgtctccttttacagaaatcgaggctgtggtgaggtcactggaggtcagggcaggagcaccaggctccgggcagactgtctagactggcgtgcctacccactttcttcaataaataaggaaggtgaggtgggggtagggcagctccagctctggtggagcatggtcatgagactgggatttcattccacctctctgtgacctgggtcacctttccctgagcctcatcttccccttagctgtaaaactgggatgagtctgctcacctcaaagggcagctgtgggcattcaggagtgcctgatggtggaagctgactctgtagccgacttatctgtgactgtctcactcttctcccagagactgtatgctccttgaagatggaagctgtgttgtgtggggcggggtggggaagcatgatgccaaaagccaactccttattcccagcccagacactcactgcctggttaagaaaacagccagagaggccgggctcggtggctcacgactgtaaccccagcaatttgggaggccaaggtgggcagatcacctgaggtcaggagttcaagaccagcctggccgacatggtgaaaccccgtctttactaaaaataccaagcagttagccaggcgtggtggcttgcgcctgtagtcccagcactagggaggctgaggcgggagaatcgcttgaacctgggaggcggaggttgcagtgagctgagatcgtgagtctgaactccagcttgggcaacagagtgaggctccatctcaaaaagaagaaaagaaaagcaaataaaggaaaacacacccagagcagtgagagaagtctgtatacaagacccatttgtgcagtagaggctgtgcaggcaggtaccgggaacagggctccaccttttagaaggtggtcctctggccgggagcagtggctcacgcctgtaatcccagcactttgggaggccgaggtgggtggatcatgaggtcaggagatcgagaccatcctggctaacacggtgaaaccccgtctctactaaaaatacaaaaaattagctgggtgtggtggcaggcgcctgtagtcccagctactcgggaggctgaggcaggagaatggcgtgaacctgggaggcggagcttgcagtgagccgatatcgcgccattgcctccagactgggcgacagagcgagactccacctcagaaaaaaaaaaaaaaaaaaaaaagaaggtggccctccatcccctgcccttccctggcgattgccagcccagtgcagggcctcaagtcttccattttggagaggaagcctctgggactcaaagagcactcaggtgccgtctccaccgcagcagggagttgtcgccactgtccttccccacatctgtgggtggatctgtcaccacccaccccaccttccctcaggctctagctgcctcattgtctcctctctggtctcaccatcctctcctcagctggcttctgctctctgcttcttggacttggccaagtgcataggggatactggggaggcctgcccagactgccttagcccctgcctggaccaaggtctgccttcagaatcagtcagataggcctgggttgcttttctaggctgccctttacttgctctgtgaacttaggccgataaagttatctttctgagcctcagttccttaactgtgaaataggagtgacagtgctgccttcttcagcttcctgtgaggaataaaagggttttgcatatggaagatacagtgagttagccggtgcccccaggggctcatattttaggaagttgattggtatggtggacaggcatgtaaattaaagtgattgtgatccaaaagtctgtcccagtttctcagagagaatgactagttcaggatggaggagggatcagaggaggtgactttgagacaccagtagatgttcttccagtgggataagggatgggaaggcgttccaggtaaagagatgcaaatagtatggagaggacagttagcattctggcctggtgggtctggcaaggagattgtgtgggaagagaagggaggatgtgatagataggaaatgaagctaaaggttctgtcagtacccgatgttggagacctctaatacccagctaagaaatgtgggctttatcttccaggaaaaggggaccactaaggagtccaagcaggccagcagcttgcttcaggtttgaggtttggaaagatcatgaatgaggccgggcatggtacctcacgcctataatcccagtactttgggaggtcgaggtgggaggatcacttgagcccgggagtttgagaccagcctgggcaacatagtgagaccttgtctctacaagaaaaaaaaaaattacaaattagccaagcgtggtggtacatgcctgtagtcccagctactctggaggctgaggcaggagggtcgcttgagcctaggaggtggaggttgcagtgagccgtgtacgtgctgctgcactacagcctgggcaacagagtgaaaccctgtctcaaaaaaaaataaatatatatatgtatatatatacacacacacatatttattgatcacgaatgacttggagaatgagaggaggggatgagggtggggaccggaagaccagtgaaaagttgctgtctttcctagggaaaggaggaggagacacagttccaggcaagctgagagactactagggagcatggggaggaaggaggcagaagaaatttcttttttttttttttttttttttgagacggagtcttgctctgtcacccaggctggagtgcagtggcgtgatctcgactcactgcaagctctgcctcccgggttcacgccattttcctgcctcagcctcccgagtagctaggactacaagcgcccgccaccacgcctgtctaattttttgtatttttagtagagacggggtttcaccgtggtctcgatctcctgacctcatgatccgcccgcctcggcctcccaaagtgctgggattacaggcgtgagccaccgcgcccggccagaagaaatttctaataacactcaaggacgccagctctggagtctgactaacttggttcagatcttggccttctcttccaatcttgagtgagatacttcacctttctgagcctcagttttcttctctgtagagtgggatcattgtggccagcttgtagtgaaacgctccagaatattagccaaacacaactaaggagatgttgactgggtttgttccatccatgataacagattttttggttaatgccccatgacaccaacacttcatatagcccttatgtgtctgactccattccgggctgtgctcatggcagcccagccatcagcaccaactgtgctgacataattgtttcctgctttttctcctgacttcttattgtgagtacttttcatgctaatacagtctccctcccaggcacagcagactgctacagattattctgatgaactgatgagatgtttgccttggcatacagctgtctatctaaaacaagggtgcctctttttttggtggagggacagagtttcactcttgttgcccaggctggagtgcaatggtgcaaactcggcttaccacaacctccacttcctgggttcaagcgattctcctgcctcagcctcccgagtagctgggattacagcacgcgtcaccacgcctggctaattttgtatttttagtagagatggggttcctccacgttggtcaggctggtctcgaactcctgacctcaggtgatccacccgccttggcctcccaatctgctgggattacaggcgtgagccaccgtgcccggccacaaagatgcctcttatatcccacatccctaccccatctaactttgcctgcctgacatcctttctgggatggctcccaagcacttcagattgaatgaaaacacctagcaacatggagcttcacgtctcttctctcctgtttgttcaacagtgttctctatctcactacatggaagtctaccatctacctggtcatttaagcccaagcctgggagtctttgtgtttggccaagctcatagggggatcttgggcaggcctgccaagaatcctctggacttttttaggatgaacaaatcaagccaagtgctgtggcacgtgcccatgatcccaggctcttgggaagctgaggtgggaagatcgcttgagtccatgagttcgaggctgcaataagctaattgcaccactgcactccagcctaggtgacagagtgagaccccctctcttaaaaaaataaaataaaaggccaggcatggtggcttacacctataatcccagcactttgggagtccaaggctagagaatcgcttgagcccaggagttcgggaccagcctgggcaacatggcaagacgttgtttctgcaaaatatacaaaaattagccgggcgtggtggtgcacacctgtagtcccagctatccaggatggctcaagcccgggtggttgaggctgcagtgagccatgaccatgccactgcactcaagtctgggcaggaccctgtctcaaaaataaatacaaaggatgaacaaattatgagagtaaaaaagggttagtctcctttatccttgctacacctcctcacccaaagccaagcagtagtgtagcaggataagccgcagacaaaaccccccagacacccagttaaagaaggaagggctttattcagctgggagctttggcaagattcacgtctccaaaaactgagctccccgagtgagcagttcctgtcccttttaagggcttacaactctaagggggtctgcatgaagaggtcgtgattgattgagcaagcaggggatatgtgactgggggctgcatgcactggttatcagaacggaacagaacaggacagggattttcacagtgcttttccatacgatgtctggaatctatagataacataaccggttaggtcaggggtcgatctttaaccagacacaggtcgcggcgccaggctgtctgcctgtggatttcatttctgccttttagtttttacttctttggaggcagaaattgggcataagacaatatgaggggtggtctcctcccttagtagtaaagcactataaatatttgtggatttacaaccatttcattcagtcttgatgacagccctgagaagtagtcattgcatccccttttatagatgaggatacagttcagagaggttaaggcaactggccagccacaagctctggaaggtgaacccagttccctctaatcccaaagaatgtgcactttttagtgtgggacaaggggtctcaaaagacaggtgggaggattctcagccctgggagaataaaagttgggtgaagttcagaactgccacctcatcagtcagaactgggccagtgacaacctgcagaagctcagcctgcaaaggcttatcaggattctagacctttggttactttcccatctttagtatttagttctccttccccaggataatcagcagaaaagtgcctggccttgtgtccatataccatggaggggagagctagagaggcgaggttctcgggaaccactagaaggaaggaatgagggggctgctggttaggcccagagctgagaccgagaagggctcttggagttctccttcccttcgtaacattaggtagaggcttagacaacttgattgtttttcatgaccttaaagactgtggctccggccgggcatggtggctcacagctgttgtaatcccagcactttgggaggctgaggcgggtagatcgcttgagcccaggagttctagaccagcctgggcaacttggcaaaaccctgtctctacaaaatatataaaaattagctggacactgtgatgcgcacttgtagtcccagctattctagaggctgaggtgggaggatcacctgagctcaagaggtcaaacctgcaatgagccgtgattgtgccactgcacttgagcctgggcaacagagagtgagatgctgtctcaaaaaaacaaacaaacaaacaaacaaaaacaagtacttgatgactccattggggtcaattatgaagagacctcttagtgcaagaccaggaccttctaacagcacaccgaagtctcgagaaattcgcttagttaaatctgacaagggtgcgatgtttatgtggcccaaagcaccattctttcttggtgtatttatccaggcaagacggctaaagtgggaatccactgagactgcaacaacttcaaagttcacatcgtgaaattccttagctttgtcactagaagcaacaatttctgtaggacacacaaaggtgaaatccaaaggatagggctgggcgcggtggctcacacctgtaatcccagcactttgggaggctgaggtgggtggatcacctgagttcaggagttcaagaccagcctcaccaacatggtgaaatcccatctctactaaaaatacaaaaattagccaggcgtcgtggcaggcgcctgtaattccaggtactcaggaggctgaggcaggagaattggcttgaacccaggagggggaggttgcagtgagccgagatcgtgccactgcactccagcctgggtgacacagcaagactccgtctcggaaaaaaaaaaaaaaagaaagaaatccaaaggatagaagaaaagcaccaaatatttcccctcaaagtcatcaaggcttaggtctttgaactctccattgaccacggctgtacccttaaaatagggcgcatgctgggtgacatcaggtgcatggtatgaggaactggtaccagaattttgcttgaccggaaccagaccacaatatgtttgtcaaacttgttcttccagaagcagcaggcctgagggctgcagtggcagaaatgcccccaaggaatggcactcacatgccgggcaactgatgctcagagtaaccttcccacagcagccgcgatcttcagtgcatgtgtgtttttgtttttttgagacagtgtctgtctctttcgcccaggctaaagtacagtggcacaatctcagctcaatttagcctcagcctcccaggctcacgccatcctcccacctcagcctcctgagtagccaggacttcaggcgtgcaccaccatgcccggctaatttttgtaattttttggatagaaatggggtttcgccatgttgcccacgctggtcttgaactcctgggctcaagcgatcctcctgcctcgacttcccaaagtgctaggattacaggtgtggtggcaccttgtctctaaaaaaaatcaatcaattaaataagaaaagaaaatagctcttctccccctctgattataacaacacattaccaaagttactggtgcttacatggggttgaatggagttatgatggatatttcatttaatgttgttcttcaatgttttaattttttacaacagacttaaaaattttttaaatacatgtggccaggcacgatggctcacgcctgtaatcccgcactttgggaggccaaggtgggtggatcatctgaggtcaggagttcaagaccagcgggaccaacatggagaaaccccatctctactaaaaatacaaaataagccgggcgtggtggcacatgcctgtaatcctagctactccagaggctgaggcaggagaatcacttgaacctgggaggtagaggttgtggtgagccgagattgcgccatggcactccagcctgggcaataagaacaaaactctgcttcaaaaaaaaaaaaaaaaaaacatgtaatcggctgtacgcagtggctcacgcctgtaatcccaggacttcgggaggctgaggcaggtggattacttgagattaggagtttgggaccagcctggccaacatggtgaaaccccgtctctactaaaaatacaaaatttgggctgggcacagtggctcacgcctataattccagcactttgggaggccaaggcggggtggatcactgagatcaggagttcgagaccagcctggccaaactggtgaaacctcgtctctactaaaaatacaaaaattagctgggtgtggtggtgggtgcctgtaatcccagctactcgagaggctgaggcaggagaatcacttgaacccaggaggcagaggttgcatgagccgagatcgcaccattgcactctagcctgggtgacagaacgagactccatttcaaaaaaacaaaaacaaaacaaaacttagcagggcatggtgatgcacacctgtaatctcagctactcggaaggctgaggcacaagaattgcttcaacccgggaggtggaggttgcagtgagctgagatcatgcctgtgcgctccagcctggcgacagagtgagactccgtctcaaaaaacagaaaaatacatgtaatgctccttgttaaacatcttagataatataggaagataaaacgaaacaagtaatgattatctataataccattttccgaggttaccattgttaatatgggatatattttcttccccacatttttctcacatattttttgtgtatgcattttttttccaaaaaaaaaaaaaatggatgataggctgtttttcttccttttttttttttttttttttggttggggggtggagtttcactactctttctcccaggctggagtgctgagtgcaatggcatgatcttggctcaccgcaacctccacctcctaggttcaagcaattctcctgcctcagcctcccaagtagctgggattacagtcgcacaccaccatgcctggctaatttttgtatttttttttttttttttggtggcgacggggtttcaccatgttggccaggctggtctcgaactcctgacctcaagtgatccacccaccttggcctccgaaagtgccaaagtactgggattacaggcgtgagccaccgcgcccaggctttttttttttttttttttttgagacagtctggctctgttgcccaggctggagtgcagtggctcgatcttggctcaccacaacctccacctcgcgggttcaagcgattctcctgcctcagcctcctgagtagctgggattacaggtgcccatcactgtgcctggctaatttttgtatttttagtagagacggggttttgccatgttggccaggctggtttggaactcctgatctcaggtaatccgcccgccccggcctcccacagtgttgggattacagatgtgagccaccacacctggccgtctgtttttcattctgcttgttttacttggcaatggggaacatctttctattcaatagattgatctctgaaaacatcacttttgatggcttcatactgttctatcatgaatataccacatatttagttcactactattgaacattcgggttctgtttttgttgtttttaaaatgttatgaaggatacagtagagaatatttgtgtaattaatctgtgggtgcatccattattctgttcttgggatacattttgagaagtggaattgttgggcaattcctcttaacgtatttctagagtgtttgataaatattgtctgattggcccaggaaaatgtttgccatttctcatatgtagtatttgactgactttcaggacaggaagatgtcacccaagcgcatagctaaaagaaggtcccccccagcagatgccatccccaaaagcaagaaggtgaagggtaagttggccttggcctctttgtgggtacaggtggccccttgaaaccctaagaacccgggactgggctcctttcttcctgaggcttgaagctgaagggtgtggatgtgcagagaccccacccagctggaaggtttcctgtagctcattgaatcctaccctctgggaatcacaaagtgggcagaaactcctctcaaagcactcaggcagcactggcacaaaaaaaaaaaaaaaaaaactagaccctagggcttcaccccaggcagtgatgcattatggttaggaccactgactttccgacatgggttcaagtccttgctctgccactttctagctgctgggcaagtcacttaatcccgcagtttggattatcaacttcttaaaatggcggcagccagagcagcgtcaccctctctgggctgtgtgaggatgagatgagataatggcctggcagcatttgagggaggtggctgtggtttcctctgtcctgggaccccggagggggacagggaggagagaaaagccagcaccaaactgggaggggaagtgtggacccacgctcagacagtgtctgtcttttgcagacacgagggccgctgcctcccgccgcgttcctggcgcccgctcctgccaaggtgcctgcgggccgagccctcctgaccagaaaacccgaccaggtggctccgcgcccggggcgccctctgtgctgccagcgcgggctcctcagcggtggccacatcctcgggggaggggctgggcgccattggctgcccggggctgcgggttggggggccgcctttggcccacagagagccccgggcgcgcacctcccgcaaatgccgctgtccgctcttcctcccgcccctcctgcctctccactggatggtggagggaagagtccgtttctgcagtggatttgcccgggagctgaacttattcactggcggacggcttgggcatggaggagggcttggatggagactggggattgttctctgacccacgtagtctcccttgctttcggtgcagattctgctattataattagctttctgcggggcaaggtggctcacgcctgtcagaagatcgagaccatcctggctaacacggtgaaaccccgtctctactaaaatacaaaaaattagccttgcgcggtggcgcgcgcctgtagtcccagctactcaggaggctgaggcagaggaatcgcttgaacccgggaggcagaggttgcaattagccaagatccaccactgcactccagactggcgacaaagggagactccgtctcaaaataacaataacaataattagctttcttttctttttctttttttttttttttttgagatcaagtatcactctgtcgcccagactggaggcggcagtggcacgatcttggctcactgccacctccgcctcccaggttcaagtgattctcctgcctcagcctcctgagtagctgagattacaggctactgttggcaaggctggtctcttaactcctgacctcaagtgatccgcccgccttggcctcccacagtgctaggattacaggtgtgagccaccgcacccagcccttcttgccctctccaccaagattcatttcacagtatccagtgtctccttgtttccctttctcccctttcacgtgaataatgtgctcagttcttaatctccacaaaaatcctgtgagagaggtacttttgttgtccccatttcacagatgacaaaacttagaaagttcatactaacagtctgtggcagagcaggggcttctgcacaggtttgtctgatcccagagcctgtgacctctcctcgctgtcgtcatcctctacactcagggtctatcttcttcacccttcagtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtaggtgttggggactggcacagggttggacaaggcctggggttgggtggcttggggcagggcttttgaaccacgcatgttcactgtggaaatggagctggctagtcaagtggggagtggcctacatgagaatggactgcgaggccagacgttgcattaatgagggcatcctgggcacaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggtaaggctgggtctgaaagtctgcatggtccctgaaagacagaattaattggcggggccccaaagataatccacttccatgcccccatggtacttactggtggggagatgaaagcccacaggtagagctgaggcccagacccaggactctagcttcctcatgtgggcctgtccacgccactggctgcttccttgaatccgatgtcatcaagtgtctgtcctgggaagtgagtgggtcaaggatgtccctgggttgaggctgatccaggaggcctgctgtcttcacccatctccctgacttctgtctccccctcaccttgccagcactgcctcttccacacttcccagaggcttggatggggcaaggaggtgtggaggcagggattgtcgcatctcagagtttccaaggtacagaggagtgtagttgaaaaaacagattgtgggtttttgttgttgttgttgttgttgtttttgtattgttttgagatggagtttcactcttgttgcccaggctggagtgcaatagcgcaatcttggctcactgcaacctctgcctcccaagtttaagtgattctcctgcctcagcctcccaagtagctgggattacaggcatgcgccaccacgcctggctaattttgtatttttagtagagacggggtttcccctgttggtcaggctggtctcgaactcccgaccccaggtgatccacccgcctcagcctcccaaagtgctaggattacaggcgtgggccaccacacccggcctgatgggtgtttccttatcacatctattttgaaattttcatggagaatttcaaacacatgaaagtaatcagaattgggctgggcgcggtggctcatgcctgtaatcccagcactttgggatgccaagatgggcagatcacgacgtcaggagatcgagaccatactggctaacatggtgaaaccccgtctctactaaaaatacaaaaaattagccaagcgtggtggcgggtgcctgtagtcccagctactcgggaggctgaggcaggagaatggcttgaacccgggaggcggagcttgcagtgagccaagatcgcgccactgcactccagcctaggggacagagcgagactccatctcaaaaaaaaaaaaagaagtccgggcgcagtagctcatgcttgtaatcccagcactttgggaggccgaagcaggctgatcacctgaggggtcgggagttcgagaccggcctgaccaacatggagaaaccctgtctctattaaaattacaaaattagctggacatggtggtgcatgcctgtaatcccagctactcgggaggctgaggcaggagaattgtttgaacctgggaggcggaggttgcagtgagccgagatcgcgccattgcactccagcctgggcaacaagagcgaaactctgtctcaaaaaaaaaaaaaaaaaaaaaaaaaggaagtaatcagaatatcagaattatatttttttcttttcttttcttttcttttttttttttttttttttttttttttttttttttttttttttttttttgagacagagtcttgctctatcacccaggttggagtgcaatgacacaatctcggctcagtgcaacctctgcctctcgggctcaagcaattctccttcctcagcctcccgagtagctgggattacaggcatgcgccaccacacctggttaatttttgtatttttagtagagacggggtttcaccatgttggccaggctggttgtgaatttctgatctcaggtgatccgcccgtctgggcctcccagagtgctggattgcaggcttgagccgccacgtctggcctcttttcttttttctttgttttgagacggagtctcgctttgtcgcccaggctggagtgcagtggcgcgatctcggctcactgcaagctctgcctccctgattcacgccattctcctgcctctgtctcccgagtagctgggactacaggcgcccgctacaacgcccggctaattttttgtattttttggtagagacggcatttcaccgtgttagccggaatggtctcgatctcctgacctcgtgatcgcccgccttggcctcccaaagtgctgggattacaggcatgagccaccgcgcccggcctcttttcttttttaattagagacgagatcctgctctgtcacccaggccagagtgcaatggcatcgtcttagctcattacagcctcaacttcctgggctcaggtgatttcttccacctcagcctcgcaagtagctggtactagaggcttgtgccaccacgcccagctaatttttgtattttttgtagggacggggtttcaccgtgttgcccaagctggtcctgagctcaagcgatctgcccacctgggcctaccaaagtgctaggattactggcatgaattaccatgcctggcccagaatagtatattgagtgcccatttacttgccacacagtttcaatgattatcagcttgtggccagacttgtttatctctatttgcatccgctctctgactccttgattattttaatgcaagtcgcagaccataaatgatttcattcataagtatttgagtatgtggcctggctcctgcccacttctccatccccatctggtgccactgcccttctggatttcactggcacggggcaggcaggactggctgataagtgccctgtccctcccttctaggacaataacggtgtgattggactgttggagcccatgaagaagagcatggtgcctgtgcaggtgcagctggatgtgcctgtggtaaaggtggcctcaggtgggtctgggggcacttgctcagggcaggagttggaggaccttgttctggggctggcctagccttgggccttacagttgtggcctgcatcccttaccttttcatccttaggaaacgaccacttggtgatgctgacagctgatggtgacctctacaccttgggctgcggggaacagggccagctaggccgtgtgcctgagttatttgccaaccgtggtggccggcaaggcctcggtaagtggccttggtacctccagcagggcaaattggcaggccacccccacagtgaaggccaaaggcaggaaggatttgctgtggtcaggcttgcatcagatgggcttgtggtgttggttaggactttggagacagactgctctggtagttttgccacctactgtctatgggactctgaacatagtttcttcatcactaagtctacctacctgtaaacctacttcattaggttgctgtgaagttaaatgagttaatgagaagaatatcaggcagatggtaagttccacgtaaatgatacccgtaatgactgtgggaatctgagcaaggcacttgtattctcttgatctcagtttccttttctataaaatagggataagagtccctacttagcctctcaagggcttttataatggaggagaattaaactcggggcagagagaagccatgtgtgtctgtctgtcactgaccgtggctttccctttgcctgcagaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggtgagccccgagcccagcttcaggcatgacccagtggcctgcgttcctgtcctggctctgccactcattcattgtgcatcctttgcggggtcgtctaacccctccaagccagttttgtcatctgtaaagtgagaatgtccatatcctgatgggaggtggcctcactgtgggaggagattgagaagggcagctctcagaacaccttcacccctgatggctccggcctttcccccaggaactccgggcacagaatcttgcttcataccccagaacctaacatccttcaagaattccaccaagtcctgggtgggcttctctggtggccagcaccatacagtctgcatggattcggaaggtagggcctttacgtccttctctagtttgggggtggagtgttccctggcctaggcctagccagattcctgagaccatggtccttggagcctgggtctgttccatgggttgtaccatacatgggtccatgagagtcactctcatcctcctagagtcctggtgttcttccaagtgtgagttcaatgggggcccatgtagattctcctaggcctcctccaaaactgggaagagacactgcagatctccttctgatcgctctgggagcagggacacactcccatggacaggtggactcacctagcctgccacccattttgcctgtagcacgccctctgctattgctcatctctctccctcctcccataggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtgagtggggctgcctacactctgtctagttgggacctgggggtcatggttcttacccaattccccaataggctgtgatgtccactctcgggggagccgaggtacagagagcagtgtttgtgatggcactttgttcctgcttctcagaagctctggcattgatgaatatgaaatgagtacacaaattattttagtaaaggtgacttattatgcagaggagagaaatagcaaagagtgagatatcactgaggcctaaggaggcaatgggactggaacccaagtctccagactcctaacccaggctgctctctcccctcagggtgaccccttcatatatcaccttgtatgttcccgctttccagggacttttacttagaatctaaatcaagaaaaaaaaaggcttagtagtcagagttgtagcaactatagcagaggagggtgtgaacaagtgaccaccaaagcctgagtgggtgagggggatagccatggaggtcctgtagaagcctggagctggcagaggtgcttgacctgaggttatctgggaagacttcctcaggaagtggggcttgcactgtaccttgaaggttccattccttgtgaaaagcaaagaatgccattccaggcagaggaacatcagggcagtctcaaaggtggctggtcctgggaacagagggtggggtaggaccttgaatgccacgcctaggagcagcctttggcagtgtgtagggactgtgctctctggtttacagagttcttttttatccatcatctccttgggttctcccaacttccctgaactcccagagtctggtaccttgccaagctgctattggccaaggccacagtccacgcccatgtcccaggtttctcctgctacagaaaggtgggctggggatcctggagacagctgtacccatttctctctcttgcaggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaataggccacttgttttctacacattccctgctttttaagggagcacatattatgtgccaggcactgctgggaaagacagaataaactataaacctggtgttgaggctacaacttaagtgatgtcaagatgtcctgaggtgccaaccagctgtcagtgtgactgtaacaaaggcttcaaatctgtcaagaagtaaggaaaagttttgtttgaattttgtttgggtatttctgttttgggagtcactggattatttttaaatgctgcatagtacaatagaggcagggtggatcttttaataccaaaccaaaaaaaattttttttttttgagacagagtttttctcgtggcccaggctagagtgcaatggcgcaatcttggctcactgtatcctccgcctcccaggttcaagcaattcttctgcctcagcctcccaagtagctgggattacaggcatgcatcaccatgcctggctaaatttttttgtgtttttagtagagacagggtcttgccccgttggtcaggctggtcccgaacacctgaccgcagatgatctgcccgcctcggcctcccaaagtgctgggattataggcgtgagccaccgcgcctggccgatttttttttttttttttttgagacagtcgctttctttgcccaggctggagtgcaatggtgtgatctcggctcgctgcaacctccacctcccgggttcaagtgattcttctgcttcagcgtctgaagtagctggaattacaggcacacaccaccgagcccagctaatttctaaaattatttatttatttattgaggcggagtctcgctctgttgcccaggctggagtgcagtggcatgatctcggctcactgcaacctccgcctcccaagttcaagcgattctcctgcctcagtctcccgagtagctgggactacaggcgcgtgccaccatgcctggctaatttttttgtatttttagtagagacggggtttcactatgttggccagactggtctccaactcctgacctcctgatccgcccacctcagcctcccaaagtgctgagattacaggcatgagccaccgcacccagcaatttatttatttagagactgagtttcgctcttgttacccaggctggagtgcagtggtgtgatctcagctcactgcaacctccgcttcccaggctcaagtgattctcctgcctcagtaatcccgagtagctgggattacaggcgtgcgccaccatggccagctaatttttgtatttttagtagagacggggtttcaccatgttggccaggatggtctggatctcttaacctcgtgatccacatgccttgacctcccaaagtgctggtacaataggcatgagccactgtgcctggccaaaccaagattttttaacacagtaccatctctagaaatgcttactgaggccaagcacggtggctcacgcctgtaattccagcactttgggaggtcaaagtaggtggatcacttgaggtcaggagtttgagaccagcctggccaacatggtgaaaccccatctctactaaaaattaaaaaactagccaggcgtggtggcacgtgcctgtaatcccagctactggggaggctaaggcaggagaatcgcttgaacccaggaggcggaggttgcagtgaactgaaatcgcgccattgcactccagcctgggtgaagaagcgagactccatctcaaaaaaaaggcttactgagccgcttgtgtattgttttcagcaactgatgtacttatttaaccatcattatttgcacaataataaaaagtagggcatgccccaccacacccagcacttttttttttttttttttttttgagacagtgcctttttttagcccaggctggagtgcagtggcgccaccttggctcactgcagcaactgcctctcaggttccagtgattctcccgcctcagcctcccaggtagttgggattacagtcatgcgccactatgcctggttaatttttatacttttagtagaaacagggtttcatgccttacacagtaattcttaacgataacatattactgtagattttcacaagcatttgacccacaaaaatcacacacagctgacttgtgcaatacagtggtcactagccacatgtggctgtttacattgaaatcaattgtccgggtgtggtggctcgtgcctgtaatctcagcactttgggagaccgaggtgggtggatcatgaggtcaggagatcgagaccatcctggctaatacagtgaaaccccctctctactaaaaatacaaaaaattagccggtcgtggtggcaggcacatgtagtcccagctactcaggaggttgaggcaggagaatagcatgaacccgggaggcagagcttgccgtgagccgagattgcaccactgcactccagcctgggcgacagcgagactccatctcaaaaaaaaaaaaaaaaatcaattaatatatatttaaaacgaaataaactcagtttcgccaggcgtggtggctcacacctgtaattccagcactttgggaggccaaggcagacagatcacttgaggtcaggcgtttgagaccagcctggccaacatggtgaaaccctgtctctactgaaaaaaaaacaaaaaaaaaatataaaaattagctgggcatggtggtacatgcctgtaatcccagctactcgggagtctgaggcaggaaaatcacttgaacctgggagatggaggttgcagtgagctgataacaggccactgcactccagcctaggtgacagagtgagactccatctcaaaacaaacaaaaaactcagtttcagttgtacaagccacatttcaagtagtcacgagtgacaagctagtacttgtggtatgggactgtgcaaatacagcacatttcccattgcagaaagttacaatggacagtgctgatacaaagaatcggtgtatggtaacaggaaagttttattaacaccaggaggattattggatgtcagagacttggaaaaatgaatatgatattaaaaaaatgtaatatgtggctcatgcctgtaatcctagcactttggcaggccgaggcgggcggatcgcttgaggtcaggagttcaaaaccagcttggccgtcatggtgaaaccctgtctctatgaaaaatacaaaaaattagctgggcatggtggtgtgcacctgtaatcccagctattctggtggctgaggcaggagaattgcttgaacctgggaggcggaggttgcagtgagccgagattgtgccaccacactccagcctgggtgacagagtgagacaccatctcaaaataaattaggcctggtgtggtggctcatgcctgtaatcccggcactttgggaggccaaggtgggtggatcacgaggtcaggagttcaagaccagccaagatggtgaaaccccgtctctactaaaaaatacaaaaaaattagccaggtgtggtgttgagcgcctgtaataccagctactcgggaggctagggcagagaattgtttgaacctgggaggtggaggttgcagtgagccgcaattgcaccactgcactccagcctgggtgacagagcgagacctcatctcaaaaaaaataggccgggcgcggtggctcatgcctgtaatcccagcactatgggaggccgaggtgggcggatcatgaggtcaggagatcgagatcatcctggctaacagtgaaaccccatctctactgaaaatacaaaaaaattagccgggcatggtggcgggcgcctgtaggtacttgggaggctgattcaggagaatggtgtgaacccaggaggcggagcttgcagtgagccaagatagcaccattgcactccagcctgggcgacagagcaagactccgtctcaaaaaaaaataaataaataaataaaaataaaaaataaaagtaaatttaagaaaaatttaaggccaggcacggtagctcacgcctgtaatcccaacactttgggaggctgaggtgggcagatcacaaggtcaggagatcgagaccatcttggctaatacagtgaaaccccaactctactaaaaatagaaaaaattagccgggtgtggtgatgggtgtctgtagtcccagctacttgggaggctgaggcaggagaatggcgtgaacccaggaggcggagcttgcagtaagccgagatcgcgctactgcactccagcctgggcaacagcgcaagactccgtctcaaaaaaagaaaaaaaaaaaaaaaaaaaaaaatatatatatatatatatatatatatatatactcttttttcttgaacttgtagttttgatgcaggcactatattttaatatttgctttgcgaaaagtacttgtatgtccgctactccagccccaaaaaaatcctttggaattatatttattggagttttcccactcagcaatataatatagcagggtgaaagtacctcttttttttttttttttttttgagacagtgtcttactctgttacccaggctggagtgcagtggcatgatcaccactcactgcagccttgacttcctcaggttcaggtgatcctcccacctcagcctcccaagtagctgggaccataggcatgtgtcactacacttggctaatttttgtatttgtttgtagctacagggttttgccacgatgtacaggctggtgtcgaactcctggactcaagtgatctgcctgcctcagcctcccaaaatgttgggattacaggcgtgagccactacacctacaaaagtacttcgttattggtcaggtgcggtggtcacacctgtgtagggaccagccctacagggcctgtgggttttactccacgtgtgtggagaccagagattgtagaaataaagacacaagacaaagagatagaagaaaagatagctgggctgggcgcggtggctcacgcctgtaatcccagcactttggcaagccaaggtgggcggatcacaaggtcaggagatcatagccatcctggctaacacggtgaaaccccgactctactaaaagtacaaaaagaaattagtcggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagtttgcagtgagccgagattgcgccactgcagtccgcagtccggcctgggcgacagagcgagactccgtctcaaaaaaaaaaaaaaaaagaaattagtcgggcgtggtggcgggtgcctgtagtcccagctactcaggaggctgaggcaggagaatggcgtgaacccgggaggtggagcttgcagtgagccgagatcacaccactctactccagtctgggcgacagagcgagactctatctcaaaaaaaaaaaaaaaaaaaggcaactgggccccagggactactaccaccaagatgcggagactggtagtggccctgaatgcctggctgtgctgttatttattgtatacaaggccaggggacagggtaaggagtgtcagtcatctccaatgataggtaacggtcatgtgagtcacgtgtccaccagacgggggggcccttccctgtttggtagccaaggcggagagagaggggggacagcgtacgtcattatttcttctatgcatttctctgagagatcaaagactttaatattctcactaattctgctactgctatctagaaggcagagccaggtgtacagagtggaacatgaaagtggaccaggagcatgaccgctgaagcacagcatcacagggagacgtttaggcctccggatggctacaggcaggcttgactgatgtcaggccttccacaagaggtggtggagcagagtcttctctaactccccaggggaaagggagactaccgttcccggtctgctaagtaatgggtaatgggtgccttcccaggcactggcgctactgctaggccaaggtcgctaagtaacgggtgccttcctgggcactgccgttaccgccctttagtggccctgtccgggtgtgacagagggctcacactcttgtcttctggtcacttctcaccgtgtcccttcagctcctatctctgtatggcctggtttttcctaggttataattgtagagcagatattattataatattgggataaagagtaatgctacaaagtaatgattgataatattcatataaaatcatgtctatattctatgtctaatatacctattcttattttaaggattttctttattatactggaacagcttgtgccttcagtctctcgcctcagcagctgggtggcttgccgcccacacacctgtaatcccagcacttagggaggctgaggtgggtggctcacctgaggtcaggagttcaagaccggcctggccaacatggtgaaaccctgtatctactaaatctactaaaaatataacaaattagctgggtatggtggcatgcagctgtagtcccagctactcaggaggctaaggctcgagaatcacttgaacccaggagggggaggttgcggtgagccgaaattgtgccactgccctccagcctgggtgacagagcgagactgtctcaaaaaaaaaaaaagaaagaaaatagtacctcctttttttttttttttggagactctgtctcccgggctggagtgcagtgggtgcgatctcagctcactgtaaccttcacctcctgggttcaagcgattctcctgcctcagcctcctgagtagctaggagtccaggcatgcaccaccatgcccggctaatttttttgtatttttagtagagacggggtttccccatgttggccaagctggtctcgaactcctgaccccaagtgatccaactgcctcggcttcccaaagtgttgggattataggcgtgagccaccatgcccggccagtatctcattcttaatagctcatatgcattgggacttcgagtagggtaggcatcgtattgagcactttacatgcaatagcttgtttaatcctcacatcagctctactatccttcagggaacagtccctgccagttgaagtgacttgcttgaggtcaggaggctaccaagtgcatagtctattcagcctccacctgagcccagaacctcagtattttttcctcatattgtacctaagagttataaagttccctagatgttttatgtatattagaacagtgccagccacgtagtaaatgctatacaattctttgctattatgattattttacattttatattccctgtagttaataattgccttgtttttaatgtactttgttttgtttgtataagtatcattaattcagttccaatatatcagaagtataaatcttttgggtgttcaaacacatcacctactttcaattttatcttttcctccgtcctctcccaacctgaattaattaccccgaaataaatgtaaagtaatacaacatatggctgtgctataaataatacttacagtcataataatgtggatgttcaacagtgctttaacaaaatatcatcaggaaggctgggcacggtggctcacgcctgtaatcccagcattttgggaagccgaggtgggaggattccatgaaggcagtagtttgagaccagcctgggcaacatagtgagacatccccctgcacccaatctctaccaaaaaaaaaattatgggtgtggtggtgcacacctgtagacccagctattgagggcagggaggctgaggtgggaggactgcttgagcccaggatatccaagctgcaggggctgtgattataacactgtactccagcctgggtgacagagcaagaccctgttttttaaaaagttggggtacggtggctcacgccagtaatcccagcactttaggagaccgaggcgggtggatcacctaaggtcaggagttcaaggccagcctgaccaacatggtgaaaccccatctctactaaaaatacaaaaattagctgggtgtggtgacgggtgcctgtagttccagctactccagaggctgagacaggagaatcgcttgaacctgggaggcagaggttgcagtgagcggagaccctgccattgcactccaacctgggcgacacggcgagactctgtctcaaaaacaaaaaagaggccgagcacgatggctcatgcctgtaattccagcactttgggaggccgaagtgggcagatcacctgaggttgggagtttcagaccagcctgaccaacttggagaaaccccatctctactaaaaatacaaaattagctgggcatggtggcgcatgcctgtaatcctagctactcaggaggctgaggcaggagaatcgcttgaacccgggaggaggagattgcagtgagccaagatcacgccattgcacttcagcctgggcaacaagagctaaattccatctcaaaaaaaaaaaaaaaaaaaaagccaggcgcagtggttcacgcctgtaatctcagtactttgggaggctgaggtgggcagatcacgaggtcaagagatcgagaccatcctggctaacatggtgaaaccccgtctctactaaaaaaatacaaaaaattagccgggcgtggtggcgggtgcctgtagtcccagctacttgggaggctgaggcaggagaatggcgtgaacctgggagacagagcttgcagtaagccgagatcgcgccactgcacactccagcctgggtgacagagcaagactctatctcgaaaaaaaaaaaaaaagaaaagaaaacataggagatggagagataagtgtctatgtatatggggagggggcagccactaaatacctgaaactgcaagtaaaaaagtagtgtagtagaaagtatatattttaaaatacacaggtaggttctaggaaaaagacttggaaatagtcgactcaagggagtgggaattcgggggcagagggtaagagaccactgtctctttccatttttttaagacagagtgtctctctgtcccccaggctggagtgcagtggcatgatcttggttcactgcagcctccgcctcctgggctcaagcaattctcatgtctcagcctcctgagtagctgggattacaggcacgtgccaccatgcccagctaatttttgtatttttagtagagatggggtttcaccatgttggccaggctggtctcaaactcctgacctcaggtgatctgcctgcctccacctcccaaagtgctgggattacaggtgtgagcccctgcacctggccaaaaataaatttttttaataaagagcacagcacagtgactggcaaataatactaaattaatagctgtcagttataattttaaggcttccaactgccatgttggaggatttactgaatgctaggcattgggccaagtactttcccaacttatttttttcctcacaaccaccctgtggggtaagtaagcactatccacattaggcccagaagttaaataaataattagcaagaggtggggccgggattatgctccatttgtttgaatctacagccaaaatgcctaaccactacactactattgcagtgatggtaggatacggccagaaatatggcaactcgtggttgaacctcaggttttcagactgatgagtctctggcttgagagcacaacatcctaagttgaggatgtatagactggtaggaaaggactttgggtgcccattagtccagagggagccccagaaagtggccttaaaacacttggagtgggtttcactgtcagagatgccaattactacatacagaagaagctttccatactgacgactgggcaccaaagtaagtcagaggcctgggatactcccagagtaggagc

SEQ ID NO: 174 - DNA, 119437 bp, Homo sapiens
aaattggaggaccaaagttggaactgtgcttttcatacctgaatcttctgtcccctatttgccctcctaagaatattcattgacctttggacttgaatcaggggacctattgtctattatattgtttttggcccataagtatgaccacttcaagtggagaagttctacagttctaatcgctgattccagacaggaaaggtggtaattaaaggagtctctacaatctggagtaagtttagggcaacaaaaggaaaaatgtcttaggccttctatcagccactgacatgccttttgatgttccagatagtacctagggtacaggttatgagggacaggtcccgtgtaagtatactgatacccatttgcataagaataagcctggggacaccatgggcaaaggtctttggattacctccccacttgacttaggctcctagccaaaagattcttagacttgatctaggaaagatcctagaggataggacctcaagaaagtcttctctgaggacgttaggacccaggaggcatgggtcagaaaagacatgaaatgcacgcatgggcagctgcagtgtagaggcttctcgctgtgccatgatctcaactgggtcagtgctgggagttcaggacgacagttttccgcctctagccagccctcagcttttcccaggaaaggtagagaaaggtggacctggttccaggcaaaccaacactcccagcccagagggccgggggttgttagagagccctttcccagagagcctcacacctgtgtcttaagcctggcggctgcgcttgtcacttttttttttttttttgagatggagtcttgctctgttgcccaggctggagtgcagtggtgcaatctcagctcactgcaagctctgcctcctgggttcccgccaatctcctgcctcagcttcccgagtacctgggactacaggtgcccaccaccatgcctggctaatattttttgtatttttagtagaggtggggtttcactgtgttagccaggatgatctcaatctcctgacctcgtgatccacccgccttggcctcccaaagtgctgcagttacaggtgtgagccactgcacccggccgcttgtcacatttaaatggctgacaggtgcctggtgttttcttccaatttctaatgagaagatagaacagaatagcaagcaagaggggttcaatgttactcactgctttggagaaatcctgaatgtgtccccagaaatgagacgagaagtcttctcctgatcaaaggtcttttcttgattgaagggttcgtggtttcacaggcttcaaggaaagaagccatggacctcagtggtgagtgttacagctccattagagaaacatgcagacccaaagagtgtgcggtggcaagatttattaaagcaaaagtgaaagtaaagtgaaagcgaaagtaaagcttccatatggtggaagggaacccagaagggttgcccaatcctttttttttttgagatggagtctcgctgtgtcgcccaggctggagtgcagtggcgcaatctcggctcactgcaagctgcgcctcctgggttcacgccattctccagcctcagcctcccgagtagctgggattacaggcgcctgccaccacgcccggctaattttttgtatttttagtagagatggggtctcactgtgttaaccaggatggtctcgatctcctgacctcgtgatccacccgccttggccttccaaagtgctgggattacaggcatgagccactgcacccggccaagggttgcccaattctattcaatcttaatcagtttgaccatgaggtgagatttttatgaacctttcataaccgtttacaaatcttgctaaagaggagtagcatcttaagaaaaccttgttgtgcttttctttttttcttttttttttttttttgagatggagtttcactcttgctgcccaggctggagtgcaatggcgtgatctaggctgaccacaacctctgcctccagggttaaagcgattctcctgcctcagcctcccaagtagctgggattacaggcatgtgcaatgacgcccagctaattttttgtatttttagtagagatggggtttctccatgttggtcaggctgctcttgaactcccaacctcaggtgatccaccctccttgacctcccaaagtgctgggattacaggcgtgagccaccatgcctggccatgtgcttttatttcagtgctccattttcagaaaaacccttttgaatttagtcaatatgttcacagtttccttttggaagattaatttttacagtctttccacatttgcttaaactttttgttttattttatctaatttaagacaatcctgtatccctaggcaaaatgtgcatttccatgccttcttataatctttgactaaaaagatactttactgttcttgcacaccttgcatgtaaatctattttcagtagtctaaattacatgttataacagtaactcttagcaattttcaacttcaatgtaaaacctggtaaagttgttttaattatgtgctaggtgcagataaagtctgactccttccagcatagttaggggaatggttacttccatatgtccccaggtcttaccaattgtgaagcaggcaagtttaaaggccaaagaagaagtttacaaccttaaaacattcagcaaacctagtatctgacctgcataatttagaccatatatttacatcttgaagacatctacactttaccaataatttttaaggctgtttttatttttcaaaaattaaagtcacatgaactgaaaggtaccacaaccttcattatccctttaaaaaatatttaatccaagcacttacccttcaagtcaattaattagaggtcttttttaacagacatcacacacataacccatataggactatatagatagaagaagatccagcagctcaggatggagctatttaggaatagggccagaaaagcatgtagtttttggagcctaataaacatgcacagttggaagacaaaaacagattttaaaagggattccagggattccatgtggaaaacagatttttttcctaaatgggatttctggcatcttgtctgttttcccaaggagtcccaggccaccagaagtcatcctagggcctttcatccatgcaccaagaatggcaagacagagtgggaaaaagtaattcagttgccagagaaaaaaagccttttccagaaaaacaagatttatggagggaaaaacataaaggcctcttgaatatacctataggttggatactcagtttcaattaagccaagtgctcttcatgaaaattgtttttcattaatcaaaactttacagagaatataaacagtgatccttatcatttcttttactggtttgtaccactacctgttcacaatcatgttcaggttccccaatttcctctgggagaaagtggctgggtttaggcaagggcaggttttcaactggactgcagattcctctagcagcaaagcttgatttttgatgaggcgatttttctgttagccagagacttcccttagaggacagcagtcctgctatactgtgtggggtgcaaacagttaagttattccccatgtttaacccagtggtttctgccaccagcaaagccactgctgcaactgcttggaggcaggctggccatcctttagccacgaggcgaagttccttgcttaggtaacctactggctgttgagttggacctttagccttagttaaaactcccagggccagccaggcatggtggctcactcctgtaatcccagcactttggaaggccaaagcgggtggatcacaaggtcaggagatcgagaccatcctggctaacacagtgaaaccccgtctctactaaaaatacaaaaaattagctgggcatggtggcgggtgcctgttgtcctggctactcgggaggctgaggcaggagaatggcgtgaacccaggaggtggagcttgcattgagccgagatcgtgccactgcactccagcctggacgacagagcgagactatgtctcaaaaaaaaaaaaaaaaaaaaaaaaaagacacacacacaaaaaaacaaaaacaaaaaaactcccagggccattcccttcctttgtgatacatagaaactaaatgccctccctatgggaagactgagggatggatggtgtattaaataaagcttgctttaactggttaaaggcttttgagttttaggttcccaagttagggagtgagttttagctgcttgagtttcttttgtgaggtggtataaagggcaagctatttcaccatacccaggcactcacagtctgcaaaatccagtaatgcctaagaatacccttaactgttaaaggaaatgggcttaatcctttccttacctggtgctctgttcccttctgataagaccagacccagatactttactgaagtttgacaaagctgagctttagattttgagaccctatattccctttcagctatgaaattgaagagagccttagtaccttcctgagacctccttggttggggcacagaggagagtgtctttacatactacaaagtttcaacttgagggtgacaaaaactagaatgatctttggacagggcctgtttcagcaacttgcgtctgctatcaggtgctgcctgagtaatgaacctgttctttattgaattgagagacagggaggtgtgtttcactaaagcttttttcagcctttccaaaaaggctgagagattttcatttggtttctgattcaacaaggacagtttacagtaattaagagttttggttctgattctttgcaagccttttaatatgcacatcagaaagtgttttcttttccacttgtctatgggatcaccaggactccaattagaggtttttttctttttcggagttttgctcttgttacccaggctggagtgcaatggcccaatctcggctcaccgcaacctccatcttctgggttcaagtgattctcctgcctcagcctcccgagtagctgggattacaggcatgcgccaccatgcccagctaattttgtatttttagtagagacggggtctctccatgttggtcaggctggtctcaaactctcaacttcaggcgatccacccgcctcggcctcccaaagtgctgaaattacaggtgtgagccaccacgcccagccccaattagggtttttaaggggcatagtttctcttcctgttgggaaaggggattctgtctcttttttaccatgtttccccttttgactgggtttttcttttgactggttataggagacatgctgttcatctctgaatatccctgctgtctgtagggcttcttgtttctctgcaacagttagggtttggcataaaagtagcatagcatctccccatgtaagatcaaacacttggattagattttagaaagcctctatatatctatgaaggtcatcagagaacttgcctagctatccctttatttgtctaaggtcctgcaatgagaagggaacttgaaacctagtagcaccatgtccattcagcatttcctgcaaaggcaacagcgaagttggcagctttttgggtagcatagctggaggggctgatgatatggctattgggggccctggatacaggaggcagttagggcactgagaagttgcattagagggttcctcaagggtttgcctctctgactttggggaattatattctgtagacttgcctgatatgactgccaagagggaagggttaattttacaacacttacaaagatgggggttgtctcactgggaaaaataagatctagttgttggatagtattgaaattaatgcttccctgaggaggttagacctcctgtctgtaagagggccttgcccttgtgcaatagaatataagctgttttttcttcagagtctcacaatcaaaggagttccagtgtttcagaatgcacttgaggagagtgcagacttcagatggtttgttatcgggggaacccaccgccaatatttcaacgtaggttctttctattttccataagtgtcagccagctgagaaataaagagaaagagtacaaacagaggaattttacagctgggcctctgggggtgacataacatttctgtaggacagcgatgtccacctgagcgcaaaaaccagcaggtttttattaaggacttcaaaaggggagggggtgtacaaacagggagtagatcacaaagatcacatgcttcaaagggcaaaaaggaaaaaggagaacaaagatcacatgcttctgaggccaataaagatcacaaggcaaagggcaaaatcaaaaactcctgataagggtctatgttcagctgtgcacgtattgtcttgataaacatctttaactacagaaaaaagggttcgaaagcagaggaccagtctgacctcaaatttatcagggagtggttttttccccatcctaataagcctgaaggtactgcaggagaccagggtgtatttcagtcattatctcaaccgcgtaagacagacactcccaaagcagccgtttatagacctccccccaggaatgcattccttccccaggatattaattattaacattccttgctgggaaaagaatttagcaatatcttccctacttgcacttccgtttataggctctctgcaagaagaaaaatatggctctattctgcccgaccctgcaggcagtcagaccttatggttgtcttcccttgttccctaaaatcgctgttattctgttctttttcaaggtgcactgatttcatattgttcaaacacacgttttaaaatcaatttgtacagttaacgcaatcatcacagtggtcctgaggtgacgtacatcctcagcttacgaagataacaggattaagagattaaaataaagacaggcataagaaattatgaaagttttattagggaagtgataaatgcccatgaaatcttcacaatttatgttcctctgccaccactccagacagtccctctgttggggtccctgacttcctgcaacagtttgttacccatctagaaagagaagggatataaggcacccctcactccctttcctgcttttggtgtgaccaagggtcgagggaaagagaggcatggggtcctccttctcctccttcctccacatcctctaggtctcggctatcgtcatagatgctacccatgaatgcaagcatgaccttcatccacacacccagaggagctagtcagcataactattcatgctcacctgcagaaggccctagctttccaccctgttggtttcctagaccaactcagcccaaaaggctcccaaggtacctcagagtctccataatggagaatgtgtcccaatactgcctctggcttcccttgctatggccccagagaaacatcagaatcccagagaatgggacaggttgacttccaaacataaaatccctttttgtttaaatcccatcccagtgttgttggatgcagaacaggtgcctcaaaataatgtaaggattgaatgctgtccttcctttggggggacaatattgaggctaattctgtcttgccaggatggcttcctcctgggtgctggaagtgtagttttcttgtctacaaatagggcatggggcctgatcactgataatgggacataagagggaaaataattgaggaactgtaagtttcggacaaagagttaacaaggctccccacaaagaaaaatcccattccactacgtggcactgtaggattagaaatgctaggtaaaaactgactccaaattctttccgacaacagttagaaagagaggtttggggtttgcctggctgtccccacagtatgcctcccagcagaagaaaattaacttgttttatagaaaggcagtctagttctcctggacagtgctggcttctcacatgggtgaagaaacaacctaatgaagtgggggatagtttcttggggagaaataacccccatccagtcccactgagtgctatcattgggagataaataggtgttcagatccaggtcttggaatacccctatttcaaggaaaccacagagacaattcattgaattacagtcctaattcctaaggcactgactgactctatccagcaagattgtagtcctaggctgtagaaacacccgcaacattgcatacaaagaagggataggatggctgggcacagtggctcacatctgtaatcctagcactttgggaggctgaggtgggtggatcacctgaagtcaggagttctagaccagcctgaccaacgtggtgaaaccctgtctctactcaaaatacaaaaattgaccgggcatggtggctcatgcctataatcccagcactttgggggactgaggttggctgatcacccgaggttgggagtttgagaccagcctgaccaacttggagaaaccctgtctctactaaaaatacaaaattagccaggcatggtggagcatgcctgaaatcccagctactttggaggctgaggcaggagaatcacctgaatccaggaggtggaggttgtggtgagccgagattacgccattgcactccagcctgggcgacaagagcaaaactctgtgtcaaaagaaaaaaaaattaaccaggcctggtggtgcatacctgtaatcccagctactcaggaggctgaggcaggagaatcgcttgaacccagtaggtggaggttgcagtgagccgtgattgtgccacttcactccagcctgggtgaaagagtgaaactctgtctcaaaacaaaaacaaaaacaaagaagggataggagacatgatagccatgaaaagaaaggaggaaaataatgcaatagaaaaagactggaagaccttgtgctgatgccctgacaggctgtcagggaccagatttaggtcaagggccttcaggtaaaccgagctgtagcctcagccaggaacctttagttgccctaggacctccttccaatcccacatgatggctaggccctctgtgaaaggaaactgaattggaacagagccaaaattcccaacacccaagggcaaatggggattgccaaagtcctctccagcaagcctgtctgctaaatcttaaggctggcaggcatgctaactgttttaaaatggctgacaggaagccagtgttctgtttgcttttgagagacaaaactgaggacaagaagcctcagaaagtaaagagttaaaggtccactcctattcacccttctgattaatccctatcttcccagccaatgcaccagaatatgttgtagtctcgccagtgcaccaagatgtagcagtctctcgttgtctgagataatacttggagttattcatctcatgttcaagaacataaaggagcatggtaacacgggtgaggttggagcaaaagtttaataagttgaagaagaaagctctctgcagtggagaggggggctcgaatgtgttgcccactatgaggctggtgtctggggtttttatggactacgaaggggaaataatgtgcttagtctgttggctgtcttagagaaagcatgatttagcttagcccaggaccagtcaggagctgaagtgaagatttataggagctactcagcttggcccaggacctttcaggagctgaagtgaaagcttggcccgggaccttggcctgggaccaatcaggacctgaagagatgattcatagacgtcaggcttacagtccaaaattgaaaggaaagtgcccatcagaacccatcaaagcccactgtgttcgtgcccacaaaaggagaaacattttcctgggagcccactgattatacaaaggaaagtcatttctatgtctggccttgttcgcttatctgagtgagcgagaggttagtgcaagtttttgtaggtgggctggagtttctcctgtctgtgcagttgcgggcatgtctccagatacaaccccctgtgctagttcccttattagtgcctgcagtttgatttttttttcccagactgctttttatgttatgtgaagatgaggcacttaacctatgggttggaggctctcaggggacccttcccttgctgtttacctgaggcaagctagccaactcctctcagtggtgggtactaacaataaacatacttatgattgaactctaattctcctgtggttctctcacagagatcttttgccagaaaaattaaagcagaggcgtacaaaggctgtttgtgtagcctgaaaaacagactttattttttaaaacatgtcccttgaaggagaagcagccacattcatagaaactggcagtaacaggaagcaacatttgcctatcctggtcagataaacttgggcaaaagccaagtccttctgctccctgagggggtcttgctcaagaatgtcctcatcatacagcaacagcagcttggaggtgtccttgctggccagaccccaacttccccacttgttgcaagctctatgattgtttcggccttttccagcagctttgatgctctctccttgtagcacacatgaaaaggattgtttctctgtccctgcaacccgtgctcttcccattccaccacatgcaccaccccagccaaatcctattcaatattatggagcaattcaaggaaaaagttattgggaaaatggtatgaaaactaagtccgtcaagtcagctctacgcagagtctgcagtgtaactgccttaattgggatgacaacaagataatcagctacttcatattgagaaaggaagtctaaagagcaagtgtggcttctgtagcacttttgagatactatgtcttgatgaggaacaagcagtgttttctgaaataaacataggtcttagccccacacatgacaggtgagctaagaaccagtacaagaaagtgaatgaggctgggtgcagtggctcatgcctgtaatcccagcactttgggaggccgagggggacagattatctgaggtcagtagtttgagaccagcctggccaacaaggtgaaaccccgtctctactaaagaaatacaaaaattagccgggcgtggtagctctcacctgtaatcccagctactcaggaggctgaggcaggagaatctattgaagctgggaggtggaggttgcagagagccaagattgtgccactgcactccagcctgggcaacgagagtgaaactccgtctcaaaacaaaacaaaacaaaaattaactgagcgtggtggcgggctcctgtaatcccagctactcgggaggctgaggcaggagaattgcttaagtccgggagatggaggttgcagtgagccgagatcgtgccattgcactccagcctgggtgacagagcaagactctgtctcaaaaaataaataaattaaataaataaataaataaataaaagtgaacgaagctaatacaaatctagcaatggatgagaatcaatttaaaaattttttgagtaggccagcagctgtggttcacacctgtaatcccagcactttgggaggccgagatggttggatcacctgacgtcaggagttcgagaccagcctagccaacatgatgaaacctcgtctctactaaaaatacaaaaaaaaatttagccgggcgtggtggcgtgtgcctgtaatcccagcttctcaggaggctgacgcaggagaattgcttgaaccctggaggtggaggttgcattgaggtgagattgcgatgacactgcacactagtctgggcaacaagagcaaaaactctggccaggcgcggtggctcacgcttgtaatcccagcactttgggaggccgaggcgggcggatcatgaggtcaggagattgagaccacggtgaaaccccgtctttactaaaaatacaaaaaaattagctgggcgtggtggcgggcgcctgtagtcccagctactcggagaggctgaggcaggagaatgacgtgaacccaggaggcggagcttgcagtgagccgagatcgcaccactgcactccagcctgggcgacagagcgagactccatctcaaaaaaaaaaaaaaaaaaaaaagagcaaaaactccatttcaaaatatctgcgtatctgttctccacaaagataccacattaaatgtgttttgggggagtggggttgcagaagaaatccagaagttttcctctggaaatcctccacctggtttataagctacccaccctgcacactgttctctagacaatgaggttaagtgagaatggtccttcagtataggtttgcctagctcacctggtggagttctgctggtctccacttctggagcagtctcaggtgaggcaaaagtagaaggaggcttctcagcagagtctccaactgcttcatccgtcatttcatcctctttctccaggctttccattccttctgcttcttcttcttcctcttcttccggctcagagttctcctcctgagaattctcttcttcagactcaccctcctgactcatgcgccttttcagatgccagccaagtcagtttctccattgtttcctgtaaaaccctccaaagagtacttacggctcctagtggctcatgaattgcagaacagcacagagctgtatcaggataatctgaagttaaacaatggggaacccactacagctgtcagagcggaattccctgagttatgaaatcccagtgatagctgacattgggcctgacagcaggaaagtggaaaagatgccttttgaaaacttcttctttaccctgaaattagttttcctttgccttagcccatatttatgtgcctcttcctttttttttttttttttttttttttttttgtcttgcaacagcgtctcactccatcacccaagctggagtgcagcggcacaatcttggctcactgcaaactccacctcctgggttcgagggattttcatgcctcagccccctgaatggctgaaattataggagcatgctaccacgccgggctaatttttgtatttttagtagagtcagggtttcaccatgttggccaggctggtctcaaactcctgacctcgttttgtgatccgcccacctcggccttctaaagtgctggaactacaggtgtgagcgaccaagcctggactatttactattttttttttttttttgagatggagttttgctcttgttgcccaggctggagtgcaatggcgtgatcttggctcactgcaacctccacctcccaggttcaagcaattctcctgcctcagcctcccgagtagctgggattacaggcatgcaccactatgctcggctaattttgtatttttggtagagacaggatttctccttgttggtcaggctggtctcgaactcccaacctcaggtgatctgcctgcctcggcctcccatgcctgagattacaggcatgagccaccgcacctggccctatatactattttttaaggcatttaaagtatggtcaggtgattcaatttaatgtgtaaacgagtttaatataataagtaaaatttcatcctttccatctcatttcacctcaactccacaatcatgtcccataatgcattcacaaatcaaatacaaatgattttaggactatccatagtgcagcaagcaagcaggtggcatatcaataagttaaacatattactgagtccacaaaatacttgagagtattctctagctctcacctggagttctgggacagaaagcacagattcctcagaagctgatgacatttcatcttcctcattttgggtgaggtcatcaaagtcatcttcttcctctttttctggcctatctttctctcctccagtttctggtccaactggggtccccactgactgaccatcaacactggatgagtctttgggcttccctgggggctactaagcctcacttcaggattcatggaggatgaagcattatttggtgatcctttgccctcatctccccccaagtttccttcattgggggttcttgagaagatgaaggggttttagttggctgaatcctctcttcttccttctgtaagattgtctgtttctttacctctctagcactgctcaactcctcacttggggagccagtgtctaattccacagtgtgttcttccttgatgtcatcacaaataccgtgctcagggtgttaccagtggacggtcttgactacaagttgtccaggttcttggcgtattgaacagagaatggaacaaaatgcacaagcaaagcaacaaatgaatgaagcaacgaaagcacagatttattgaagtgaaagtacattccacagagcagaagcaggcttgggcaagaggctcaagcaccccagttgcaaaatcttcttgggtttgagtaccctttagaggtttcctattggttacaccctttgtaaatgaagacgtagcccatgaccaattggaggctgaagtgaaattacaccctatgcaaatgaagatttcgcctgcgaccaatcagaggctaaagtgaaggctccctgtctccagatcctattctcctgcctcattcccccttgagagacttaatatcaaatatttacaggaggtagagggactgacagtctttcttctgtaactgcttcatgctgtttggggcactgtccctatctacttggggaccatggaactctcaccctgctctgtctagtggagacaggatgacttcttgttggccggggctggcatcattccctggatagaagccctgctgcatgatcatttgaagcttaatggcctctaggtgagaaaaaatacatttggttaaaagatttaacaaacatggtccaacatggtcaatgcgagcataattgttaataatgtgccagctaagggaagtagacatgaagcccaacttagtgcccttgaccagaagccccatgactcggacagctgttgttatattttagaggccccatcagctaattttcaggcggcatctcttgctaatcctgattggttgacataaaaacagcattcttcggtggggcgcggtggctcacgcctgtaatcccagcactttgggaggctgaggcgggcggatcaagaggtcaggagctggagaccatcctggctaacacggtgaaaccctgtctctactgaaaaaaaaaaaaaaaaaaaaaaaattagccgggcgtggtgccaggcgtctgtagtcccagctacttgggaggctgaggcgggagaatggcataaatccgggaggaggagcttgcagtgagccgagatcgcgccactgcactccagcctggatgacagagtgagactccatctcaaaacaaaacaaaacaacaacaacaaaaaaccccagcattcttcttttaggaaaagacatatgccacctttttcagcagctaggaaatccagtctcctattattttgtaaaacgaccgttgccaaggagtctatctgattttgtaaggtgacaatactttgggcaatgtcttccaagctctctgaaagatccttggacaaacgttggtaataggataggaatgttgcaagcctgctaactcctgttcctacttctgcggttattcctagtcctaccaaaaggagtatgagtttgatggttcatttgtgcctggcgggtgcagttaaaggtatgagagactggttattgagagctatacagatttcaggggctaaataaagaagtgtagaggtttcagtccatttgattggtaaacataactaggaactagttccacacaggaaaaagactccgtgtttttcaagataaaaatcattctctatggtgaacatatgggttagctttttgtttttctttccccagtggttaaggtccctgctaaggtggctccagttaaaggctggaaaggaccttgggaagtatcctcagttgtcctagcagttaagttttcctggtgaaggtagttatgcttagtgtccaccagcaaccacccagaggtattttcatactggagaaccaaaaggcaactagctgtcttaggattactacagtcttcccaagtgaaaatgtgaacacagctagtggtcctaccttgacagtacttagactgtgtgtcctttaaagtgcccttaattaggaatagtttcatgcaaaccatacaggttttctaaatgatgcagcctaggtaactgcatagcttacatatcatgtgagaggttaatccctagggtgtagttactctgatgactcaaggttcccagggtttgactagaattttttaatacaaagtggcacctgggattttagttctttgtgcgttcttgggccccaaataggtttttgaggagatgcaaccccagaaatgttactttggtaggactggagaaggtttactgctcatcctgacattgtaacttttgttgtttatgtaattttgaagtcatagaagtcatgcagatccattaatttgaagggagtccctcccttgtagttgaggtggtaggacattttttcaagggcccaagataagcctgggttgcgatggcagtgtgttttggtgatgttggagatgaacaaagccaacagtcctttgccagagctggactggtggtatttaacagtctttgggttaaattttaaagtcttaataaatacccagaatccattaattgccagagaagtaaaataaaaccctgctgtaaaattaagctgattcccagtatgcctggtcccagtatacacaggccagggctaaccattatgggactaaaaatacttatctgttattttgttcttttgaatgggaacttcagggggtgtatacctatcctctcaggaataatgttacaaaaatgaagtaaaacattttgcttaattattacaaaggaaatgattccatccatttggaagaaggcaataaattataaaaatataaaaactgctactattatcaaacctacagtaactatgcagcatagacaccaaggagagttggtaggcattcacttatcttttgactgtctttaaaacaggtacttcaggtcttccacaggttcacaggtatagtggctgacggaagcttcaagttacaggtctggggcttcaggtattgcaggcttgaccctagaaagacgtatccaacttctaatcctggtactttgactacagaaggcgtggccaacaccactgaaaaagtcccttccatttgggttggagttgttgagcaggtgacccctctttctgtgttttaacaaatacttttctctcctggcctgatcttgggttgctggttagttcccaatgcagagaacctttgagttccaaacttttgaaatgcctgctgaaattgtctccggttaattacgtattttactaaactggctatttctggatcagtaattagatcatccattaaaaatggccttcccagccaggtgcagtggctcattcttataatcccagcactttgggaggccaaggtgggtggatcacttgaggtcatgagttcaagaccagcctggccaacatagtgaaaccccatctatactaaaaatacaaaaattagcggggtgtggtggctcacacctgtaatgccagctacttgggaggctgaggcaggagaattacttgaacctgggaggtggaggttgcagtaagccaagactgtgccactgcactccagtctggacaacagagtgagactctgtctcaaaaaaaaaaaaaaagacttctgtataacattttaaatgggctcatattaatttttgctctaggggaattatggatccttaaaaggactatgggcagcaagctgacccaagtttctgaagtttcctgacatagcttagctaatgccgattttagaggttgattagccctttctactttcccagaggattgaggtctccatgctgaatgtaaatagtattagattctgagagccttagcaacccttttagttatttgggagacgaaagacatactgctctcaccttggaggctttggggtaacccaaactggggattatttatcttaggagaacttttataacttcattagccttctttgttctgctagggtaagccagtaaatgtgtctattagtactagcaaaaacttgtatcccctacaagctggcatatgggtaaaatccaattgccagtcttcccctggggaagtgccccttctccggactggttctattagaggaggcattttgttcctggggttgttgaatgctcacagtgaacaggtttgacagacctgcttaaccacggaagttaagtcaggcccaatgaagagcctgtttatcatggcaagagtggcatctcctcacatatggaaagagtcatgcaggatttttataattctccattgggctgtttgagggagatacacttttgatactatataccaccaggatccttgtttgtgtccatcttcctcctttacttcgaatatccctgaatacatcacagggatattcaggttctattggggaatcatagaaaggaagcagtgctagaatttgtcgggattacaccctgagcagtgcggctttggcttatcagcctttctgtgcccttgtgttacaggggttaggttcttttgatgccccctacaatgaattatggctatgcttttggcaagtgtattgcttccaacagttgaagaatttcagacccatgctttatggtggaagatttactagttagtagtcctctttctctttcttttcaaattgcagcatgagcatgaaacacgagaaatgcatgtttggaatctgtatagatgttaagctttttcccttttcctaatgtcagaactcgagtaagagcaatgatctcagctttttgtgctgacatacctgggggcaggggttggacctcaataattgtattgtaatttactgttgtatatctggcccagtgttcccgtttgatataaagctgctgaggtctgtgaaccagtcatcctctgaatctgggagaggtcaaccttttaaatcaggctggctaacatatgtatgtgcaataacttgctcgcaggaatgattaattattgggcctgtgggcagcaatcaagctggattcacagtgttacaggttttaagggtcacatctagattttccaggagcatagcctggtatttggttaacctttcccccatcatacagttgtgtccttttatttctaggattgacttgatgtggggttaatacttccagtggctgacccagggtgattttagcggcttcttccactaaaatagcagtgtctgccatcgacggcaagcagcttggccaccgtgtccaatttctttgagaagtaggcagttggcactcccatggctatgcctttcccttctgctacatacaagggcttagtgaggtctaggatgctaagagcgggaggctggctgagagcctgttttaacttgataaagccttctctcatttccaaagtccattcaattggctcattttctggctcccttgttgctttcataaaggggttttgctatgagcccaaaatttggtacccatcttctgcaaaacccagccatccccagaaaacgacgaagctgttgcttggtgtgggaggagctccaaaccacatacggcttgcactcattctggggatatttgctgggctctgggtgttaagatacaccttaaatattgaacccgttggtgggcaatctgagccttccttttggacactttatatcccatctgcagagaaatttaaggttcttatagtattttagtcaccccctgggttgggctacacacaagaaggtcatgtacatactagagtacactccattttccaattttagatcccttagatccccaaggcttgtgcaaaaaacaaacaaacatggttatcctgaaagccctgagggaggggcactgtccaagtgtatttctgttttagccctacccagtttcccagtataccatgctagtgcgttgacctatttattaatgtggtctgggacattgtctgcattactattagcaattttgctgggtggtgcctaaatcgtagcagtgtccctattttaactataatatcccctcccaacaaggggactgggcagcttgttactactagaaattcttgttggaagatttgtttctcaaattggcaagtcaaaagaggaataaagaatcttttttgtggctctccttccattcccataacgcttgtggatggggaggaagcttttcctacgtaagtagtaagggcaaagtaatttgtccctgtatcaaaaagaaaccaaatttgggtgcccaacatgtccagagttacccagggctcctcaatagtaatgaatgatgttcctgggcaggggtggtgaggaaggccctgggccccatcagttttcatcaatttctccttttgcactgttaagagttttgactgacctcctctgtgtaacagggggcagttaattctccagcaccaggggttgtgactggtgcctttgtactgccaacagggtcccagtgggggcttactacagtcctttgcccaattcccatttttcttgcatttgaagcaagagcctttgctggcattatccttatggcccattgggattcccttgggcactctttgggcattcagggcatctccaatgatggctatcgtaattttggcttgcttcttctttattccttttccttcctccaggtcatgattgttatacaccataaggcagtatcaagaagttgattttgattagtctgtggcatcatctatagcttttggagcctaatggctggagcggattggctaatgaaatgctgtgccattaatattttgcctctggagaggaagcgtccagattggtatatttcctttccccagcctaccataaaagatggctggattttcctccttgcattaatattttgccttctggagaggaagtgtccagattggcatatttcctttccccagcctaccataaaacatggctggattttcctccttgccttgtataacctccctgatcataatttgctaccttaagatattgtctttttcattcctccaaggagagcctcaagaaatttggcccagttgttcattcccgcaggggtgtcaattaggatcagtagtaggggctggggctgggccctggtgattgccctaaaggcttcaggcaaataaatcgtggacttcctggcaggcggcctcaaagattcgttcccagggggtacaacacgttgctagaattaattgaacatccctccatgagaaaccaaaggctaaagtcaaagtttggaacccatctgcaaatttcctggggttctcagaatagcttccaagcttttctttacattgtgttatggagaagcaggcctgcactctaactggccccttggctcctgctacttccctcaggagtggtagggctgaaagggagttgaataaggtgttccactgtgaggggaacttggcagggttcctggtttttgctcttgggtttgagcctcaggaacacttggcaacaggctatacgggagaggttgccatttcccgagacaggtgacccttgtcaaaataggatcatctacaatatctggttctgccttaggacctttgattatgggacaggtcctggagttttgcacatggttgggttttgatatacacccatgaagacctgcacatatgggatttctggcaatttaccctgcattttgcaaaataggtctaattgcagatggtgttaataattaagaattccattgactgcccattgttcctggctgcttgtttggggtccctaagggtgtccccctttagggtcccatcttagtgtgacatgtgacctttgatgggtgccagcactactttggcaaggttctctccaccactggtgacccactattaactccttttattcctagatgaaggccttgacttctagcatcttttttttttttttttttttttggagatggagtttcactcttgttgcccaggctggagagcaatggacatgatcttggctcactgaaacctccacctcctgggttcaagtaattctcctatttcagcctcccaaatagctagggttgcaggtgtgcatcaccatgccaggctcattttgtatttttagtagagacggggtttcaccatgttggccaggcaggtctcgaactcctgacctcaggtgatctatctgcctcagcctcccaaagtgctgggattacaggtgtgggccacagcacctggcctctagcatccttataatttggtaaggccatggtttcccacacttcctgttccactagagtgatagctgtgaaccctaataagaggaacaggaggctggtaggtttcttttgtcatgtggattatgggtaatttcagggaaaaaggttgattttaggcatgaaagataaaatagggctggctattccattctggccctgggcaagagagggaatgtttaaaaatccaccaccatggcaatgggtcctgtgtaagggcaggccattctattgaaataatatggtgaagacaaaggaaacaaggtcccctcagtggaggtccaagatgtagaatgtattctaaagcttgtgggtcccaaaggtcatcagccagccaaatggatccagtagaagggtcaaaatatctaggagatactatcttttgccctcactggctaactctgtaagagaatttggcctaagaaaggagggtttaagaggcctgagtgtgaattcgccctgaatgagctaccactgccaatggtgtcacgtgtagaactcagagactataaccaggaaagataaaagagtctttctcccttccgggcagggaagctatcccgattcattccttggccttcaggtaacactggagagtggccctgtccagttgccctcaattaccaaagagctgttagaaaacagcagctgaaagactcaaaaaaagagaactcaggtctgtcacccaaactgggtgatggtgatcaggtgcttccacgtggatacccttcagtctcactggagagtggccctggccagagacctgcagttgcctccatgttcacatgctatctgctgagtctcaagttggaaaagggaaagagagagaggaaaaggttcccctgtatggagtggagccctgcacagagatatagctccagcccatgccgaaaaatgaaggcttgacagggaaagaaaaaggaaagaagaaaagaaaaataaccgcccccttcccctgcaccgcaatttggacttacctccaggctggcttgccaaaatatgttactgtcggagggtcttgactacaatttgtccaggttcttggaatgttgaatgaagaactgaacaaattgcacaaatcaatgaaacaatgaagcaataaaagcacagatttattgaagcaaaagtatattccacagagtgggagcaggctaaagcaagctgctcaagagccccagttgcaaaatctggggtttaagtaccctttaggggtttcctattggttacaccctatgcgccaccaatcggaggccgaagtgaaggctcccagtctccagactcttattctcctagctcaaagaaatccactgatttcctctgtagcatcttcaggttccatcttgacaacttcctctaaatccccaggggaagagttgtttagagactcctggatgccctgagggagcggctccagagcttgccttccctcctctgttttcacaacggtccagcgataggcactgttctctgacaatccttcttggcactgtttatcgactggtggaggccctgggctatgttccactttggggaaaacagtagcagagagaggagatagttcctggggctctaatttgggttctaggccctgaaaggcattttccccatcagccacagcacaagcaatgtccacattcatgtgggccttatcttcaggggtggatggtataggaagattcacagaattgccagaaacaattaagggtgagacagaggaggccacaaggggctggttcaatggacaggggaaggaagtagggttaaccaagagggtggcgatgggaatagtctggggactctgggccacagccgcattgacaggctggatcatgttacagccaccgccaaggctcacaatcttcacagtggtagcaggaacagtgaagataacagatgcagggtggataacaggggcaggtttgatacagcgaaaggccctggctccccttctttttgagggtctccgtctcacatatggctttcgaaacatggaagaggcaggggagggcatcattaccttgggcacaggggcagaagagagcaaagtctgggactcagacagagggaagcttgtcctggcctcagggggcatagcaggcagtgctgcaggagactcaaaactctcacctccactgacccccagtggagggacacctggaactgtctgtaaaacagtggctggctgtattgggtgaggaatccggagcaccattttgctcggaggggcttctgaatgagttgattgggctggtgttttcccagggttgaagctgggctggagagaggggctgggttggataaggaggggtttcaggactgatgaacgcttctgtctccaagccttcttggggaaacggtcggcaactggcttcagtttcaggactacacccttaggcaatagcagtgggtaccgagtttcactccccaactctgagttgtctttttctaggccttgatctgagttgatctcagtggttccagtcatatttcctacctctctagcaccatcagccatgtgccgcagttcttcctggatggatggcagactggcctattggaaatgagaacactctgatccagcacatgtcagaatttgggaaaaagaataggactttctaagtttagggacctgagacaagctcaaggcatctttccaagggactctgcatatgaaatttctacaaagaccacagtccaattatacactttagaaactcttctctgaatttcctttagcaaattaccattttacccattattttgaaaatgttgtagaatcacccggagaagggcagaaaagtaagggaagaaaggtgaatcaggaagattcctgaagtcctagttctacaactaaagcattagacgattaaggaagtccttgatattctctcagaactttcagtgaccttctgcctcctacagacttcgaggaagagggctgtacctttaaccagaatgggagccggtgttcttctctctctataggtggcttccactgatgtggctggatctcttcacagcattttcctaggactggcagctgtttggtcttcttataaaacttaacatgaaaaaaatgcgcatgaattacattccttctggaaacactgtcttctgtcaggctggtgaatggggtggtggtggatcaagagaaacacacacacacacacacacacacacacacacacaagaccacatacacaaacatccatgaacacacatatacgaatagcatatgctgaatacttgtacatttcaaattaaactaatctctatttaaagattttatagttattcagtattttctttttgagacggagtcttgctctgtcgcccaggatggagtgcaatggcgcgatctccgctcactgcaagctccacctcccaggttcacgccattctcctgcctcagcctccggagtagctgggactacaggtgcccgccaccacacccggctgatttttttgtatttttagtagagacagggtttcactgtgttagccaggatggtctcgatctcctgacctcgtgatccacccgcctcggcctcccaaagtgctaggattacaggcgtcagccaccgcgcccagccctattcaatattttctaactgatgatctccattctggttgccaggaaggggagagtttaggtcacagagagaaaaggaagcagatgctaagagcaatcttatgtaagatttgttcctgctcaacagctgcaaagacagcatcgtaatctataaaatggacacatcaaagactttaagcaaatgatggtgtgaagggcatcagaagggaaggaaaaaaaaaaagaccgaggcagttcagttttaagagtaaataggctggccttggtggctcacatctgtaaacccagcactttgtgaggctgaggcgggcagatcacttgagattgagagtttgagaccagcctggccaacatggtgaaactccatctctactaaaaatacaaaaattagctgggtgtggtggtgggtgcctgtaatcccagttacttgggaggctggggcaaaagaatcgcttgaacctggcagtgggggtggtagggtggagattgcagtgagccaagatcatgccactgcactccagcgttggtaacagggtgagactccatctcaaaaaaaaaaaaagaagataagaactgaacttaaaccatgacaataagcatctgttcatccaacatgatgaacataagatgttttctatatcctaggcactgtgctaaaagctaagcacacacataagggaagcaattcctgctctcatggagcttacagactagtgggagagtcaagtggacaaatggcatcctacattaaaaaatgtacaaagggctgggcatggtggctcatgcctgtaatgccagcactttgggagaacgaggaggatggatcactggaggtcaggagttcatgaccagcctggccaacatggcgaaaccctgtctctaataaagtacaaaaaaaaattagctgggtgtggtggtgcacgcctgtgatcctagctacttggcaggctgaggcaggagaatcacttgaactgaggaattaagaggttgcagtgagccaagactgcaccactgcactccagcctgggcaacagagcaagactccaaccccgacaccccgccccatcccccaacaaaagtacaaaggtgtgcacgaaaaatgacacaaaactaaaacttaaacacaaattacttctggccaggcgtggtggcttatgcctgtaatcccagcactttgggaggccgaggcaggcagatcacaaggtcaggagatcaagaccatcctggccaacatggtgaaaccccatctctactaaaaatacaaaaattagctaagtgtggtggcgcgtgcctgtaatctcagctactcgggaggctgaggcacgagaatcacttgaacccaggaggtggagagtgcagtgggccgacatcacgccactgcactccagcctggcaacagagtgagactccatctcaaaaaaaaaaaaaaaaattatttctgcagaagaataaggtttatcacgtgtgccttaaaaccatggatacgccaggcatggtggcccacacctgtaatcccagcactctgggaggctgaggtgggtgggtcacgaggtcaggagtttgagaccagcctgaccaacaaggtgaaaccccgtctctactaaaaatacaaaaattagcagggtgtggtggtgagcgcctgtagtcccagctcctcgggacgctgaaacaggacaattgcttgaacctgggaggcagaggttccagtgagccaagatcacgccattgcactccagcctgggcaatggagcgagactctgtctcaaaacaaacaaacaaacaaaaacaaaaagaaagtactttttaaaaaaccatggataaaaatagacaaatactaaggcatattatcatgcattttcaaaatattgaagccaaaggaaaaatcctgcatgctgtcagaggttgagaaaaacaggtgttacacaaagactcaagagttaaatggggccatggctcatgcctataatcccattactttgggaggccaagacaggacgagcacttgaggccaggagtttgagaccagcctggccaacataacgagaccatgtcttaaaaaaaaaaaaaaaaaaaattagctgggcatagtggtgcacaccgggttggagacaccagtgagccatgatttagccacgctccaaactgggcaacagggtgggaccctgtctcggaaaaaaaaaaaaaaagttaaatggcatgaaatttcttaacaccacactaggagttagaagaaaatgaagtgaggcccttaaaagcttcttaaaaaaattatttcctatctagaattctagatacagtgacagaggagagtattattttttccttttattttgaaataattatattcataggaaattgcaaaaaatagtaccaagaggtcccatgtacccttcaaccagtttctcccaatataatgtttttatgttacatagaaacaagagctatacatataaacaaggtacacagtacaatattactaccaggaaactggccagacatggaggatgtggtggctcatgcctgtaatcccagcactatgggaggccaaggtgggcagatcacttgaggtcaggggttcgagatcacctggccaacatggcaaaaccccatctctactaaaaatacaaaaattagctgggtgtggtggctaatcccagctactcaggaggctgaggcaggagaatcgcttgaacccaggaggcagaggctgcagtgagcaacagtgagactctgtctcaaaaaaagaaaaaaaataaaacaaaaacaaaaacgaggaaactgacatcgatacaatcaaaagaccatgaatggagatttttttttttttttttttaatacggagtctcgctctgtcacccaggctggagtgtagtggcgagatctcggctcactgcaagctccacctcccaggttcacgccattctcctgcctcagcctccagagtacctgggactacagacgcccgccaccacacccggctaatttttttgtacttttagtagagacggggtttcaccacattagccaggatggtctcgatttcccgacctcgtgatccacccgcctcagcctcccaaagtgctgggattacaggcgtgagccactgcgcccggccccggagatggtttaaatgtgaaaattcccttcccaagcactctccctcaggatgctactggaatggggccatgcagggtggctcatgcctataatctcagcactttgggatgctgaagcaggaggatcacttgaacccaggagtctgagaccagcctgggcaaaaaactgagacccccccacctcaattttttaaaattcagaaaaaaattttttttaaaaaaaagctactagaatgtgttccactaaagtaaagaagtaatactcacgcctgtaatcccagcactttgggagaccgaaacgggtggatcaagaggtcaggagatcaaaaccatcctggctaacatggtgaaaccctgtctctactaaaaatacaaaaaattagccaggcgtagtggcatgtgcctataatcccagctactcgggaggctgaggcaggagaattgcttgaacccgggaggcggacgttgcagtgagccaagatcatcgcgcctttggactccagcctgggcaacaaagcgagactcggtctcaaaaaaaagcaaaacaaaacaaaaaacaaggccaggcgtggtgtctcacgcctgtaatccccgcactctgggaggctgaggtgggtggatcccctgaggtcaggagttcaagaccaagaccaaggttgcaggttgcagtgagccgagatccagcctgggggacagagcaagactctgtgtctcaaaaaaaaaaaaaaaaaaaaaaaaagtaatgcaaaagcaaagatgtggaattcaggaaataagaggatctaacacagtatgaggcaaaaggaattcctgggatgatggtgaagaaaaagcccaagaagacatcagtgcagcaacatggagagcaacacgcttaaagtggaataatgtcagagggctcagggagcaatttcttcaagatgaaagtgacagaatatctagaatacctgaacacactgaaagaagatgatctgggaaacaaaatgttcagcaggaaaggcaaggtaacacagtaacatagctgagctgtgaagagcatttatacagtccttaaaatctattttttttttttgagacggagtcttgctctggcaagactggagtgcagtggcgcgatctcggctcactgcaagctccacctcccgggttcacaccattctcctgcctcagcctcccgagtagctgggactacaggcgcccgccaccacgcccagccagttttttgtatttttagtagagctggggtttcaccatgttagccaggatggtctcgatttcctgacctcgttatccacctgccttggcctcccaaagtgctgggattacaggcgtgagccaccgcgcccagccaacagtccttaaaatcttacaatgtaaaccctgaatacaatctaaccaaaattctaccataactactagtgaggagtttggagagcagaaaatgtgcatgtttgtggtgggagtaagggagtgaggagagaggtaaatcttcggcttccgtggtttatggttaataagtaaggcctaaatccaatacaccaggcagtaccaattagaggctgagacaggagaattgcctaaggccaaaaattgaagaccagcctgggcaatatagggacaccccatccctaaaaaaaaaaagttttttgccaggcacagaggctcacgcctataattccagcactttgggaggccgaggtgggcagatcacctgagatcaggagttcaagatcagactgaccaacatggtgaaattatgtttctactaaaaatataaaaattagccaggtgtggtggcgcatgcctgtagtcccagctacttaggaggctaaggcatgaaaattgcttgaacccggtaggtggaggttgcagtgagctaaaattgtgccactgcactccagcctgggtgacagagacagattctgtctcaaaaaaataaaataaaataaataaataaataaatttaatggccaagcacagtggctaatgcatataatcccagctccttgggaggctgacgttggaagaatgcttgagcctaggagttcaaggctgcagtgagctatgactataccactgtactccagcctaggcaggagagtaagaccttgtctcaagaaaaatacaaaaacacaatgaaaccaaaggctgggcatcatggctcacgcctgtaatcccaacactctgggaggccgagctgaggcaagaggactgcttgaggtcaggacttcaagaccagcctgggaaacaaaatgacaccctgtcttcacacaaaataaaataatcggctagccttggtggcatgcacctgtagtccaagctacttggaaggctgaagtggaaggatcacccaggaatttgaggttgcagtgacctatgattgtgcccatgcactccagccaggatgacagagtgagaacctgtctctaaaaaaaaaaaaaaacataaataaatatctaaataaaaaagaaggctgggggcaatggctcacatttgtaatcccagcacttagggaggccgaggcagatggatcacctgaggtcaggagttcgagaccagcctggccaacatggtgaaaccccgactctactaaatacaaaaatcagctgggcatggtggcaggggcctgtaatcccagctacaagggaggctgaggcaggagaatcacttgaacccaggaggcagaggttgcagtcagccaagatcgcaccattgcactccagcctgggggtcaagagcgagactccatctcaatcaatcaatcaataagtaaaaagagttgagaaaaagtatataggctgggcctgggcgacaagagcgaaactccatctcaatacatacatacatacatacatacatacatacagacacagacacacacaaacacacacacacacacacacacacatacatgcatacatacaaacacaaaattgagaaaaagtatataggctgggcacggtggcttatgcctgcaatcctagcctctgggaagccaaaactggtggatcacttgaggtcagaagttcaagaccagcctggccaacatggtgaaacccgtatctactaaaaatacaaaaaattagctgagcgtggtgggcacgcctgtaatctcagctatttgggaggctgaggcaggagaatcacttgaacccgggaggcggaagctgcagtgagccaagatcatgccactatactcctgcactccagcctgggtgacagtgcaagattatgtctgaccaaaaaaacaaaacaaaacaaaaacccaaagcatgtaagtggaatactgcatatcatttctagaaagttcaagaaagagaattattacagggaaacatggatttgtggaatcttttaagaggatgaagatactccagaggaacgtaatgaatgaatcaatgtccctgaaaaggcaacaggggaattaatctagtatataagtaggagaaattagctttagataaaagaaggttcttcttttctttgagaataacaagagaaaagaacagatatgtgttggtgaggtgcctggatagtgcatgcaggaaacactcactttaatgatgttgtcaggagctctgttcatgttgaggttcttgattctcactgtcagttggcgggcagtcttgcaggttagaaggtacttgctgattagagggttaagaaactcagtcccttcaaaatgcttcagtcctaaagctaacaaactgagaaaggagcaataacactaaatctcacttcacagtccttccttctaaagggcctccccagactaacacattttacaatctactttttcttacttgttcttaaaacaaggtctcactctgtcacctgggctggagtgcagtggcgtgatcgcagcccactgcagctgctacttcctaagctgaagcgattctccagtctcagcctcccaaagtgctgagattacaggcatgagcccatggcgtgtggcccaatctactttttcatttttttcagacagggttttgctctgttgtccaggctggagagcagtggcatgattacagtgcactgcagtcttgaatgcctgggttcaatcgattcccgcacttcagcctcctgagtatctgtggctataaacgtttgctaccatgcctaactaatgttttatttcattatttgtagagaccagttctcactttgttgcctaggctgatcttgaacttctggcctcaagtgatcctcctgcctcggcctcccaaagtgtcgtcattacaggtgtgagccaccatggctggccaatctactttttctacaactaattcttgtagtgactactacaagttggtgactactcagtagaaaatttcaggtatttagtgagtagtgattaagtactatgaataagaatcaaatagttcacaattaagtaggagcaagagaaactagtcataaatcatcaataaatgtcagatcatgatgagctgtatattaacaacacaaaggaagttcaaagagaatacatgggaaggagaatgattctaataaaacaaatataaaatgaataataggtaccccgtcagacaaattaaactggcaccaatactaccctctaacataacatatataatcatggttacatatatacatatttgctgttaacagtgtggcaatacacacaaagggccataaaaatgttcataatctagctgggtgtggtggcttatgcctatagtcccagcactttgggaggccaggagtgggaggatcatttgaggtcaggaattcaagagcagcctgggcaacacagagataccctcacctgtacaaaaaaaatcagccatgtatggtggcacacgcttgtggtcccagctactccatggaggctgaggcaggaggatcacttgatcccaggagttcaaggctgcagtgagctgtgattgcaacactgtactccagcctgggtgacagagtaagatcctgtctctaaataaataataacattagaaaagccaacctcctgccttggcctttcaaagtgctgggattacaggtgggagccgccatgtccagtctaaaacattttaaaaatgtgtgtaacatccccccaaaaagcagtatttggcactgctagaacaagcacgttctagaggactctgctcatctatactgcttttccttttgtgtccatgtcttattatacaagtcttacttcccctaaactcctcaaaggaactacatcttctccttgggatatttgatcccccagagtaaacacttacttgtcctcagccttggtgaagaggatcttatcctggggattctttgccttcagggaacacactggaagtaactctggatacatgaaaaccttgcttgtggccaggatccaagccacttgctttggcaaacagggaaattcattggctataagaaaataaatctctgataaatcaacttctaggaaaaaagagggcttcaaaaagcctgtgaatgcatttttgcatttaggtagagctgtccttatctaacttgattccctcccatctgcctaccactccccaaagagtttccacagtctttcctcaactaacattaggtctaaagggagtcccattcactggcaataaaagttgactttttttttttttttttttagacggagtctggctctgtcgcccagactggagtgcgtggcgcaatcttggctcactgcaagctccgcctcccgggttcaggccattctcctgcctcagcctcctgagtagctgggactacaggcgcctgccaccacgcctggctgattttttgtatttttagtagagacggggtttcactgtagacaggatggtcttgatctcctgaccttgtcatccgacagcctcggcctcctaaagtgttggattacaggcgtaagccacggcgcccggcctctcttactctttcttacgtgtaacactttattcacaaagtaaaacaaacacttaaaaagtacctagtaatacctgtcacatagtgtatgctcaaaaatgttttacctcctttcccctttaaatctctgaaggataacagaccttcaacaatgcttttttcttccaggataagattccaggccaggcgtgctggctcacgcctgtaatcccagcactttgggaggccgaggcaggtggatcacctgaggtcaggagttcaagaccagcctggccaacatagtgaaaccccatctctaccaaaaatgtaaaaattagccaggcatggtggcacgcacctgtaattccagctacttgggaggctgaggcaggagaattgtttgaacctgggaggcggaggttgcagtgagccgagatcaccccactgcactccagcctaggtgacagagcgagactccatcttaaaaaaaaaaaaaagaaaaaagattccaacttctttaatctccctcacaaacctggtattccaaattttacttttatttcattctttcttaactttcattaagttctcccagattcctcctgaggttgggaacaaaagaaccataaaaggaatgagacaattcagtctcattcatttctgtctccctctctcagcctctcaattttaggcacctctgcatttctagagacaaaactactatatccatatttctccttccataagtgtcatttttatatctccagaagaaaaacacaggacactagatgtgtaagataatactataatttggtattaaatcacgttttcattaccatttcatataatatagctattaaagtagtttgggatctgtgtctatgatatagtacacttaaattcaactacattcaatgtaatgataagacttagggatttaaaatagaatccaaagacaaacccaaatccagaacaaaccacaactaatttgctaagtcagcaaacaaatcagaagtaaatatttggcttaagtaaatagcaaatattttctcaaaaaatactaaaccaatgcaaggtagaatctaaaccggcaaatttctttaaaatactgaacacggcaaatgtacaatctctaatttacgcctaacttgcaagtcaacatttcattcagaatggagatatcacctatgctacaatcattatggtaaataaagttagttgatcttaatgaagagaataaaaagctaaacatgaccgaactttaccacctgactttcatctttaccaggccccagtttatcttgatctgattcctaatacttacccctcatattgctgtagtccaattcttagcactgagcctcagatctctacctcccatattcctatactgtccactgcctccatgccttacccaggcccggagattatcatgtaattctagaacttggataatgagtacaaagggaggataaaagagagaaggaagaaattacaaatgtcctgtgtcctccattcctaggcaagtatcctaggaagttatctatgggataagattcccaccacctctcaccgcaagtaaaaacttaaagctgacacatctgtctcctaccagtcttcttgacagttttatgagggctgcagtcaatgctgacatgtgtgctgaagtcttcaatcagctgcatagctcccatcaagttacagggttggaacagggtctgaaacttggggttgtactgatggtgaagggcgatggagctttgagcaaaggttcccagctctttctgggaaaacacgacacaaggaagatctaagacaattccagacaattaataccaatagccttcagaatctaaatgagaagctgaccttcctactacaggataaaaacaggtaaaaataatcataaagtctttcacaataaactactgttaagattatgcctgagttctcagatattcagggattatattcttgttttatttttaaactgtttctcactaaggaatacatggtctagctcccgagctagaattaagagtctcaagaatggggactattactttaatttaattaattaatttattttgagacatggtctcactctgccgctcaggctggactgcagtggcatgatctcagctcactgcaaactccccctcccaggctcaagccatcctcccactgcctcctgagaagctgggactataggcatacacctccaaacctagctgatttttgtattttttgcagagacagcgttttcccatcttggccaggctgatctcgaactcctgggctcacaatccgcctgcctcggcctctcatagtgctgggattacagggatgagtcacctcacccgaccaggaccattacttttaaaattgttttgtcttttggtctcagaataatgcctacaaccaagtactcctcatcctcctctgaatacagtaagagatgaagacatcctgttgatcaccaaggaagttttagaatactagcaaatgtactcttcaaaatccaaagaagacttactgaagaagctgagagtattatcattacctgtccaaaagtttgaggcaatttttatgaggtaaagtatggttttgtttttgtgagacaggttctcactctgtcacccaggctggagtgatatataagcacggctccctacagtctcaacgtcccaggctcaagtgatcctcctacctcagtctcccaagttgctgggactacaggcactcggcaccatccccagctaatttttttattttttatttttttggtagggatggggtcttactatgttgcccaggctggtctcaaactcctgggctcaagcaatcctcccaccttgacctaccaaagtgctgggactacaggcatgagccaccatacctggccaaatttcaaatttaaaatctcaaaataggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagccgggcatagtggcgggtgcctgtagtcccagctacttgggaggctgaggcaagagaatggcgtgaacccgggaggcggagcttgcagtgagccgagatcccgccactgcactccagcctgggcgacagagcgagactccgtctcaaaaaaaaaaaaaaaaaaaaaaaaagctcaaaatacctcaaaacgtcatgagcaaaactagctctacacataaaacactaatattgagcttcatgaatggataatgaattcaacatctacatgtatatttacttcattatttaaattaaaacaaaacaaaacaaaaaaaacacagaccgggtcttactatgttgcccaggctgttcttgaccactgggctcaagtgatcctatcacctcagcctcccaaagtgctggaattacaggtgtgagccactatgcccagcctcaacatctatgaaatgaatagcggtaccaaaaacctaagaagtcagggtgaatctaaagatgaggaggaggacccaataaaaatatcagaaggacaggccaggcgcagtggctcatggctgtaatcccagtactttgggaggtagaggtgggcagatcacttgaagtcaggaattcgagaccagcctggccaacatggcaaaaccctgtctctactaaaaatacaaaaaaaattacccgtggtggtgcccgcctgtagtcccagctacttgggaggctgaggcaggagaatcacttgaacccgggaggcaggggttgcagtgaactgaaattgttccaccgcactccatcctgggtgaaagagcaagaccctgtctcaaaaaagaaaagaaaaaattgaatacactctttgtcctttcatgtgaatcagtggcttatgttcactcagcaaacataggaagccacagcaatcaaaaatacctgagagaataactgtgagaaataacctgccaagctaattttatattctagtctatagaattacggcaatttggaaacttacaagacatatcctggtgctactggcctccggattgagattggggttgcaggtggcaagaaggtggatttgtgtcaagagctgaacatgctggggagagaaagaaaataatgcagtgatatgttatgacactgccatttcaggagcccagagatatttttttttccccctggagacagggtcttgctctgtcacacagcttggagtgcagtggtgcaaccatgactcaatgccctctcaaccacctgtgctcaagcaatcttcccacctcagcctcccaagtagctgtgaccacaatgcctggctaatttattttattattattattattattatttttagacagagtctcgcactgacttttgggctggagtgcaatggcgtgatctcggctcactgtaacctctgcctcccaggttcaagtgattctcttgcctcaacctcccgagtagctgggattacaggtgcccgccgccacacccagctaattttttgttttcgtagagacggggtttcaccatgttggccaggcttgcctcaaactcctgacctcatgattcacccgccttggcctcccaaagtgctgggattacaggtgtgagccactgtgcccagccttatttttattttttgtagagacagagtctcactatgttgtccaggctgcttttgaactcccctgctcaagcaatcctcccacctcagcctcccaaagtgctgggattacatgtgtgagccactgcacccagccaccagagagtcattaactaagatgtttgcaactttatgacacaaattttgctttctgcaaagagtgtgagaacaacgtaggatcttggcataaatttctcagacatgttcccttgaacaaaatgacagaaccagaggaagtttaacctctaaacagaggaggaactgagattagaaaaggaaaaggccgggcgcagtgactcacgcgtgtaatcccagcactctgggaggccgaggcgggtggatcacgaggttaggagatcgagaccatcctggctaacacagtgaaccctgtctctactaaaaatacaaaaaattagctgggtgtggtggcgagtccctgtagtcacagctactcgggaggctgaggcaggagaatggcgtgaacccgggaggcagagcttgcagtgagctgagattgagccactgcactccagcctgggtgacagagcgagactacgtctcaaaaaaaaaagaaaaaagaaaagggaaaagggaaaaaaaactacttgtcacagtgaaggttaaatttcagaatagattactgaggactctttgaaatctgtaattccgaataccattagggtccttatgtgctgtcttccctgagccacaggacatgaacatgatgacttctcaagctcctaactgatgtgaagatactacggttttaatacgtagtaaggtaactatctctgacatttacaaagctgctaattttagattataccaaagcctcagagttaggccttggtataattcaatattaatatgaccaaggaaagtgttacctgctgcatctgctgctggagtctcttcctttgtgctgggtccagaatcagggtctgatgaacttccttacactggggtttaaccttctctacctccttctgctgtttggctgaaggtttcttcatcttcagctgttcaaatagttccttcgctatctgatgttgttcatttagtaggttggccagtagttcctcaaacctatcccaaacggggatgactgaatttgagtgttttcctaggtccacaacacatccaattctttgcaatgatgagcaaagagcctgaacaattttcattccctactaatccccccttttcactttagccaacagtcaaactcccagccttacacaaatcttttcccaaagtagttagcatgcatcaaatgattctgtattacaccccatcccattcctctacaattcctcttccaaataatatacaaatgaagaaaaaattaaacaaaaaactagggacagagaaatatatgggtaagaaagcagccaaggagctggtgggaactcatcattctcatttcttctctcattacttgttactccctgggatgttactcccatcccaggtccagcttgtcccattatcctatctactcaggctgcactgccctgctttcttaacaagtcaaagactttctagcatgaagcaggaaaaggatataccaaaataactgaagtacatggtagttcaaatgaacagaacggagaagttagttaaaatattatccatgaaggctatcttcttttagccctttaaattcctcttccaaggttcctaaccctaacttcccatccataccctcctgaaagattgtttgcagggctgaagcaaaaattccaatacctagcatgtcagttctatgtatgattactataccttttctatgtttacatagaaagaaataaagggagaataatatacctaaatgattaagcatatgctgataccctatgcaacaggataagatctgctgaagtagctataacaagcaggttatcatatttcaaggaaccccctatattacagcaatagttaaatggtaacgtttttcaatagtttttgcagataaagattacgtttgaataagttttcttttatagtatttactgtaggtttgggtagcacagagtaaaaacctgaagaccgtgggactgtctatacaatctttactgagaactgaaaatttgaacatccgcgctaccaccactgaaggaacagaagagaagaagcataaaaaagtagaaaatggaaacatagcctgcacttagttttaacaaggattatttaggtaattgataagggaagccccagagtttttgttttgactgtctttttctcctctctcttccttattgtgttttaagatgtgcttactctctatggacttacagagggatttttatttagtcaaagattaaaacaaaaacaggtttgtatttgcaatcgaaagagaagcagaagctgcccaagtacagtcatgcgccacagaatgtttcagtcaataacgaaccacatagtcagaggtggctccataagattactgtaccttttctatgtttacatacatatgtacttaccattgtgttacaactgcctacagtattcagtacagtacagtaacacactgtacaggttttgtagcctgggagcaataggtatgcagtaggctaaaccatttaggtttatgtaagtacattctacgatgtttacacaatgatgaatcgtttaatgatagatttcacagagggtatgaccatgagatgatatatgactatattccattgaataccagaaggtaactggattctaacaggaattttaaattagttctatattttccaaattttaagaagttataaagagttgatcagcaaaaccaaaatatttattaatcagatcctattatacgttcccaggatgaatggttccattctgctataccagaattttgttctatgaactataaattaaaataatgggtcaaatactgacttagcaatcttgagatttttgatgtagttgtattgtgatatttgttgtaatggagaatgactagtagttctagtttttaagacattggttggcctatcttatcttttttcactaaattggaaaatccctaaaggtctagctttcagatggaacccaagctctctgcttagtagtgctgttaagttcaaacacaggactaattacagggactattctctttgctttgttccacttatggcacaaactgcatcctgacctctcgccatcgacctaatgattatatgctgctacaacagaataaagtgcagatgcaaatccaccacaaaatgaggaaaaaattaaagcctctactttctggatgctgtaacacaagtgccaactttaggcaaaaaggtcagcacgtatgtttcagactccttactgcaggtgcttcagggtttgctccactaatgcctaggtgactaacaaattttcagtcacatttagcagatattaatggcacataaaaagaacaaaagggacagactggatattacaatatagggtagtttgtgtggctggccacattgagtcctacatacctctccagcaccactcacccggagaagtggatatggatgccagctactgttttttctcccttcccaaacagatacagcttggcctacagctgcactgccccataacaaggagacttcacttgacacctaactcctgacaggactctgcatccttacatcagtaacagaagctggctggggatgaaaaattgttaactgcaacttctgaaaaccttttcagaaataaactcttcctctattccaaatctcaaggtcttcaactagcctaccgtagagcttgaggggtgttaaagttagcttgaggctcagccacacgctcctcctcttctgggccatcatcttccatgttggagaatcccatctcatcttggaactgtgggcaaaggaaagggagggttttcctggggaatgggcttttgaatgttgctccagtgttgggaaggaaaagtgaaaactataaacaatactttaataatgctggcacccagaaagagcctacatcagaacctttctcacttcaggactcctacaaacccacatatggaatgactattatgccaggaaagaagttgctcaaccagtcaacttgtatcagtaagcacagagctaggataactcaaaatgatcaatttcttaaacagaaatatctttttagacaaatttatggaaaaggtaattatttgtgtgcaaaatactttaaaactagttggcaatctttaaggacacaccaaatgacagtaggggaagccatcaaaagttttcaaggggcaagatgtgctggctcacacctgtaattccagcactttgggaggttgaggcaggaagattacttgagcctatgagttccagaacatggcaagaccctgtctctacaaaaaaataaaataattagccgggcctgtaggtgtgtgcctgtagtcccagctactcaggaggcttagatgagagaattgttttgagccctggaggtcgaggctgctgtgagctgagatttcaccactgtattctccagagcctgggtgacagagcaagactttgcctcaaaaaaaaaaaaaaaaagcttcaaggaaaattttagtaagaataacctacatgtggataatcaagagtctagcagttagcaaatttcttttgtcattatattctttcccaggtagactaaaaggagaattggttcagtccctcttctagaaggagcatcacagagatcaaaggacacattttgttggagaaccaacttacaatcccatgttctcacttgaggatcattactcacagtttcaaacagatcttccatcagctcatttgcttccttttctgcaaaaaagccaaacgttgttggtataaattagattcattttacaatatggaggaattccatgtagacaatgtatgatgttttcaacaaggcatctgacgaattcttcatatctatccttattcctgagacagggtctcactctgtcacccgggctggagggcagtggcttgatctcggctcactgcaatctctgcttcccaggctcaagcgatcctcccacttcagccctccaagtagctggggcaacaggagtgtgctgtcatgcccggctaattcttccatattttgtagagatgggttttccccatgttgcccaagctggtcttgaactcctgagctccagtgatccacccaccttggcttcccaaagtgctggggttacaggcatgagccaccacgcccagctatccttcattcatttattcaaaaacatttattgagtacttactatgtttcaatccctgttttagatgcttgggatatatgagagaatgagagagagagagagttctaatctcattgaacttaaattctaataggaagaagacaaggagaaaatgtgagctagatgatttttttttttttttgagacggagtttcgctcttgttgcccaggctggagtgcgatgacacgattttggctcactgcaacctccgcctcccaggttcaagctattctcctgcctcagcctcccaagtagctgggattacaggcatgcaccaccacgcccagctaattttgtgtttttagtagagatggggtttctccatattggtcaggctggtctcaaactcctgacctcaggtgatccgcccacctcagcctcccaaagtgctgggattacaggcatgagccaccatgaccagcccaatgattttataattagatggcctatccaaacccacacaatactgaatggaatcaagagacaagtctcccaacctgggcaaaatgtcaacatatctctaaaaaaaaatttatctgggcttggtcgcacatgcatatagtcccatatacttgagaggctgaggtgagagaatctctttgagtccaagaagcagaggctgtagtgagctgagaccgtcccactgcattccagcctgaacgacagagcaagacactgtctccaaaaaaaaaagagacagacagagacaagtttccaacagtgtttcataggactctatctttggacccgacctattcaaaaactccatcagtgaattagaagaccaagagaacatacttaacaaatctgtagatgatgtaaagctgtaaagctgaaagggactgccaatccaattgatggaaaattcagaatcatattttctcaaatcaactggatgtaacacgtaaggataaatttaaagttctacattgaggatttttttttttttttttttttaaatagagccagggacttgctatgttgcccaggctggtcttgaactcctgggctccagcgatcctcccacctcatcctcccaaagtgctgggattacagacatgagccaccccacctggcaagatcttatatgtgtattcaagatattacacaactcactaagtctccagatgaaaaccagaatctctaaatatagtttgacagtttgacaatgcccaatgacagactaaatgagaaattaggaggcagcttgatttttttttatttcctcagagatctttgttctgagttctgactcttgttctacaaatattcaaagtcgaaatgattatcatgttaatgggtaaagagcttcaaatctttggctatctcatttttttttaatttttattcatttgttttaccttatgtgttcctctacaatggttatctaggaagttaacaaccattctagctatctagcattctggttcttgatatcatgtaaaatgagcgttctgatctctgacacacaaagctatttagaagataaaaaatagacatttttttcaacaatcattttacttttttctctacatctacatactctacatgtcagagtttttgtttctgttttttcgagagtagctgggattacaggcacctgccacaacacctggataattttttgtatttttagtagagatggggtttcatcatgttggccaggttggtctccaactcctgacctcaggtgatccacctgcctcagcctcccaaagtgcagggattacaggcatgagccactgcacccagccaagtactttgattcttaatggaggatttaatccactgacatcccaaaggacaaactatccaatggaattcctggataaaacacaggcacacagtgtctcttcctcagaggaaagaaatttttgtcaacagaagaattttgctcttctgggcgtggtggctcctgcctgtaatcctagcactttgggaggctgagcctggaggatcacctgaggtcaggagttcgagaccagcctggccaacctggtgaaaccctgtctctactaaaaatacaaaaattagcctagcgtggtggctaatgcctgtaatcccagctacttgggaggctgaggcaggagaatcgcttgaacccgggagtcggaggttgcagtgagccgagattgcgccattgcactccagcctgggcgacaagagcgaaactccatctcaaaaaaaaaacaaaaaacaaaattgatttgctctagcagaaaaataattatatttcaggaattccttcaggaatcctataccagtactaaaagatcctatattggaaaatgaaaatgcccaaattaataagtcctgagatagaggagaagggatcttgttttgtccatcactgtatcttagtacctggaatagtgcttggcacataataagcattaaatacatacatggcagtcttgtttctgaaccaaaatgaggtggtttaatgaaagagatgggtttggctaggcgtggtggctcacacctgtaatcccagcactttgggaggctgaggcaggtggatcacttgaggtcaggagtatgagaacagcttggctactggctaacatggtgaaaccctgtctctactaacaatacaaaaattagccaggtgtagtggtgcgtgcctgtaaacccagctgctcaggacattgaggcaggagaatcacttgaatccgggtggcagaggctacagtgagtcaaaatcctgccactgcattccaaactgggctacagagcaagactccatctcaaaaaaaacaaaacaaaacaaaaaaaacaacaacaagtgaaatactgaaatactgatcagctttaaaaagagaactgtcataaccaccccaatttagttccaagacttaggcttccccaccaaggcaaaattaacacagtaagaaggctattccagttcattttggagaaaatcttggatttggtaagcaggtaaaaagagctgggcatgctggctcacatctgtaatcccagcaaactgggaggccaagacaggaggatggcttgaggccaggagttcaagaccagattgatctacatagcaagacctgggccaggtgcagtggctcactcctataatcccagcactttggaaggccgagacggctggagaacttgaggttaggagttcgtgaccagcctggccaacgtggggaaaccctgtctcaactaaaaatacaaaaatcagcagggcgtgttggcacgcgcctgtaatcccagctatttgggaagctgaggaaagagaatcacttgaacctgggaggcagaggttgcagtgaggcaagattgtgccattgtactccagcctgggcgaggagagcgaaactctctctcaaaaacaaaaacaaaaacaaaaaaccatagcgagacctaatctcaattaaaaaaataaagaaattgtatacacatacatgcacatatatgcacactacacacacatatcacatgtacgttttgagaaaaataacaccatgaacctactacccgttaaaaattagagaaaatattaaacttttcacaaatttacatagcattcttatacaggggccatgtcaatagaaagaaaggactatcagacaatttttcctaaaacttctccattatctcactgaatcctataatctgtcctattaaaacacctttttacatttcttgcttttttttttttttttgtgagacagagtgttgctctgatgccgaggctagagtgcagtggcatgatttcagctcactgcaacttccccctcccagttcaagcaattcttggttcaagcaattctcgtgcctcagcttcccgagtagctgggactacaggtgcactccaacacatgcagctaattttttgtattttagtagagacggggtttcaccgtgttgcccaggctggtctcgatcttctgagctctgacaatccatccgcctcgtcctcccaaagtgctaggattacaggcgtgagccaccccacctgaccaatttcttgttcttttaaaagtacagtaattatttttaagttccagtaataaattaatgggtagtctgtcaaatagctactggattttatatcaggagggctttctacatgtatgtatacccaaaaatgacattaagacctttttacataaactcactgtagagatacatcccaaaacaaggtaaggaatataaatgatgtttaccttcttttcaaaccaacagttcctttatacaaaaacaccagatgatacaaaacatatttttttaaagtacaaagttccatacagaataaaataaacactttatggttattcctaagaataagtagtgacaaaaagtctttgcaattgggtaataaaatttcagcttctaggaatatgtttccctcttccttgtccttttgagagctgccactatcacacaattcacagcatctcttcaaccacagaaaattagcgtctcttcaagcacagagaccatatattaattatctttgtgtctcctgcataggattaactcagtgtttgttataactaagttaaactccaagacaggagcttcaaatcacctcaggcccaatccaaaactgaaaaaaagacgcttctcagagtttgagaacaaaaagatactgacaaagaacaaagccatagatacttgtgcgacattagcttccctttttaccaaatacagagtcatttactaatactgcagaaatgtttgcagacgataaaaagaataaattaaaaatatggatcctgtcaacatgttcaaatactaacatagactccttcaccttaaactcatactaacatccacacacccgaacaatgaaaatgaaaggttttcaaatgagatctaaatataaattggctctatttcattacagtttaagttcctaaaatcatatatataaatcatgtgattgcgcttatgctcatcttctaacttgagggcccagtgtctttcatccgattctctgaaggataagtgaccccaaaaaacttttaagaaccactaatctagcctatcaagaaacatcccattttccagaagaatacagctaagttggcttagttcatgcattcttacctcatattcatagagttcatagacgggatccttactacatgaaatcagtcttttttttttttttttttttttttttggagatggagtctcctctgtggcccaggctggagtgcagtggcgcaatctcagctcactgcaagctctgcctcccgggttcacgccattctcctgcctcagcctccccgagtagctgggactacaggcgcccgccaccacgcccggctaattttttgtatttttagtagagacggggtttcatcctgttagccaggatagtctcgatctcctgacctcgtgattcgatctcctgacctcgtgatccgcccacctcggcctcccaaagtgctgggattacaggtgtgagccaccgcgccctgccgaaatcagtctttcaaaggattccttcagcccagccaagaagttccaacatccacaggcacatatattaacaattaccagtacccaaaaacagttctctggttttaattccacactgcctccctcaacttaatacctaccaccgtcaaaacaactcccctcagattgcatccaggctatttacagagacaccttgatgatcctcacctcaaggcatggaccattcattgaatggttatatttgttgaatgagtgaaaaaggatccttcctcccacagatttcaagttaagctgtcagcacccatgcagctgctctggtacaagttaagctgtgaaagccttctccctcacgcatacaaccttaagtgtcagaaatgctctgcttcctccataaatccaaaataatatagccatggatatgcatttcatacaggtcagactcggcaaggacagctacgttccacatacatatctgacacaatcggtctcccccaaatacaagccaaccagtcttatgtgctcctatctttccagcatactcagatttgccgacaaagacttcctgaggcaccatggtatgctgaatatactgctgcagtagtagtgaaaatatgggagttacagttccaactttgtcaccaatttaacatgcggccttggagaagttctctccttatgcctaaatttcctattttgtaaaatggaagaaagcatcctaccattttcacagagattcagtatcacaaagaaactgaaagagctttcttattgtattgtaaactattactataaacccgcgacaacaaataaggccacccattctttacagctttgtagcaatgattctgttaaagatattttggcccttcacatttacacaactcactctaaccaaaggcacaaactattcttaagaccacaactggctatgccaagtttctcccctccctgacctcacagacacatgctgtacagaacactaccattgccgctctttcccaacaagtaactaggggctcccaatccctaaaatacacacacatatcaacctgcaaggaacctcccaacatttattcaagaaataagctaacttataaggggaactccattacacttacacaaataaaggcaaactcttacggaaacacttgccatcctcacatacacacaccaacacagccgctacacaccaacagaccatctgtctgctagaccaaaaacatctctttccatgtacaaactaaccagtgacatttattaaacgtacaacactgagatcatcctgtcgttcccacataccgttcaacgcggcagggacaccacagaccttgtcacacaggtaaaatcccctctcaagatcgtgtcctcgaccactcttatcccttaattaaacacacacaaactggactatgggggaggctccgatcatgcctacaaacacaaactaacctgtcaggggcacagccgactccgcctccactcgcttacttcccagccccctccgggagtctgcctgtcagggacaccccttcaccccgcctggagggacttcccggtaggctcaggatccccctccctgctctcccctcccccatcttcaccactgctctcccagaggtccaggtccgggagatgacagtggctcccagaaagcccaggattcaatcgctgagagagtgcttaggcccgaatgccggcccaaatcgttctactcaccgtgtcggaggccgagagcgatgagagtacagggaagtgaggaagagggggtggccgccaggctcctccgcttccctgggtccaccgcggatccctcccgcttgtcaggaggcggccagcgggtaagccgactggcggaaatgcgagagaggagaagggaaaggtggagggctaaaggggcaaactgagaggaggcggatcccgcaaccgacactgggatcgtttcccctcgcaaagcgaacccaaaatggcggcggcagcggcggcagcagagtggccgcggcagctcctccagagggagggagctaagggcgcctagcgacacccccaacctcccactcctccctcctcgcgttcttccccacggtcccccgcttcgcccgactccggccatgtagcgcgcacgtcagcccgcacgcgtacgagtgtctacgggctcgtcgctggctgctcccaccaaccaccaccttcggccgtcctgcgagccagccatcccgtacgcgctcacccacgggaacctcctcgcccagttctccactccccctcagaccctgtcaagccggctccagcgcaggccctcacgcgtaccttcagcggcgcgagcccaagccttctccacctcctcttctctcctccccctccctccccgcccgcacggccaccaaccgccgccaaagcagccgccgccagcacccccaccctacactcctcgcgcgtgcgcctcccacagtccccaccgcgggactgttccattcctggcggctgcaggggcaggagaggaagggaccggcaaagcgagtctggcttgccgtttgactggaattgccagggtggccggccgagtcccatgacaacctacctccctgggttcgtcgccgcggcgctgcggctcgcctcctcctccatgggaccgcggcgaggggatcgagggcggcctagcgcccctctgccggccggtggttggaggccgcggcggctgcgcgttgagtcgtttcctgccggatgacccgacccttttttgcagtctcaggacgggcgctttggagccggccccaggcagcgtgtgtcggtcgcctagtctggagaactagtcctcgactcacggtgagggaatggaccgacacgggtattgtaccgctgagggaaaggagcgggactccggacctccaggaggtagggagtgaggccggtagaccggcgcgcctccgggggggattcctcccgggcgttgagttgccaacctgggacccgaggaagttcggcgtggtggtgtgctttttgttgttgttaaccctcctcggatttctcgaatttcacaccactgtccatatgcgatgatgtttgtttgcccttgacgcacttactcatggatggtacttcagcctcgttagacagcctggtgatggaggatgaagaaaccatgtgcttctcattcagttctggactcagtttcccttgtcttcagcaagttatttttgttagttccttatcaaaaagtgtacataaaaattaggcaactccaaacatgcctccagggttggtgtgtgaaataataagatagggctgggcgcggtggctcacgcctgtaatcccagcactttgggaggccgaggcaggtggatgacaaggtgaagagatcgagacaatcctggccaacatggtgaaaccccgtctctactaaaaatacaaatattagccggccgtggtggcgggcgcctgtagccccagctactcgggaggctgaggcaggagaattgcttgaacccgggcggcggaagttgcagtgagccgagatcgcgccactgcactccagcctggcgacaaagcgagactccgtcacacacacacacacacacacgaaataataatatatgtaaagtggaattagctcctaggcatagggaaggtgcagagtattgccgtgttgtcatttacagttctgttgatgtcgataacgtttgtgggtgtaatgggtagtgttctgtccctccaagtcgttaataaaacaaagcaggccgggcgtcttgttaaatagttgtatcaatgacttgatttagattaatgaggatatatttttcaaatttatgccttttacaaaatttttaaagagtaggtaatgtcggtgatagatataaagaaaggaaaagatctccagatgtggaatcttctactggatcctgtaacagaaagaagacattaggctgggcgcagtggctcacacctgtaatctcagcactttgggaggcggaggagggcgcattgcttgagcctaggagttcgagaccagcttaggcaacacggtgaaaccccatctctacaaaaagacacaaaaattagacaggtgtggcacacgcttgtagtctgagctacttgggaggctgaagcaggaggattgaggaagaggttgcaaagttagccgagatcacgccatcacactgcagcctaggtgacagagcgagaccctgtctcaaaaaaagaaagaagacattagcagaaaagctgaggaaatgcaaataaagtctgcaatttttaaatagtattgtaccagctttaatttcttaattttgaaaattgtaccatggtcatatgtatgtaacattaaggaaactctaatgaaaattgtaagaaagcactttgtactacctttgcaactcttctgtaaatttacacttttttttgtttgtttgctttgagataggatctatgtcgccaaggctggaaggcagtagtgcagtcctggctcactgcaacctcaagctccttggctcaagggatcctcccacctcagccatctgagcaactaggactacaggcacatgccaccacatccagctaatttattttattttttttttgagacggagtctcgctctgtcacccaggctggagtgcagtggcgcgatctcggctcactgcaagctccgcctcccgggttcgcgccattctcctacctcagcctcctgagtagctgggactacaggcacccgccaccacgtccagctaattttttgtatttttagtagagacggggtttcaccgtgttagccaggctggtctcgatctcctgacctcatgatccacctgcctcagcctcccaaagtgctgggattacaggcgtgagccaccatgcccagcctccactatcgaactttagaacattttttatcacccccaaaagaatcttatcagtaagttgctttccattcctccctcccattgcctctcgcaaccactaaatcagtttatgtaattaataagcaaattatggacatttcatgtaattgaaatcatactatatgcaactgtcttcttttactttgttttgaaggttcatccagttgtgtaatgcatcagaactttgtttcgtattgccaaataatattccattatatggctataccacgttatgtttattcatcaattgatggacatgtgaggtatttccactttttggctcttatgcataatactgctacgaacatttgtgtacaacttttgcatacacttgtttttatttctcttttatacctgagagtggaattgcaggttcatatggtaactccatgttttaccttttgaggaactgccaaacttttccaaagtggcctcaccgcttaaaaaatcctaacagcaacatataagaatcctagtttttccagattctatccaacacatgttattatcagttcttttgaatttcatcattctagtgggtgtgaagtgtatctcattgtggtttttatttgcattttcttaattttgggggaccagtctcagcaccacccgtagggtatccgaagtccggtggcgacaaaggaatgagaagagacaggttaagtgttcataaaggtgggagccagggggccagttgcaaaatggaggctgcaaaaggcccagagttctgatctccacactgtttattgagtacagtcacttagatctaagaagcagatgttcagggcgaaacagtcaaagggaagcagtacgtcatacacataatctgtagcagtggcggtttaagtgaatctcctttgtgcttaaacaacgtatctttagttagctggtgggagtgggcttaactaggagcctgcatatctagccacattccagtgcttcagaggagcgtctttcttcttgagcacagtgtttatagataagagagcaggttgtgctcagagcatgggaacataatggcgataagaaggctttcctcctcagagtcctcttgtggctttccacaacttactgtcccatgtttttatggccagtttatgcaggcaccctgtaagcctttttcccaacatgccccccttttttcttttttaaaactgccattgctattaagacttgttcctggtgtctggtctctctccagaggcatcttccgcatctgcagactaaaagcaaacagcataaacaggtacacattaaagcaaaatttgcgatagttgattctctaacggtcttaatccacttaagaggatttatgtttgaaagtccatcagcagctccagtgagaatgtcagtcccaggcaggagagttaaatgagcctgagatgctttaaaaacctgttcctttaatttggctatattcagtgtaaaatttccatccctttcttccagatgatgtctaactttttcccagtgatgttcagtagcattgtatgaatggggagttatgcagaaatcagaagtattccaatcacattgcatttgcaatcgatgctctaagcttattatacgatctctcatccaaataacagtctgtctaagatcatttatttgatttgccaattgttggtctatccgggtctgataattccacaattttgaggaattcttttgccaattatttacatattctgcagtttgaacagaggagtgtaaagcaattccagcagccacaacagtagctgtgactgcaataaggcccataatgactgctataagggtaaaaataaatctttttgttctggtaaacactccctttaacatttctgtgaggatatgaatggaagaagaggctttccaaggtctattgagggaaaccggtatctaaactcctctagccctcaccagcaacacagatgttttcacatcaaacgtggaatcaatacaggtgaaaaggtgacagttttgacaagtaatagtttgagaattaggtcgaatatcaatatttccgaccatcaacataaaaggaggcttgacacagctctgaatgggcgccattcggttggaagaaaactgatacacaaattgaagtctctcaccttttccctcaaggtaatatttttcttctcaaacctgaatatgagattgggccatcattaccttccataatttgggatgttcagggcctattattggattaatcatttttggatgtgggccggctataccaaaattggttgaaattatgggaaactgggcatgtttttcagtgtaaatagtgtcatctctttgacagtatagttcctgttttagtcctgtcttgtatctatcattctgattggtacaattaactgcaaaggtccccttaggggaccaatcagtgacaattccataggaattattttgaagtaccacagcgtgatcagagatgcaatcctggccgggagtggtggctcacgcctgtaatcccagcactttgggaggccgaggccggcagatcacctgaggtcgggagttcgagaccagtctggccaacatggagaaaccccctctctactaaaaatacaaaattagcagggtgtggtggcacatgcctgtaatcgcagctacttgggaggctgaggcaggagaatcccttgaacttggggggcggaggttgcagtgagctgagattgcgccattgcactccagcctgtgcaacaagagcaaaactccctctcaaaaaaaaagaaagaaaaaaaaagagatacaatcctttcaaatcaatatttctaaatcatttgactgttgttgaggttgttgacacctctcttttctgggcttaaactgttacagttgaactgaactctgtggatgatccgggctccatccagaaaataaatgataggatactggtctttgattatgacctgaaattttaactagccaatgttgtccgtagccttttaggcaaccgacagctggccctatgcaaagaggaggggaactgataacccatggacatatttattaacattccttcctcctctgggtgagagggcccttgagtatctgtaggctcaggcatccaaacactattattaacataagcctcaaccgggggttccaaccatgtgacaggcctaattaaaggtggaaatgggacgtatgcccaataggtataattttggtctgctgtagccacagggagacttaccaccatggtaattaccgcaatcatagctaccatcaggttactcgaggttagtggtttttgttgtgttttcaggttttcttctgcaaggtgggtcagcctcttgatctgtccccaagttggtgggctcgcttgatgggttttgttggtcttcatctggttggctgaaatgttcattcgagccatcaggcgtgctgggagtggagatcttggttccaaaatccttttctcttctttggaaatttgctcatggtagaatttaagatgtcttgtaggtacccaaactggaagctggttttcttctggggaaatacaaacaaaccctcttccccatgttatatctctctttttcccaggtctttgttttaaagtccttccaccacacaggttttccttcatgaacatttaccttctgtcctgttaaatgctcttcagctgctatagtaacctgattgcggaagatgttcaaaaaatttaaggtaacaagagccaattgtaactgcatatgaggggtggaatattccctatctccccctattttctttttatgtaattgcatttttaaggttcagttggctcgctcaacaatcgcttgcctttgagaattataggggataaccgtactgtgttcaatgctctgttgttttaaaaatgtttggaaagatctactacagtagcctggtctgttgtctgtttttaatttttgtggaattcccatgacagtaaaacaggaaagcaagtgtctttttatatgtgttgtagtctggctggtttggcaagtagaccatataaatgagaatatgtatctatggtcacatggacataagaaagtttgccaaatgcaggaatgtgggtgacgtccatttgccagatcatgttaggtgccaaccctcgagggttaacaccagttccttgatacggtagttgcagtacctggcactgaggacgatgttgtacaatgtccttggcctgtttccacataatttgatagttgtttgtaagtcctgttacattaaggtgtgttaatgagtggaaagtctgggcatcagtaagtatgggggaaaccaacaagtcagcttgctcattagcctcagtcaagggtcctggaagattggtatgtgctcggatatgagttatatagaaaggaaaatcccgagcacacacagctgtttgtaaagagttgaacaattgataaagctgtttatcaataatatatttaattaaggcagtttcaatatgctgagtagcttatacaacataagctgaatctgaaacagtattaactggctgattaaaatcttctaatactgcaatcattgcctgtaatttagctctttggactgaggaagagttagtgtggataactttaccacaaggtcccacatatgccgctttcccagtactggagccatcagtaaaaacaatcatggctccttccaaaggggcatcacgagtaattttcggaagaacctatgtagttaattttaagaactggaaaattttatttttaggatgatgattatcaatacattcaataaattctgctaaattaacttgccatgtaactgagttaataaatgcctgcttaatgtgacttttatttattggaactataatcttattgggctcagtgccataaagtttaacaatttgcatatgagcctgtccaattaaaattgtgatctgatctacatagactgtaagtgttttcatggtattatatggcaaaaaagaccattcaaccaaatcattattttgaacaataaccctcattgaggagtgtgaagtagggaacacaatgaattgaaaaggcaagactgagtcaatcctactaacctgggcttgctgaatttttttttttcaattactcttaactcattcatggccttgggtgttaattctcttttatggtgtaagttgcaatctcccctcaatatttagaaaatattagacatagcataagtagaaattcctaaggtgggctgaatccaattaatgtctcctaacaatttttgaaaatcatttaaggtttttaaagaatcttttctgatttgaaccttttgaggcttaatggctctatcttgtacttgtatccccaaatattgaaaaggaagagttgtttgaattttgtcaggtgttataagcaatccagcatttgtaattgccttttgcaaagatgaataacattgaataagttggtctctattttttgttgcacatagtatgtcatccatataatgaatgatgtaacaatctggaaattgatctctaactagctggatagctttgcctacaaaagtttgacaaactgtggaactgtttaacataccttggggtaaaaccttccaatgatatctggctgcaggttctttgttattaatggcagggatagtaaaggcaaatttttcaaaatctgtctctgccaaaggaattgtaaagaagcagtcttttaaatctataataacaagcagccagtctttagggagcatggtgggggatgggagccctggttgtaaagctcccattggttgcattacagcgttgacctcttgcaagtcggtcagcatgcaccatctaccatactttttttaaaattacatatactggggaattccaaggagagaaagtgggtgaaatatatcctttttctagtagttttttaactatttcatggaacgcccccaagtttttctgagggagcggccactgttcgacccagacaggatgctgcagggtgagcctgaattgcttcttcaccatagtgaactgcaggttgggcagtaatgggtgcggcaagctgagtttcaggctccctccccctgcactcactcagctgaggaggaggtggccattccggacatttctctgaagaagctgcgggctgaacaattttctgtgtaggtttagggagaccggggggattggtagaaatcacctccggtatcgggggaaccagcccccaatatttcaacataggttctattttccgtaagtgtgccagtctgagaaataaagagaaagagtgcaaaagagaaattctacagctgggtctccgggggtgacatcacatttcagcaggttccatgatgcccctgagccgcaaaaccagcaagtttttattatggatttcaaaaggggaggggtgtacgaatagggagtgggtcacagaggtcacatgcttcagaggcagtaaaatatcacaaaggcagagaggcagagcgagatcacaaggccagggcgaaactagaattactgatgaaggtccatgtcccgctgggcacattggacgttgatattgataaacatcttaacaggaaacagggttcgagagcagacaaccgatctgactagaattcgccaggctggaatttcctaatcctagcaagcctgagggtgctgcaggagaccagggcatatttcatcccttatctccaactgcataagacagacactcccagagcagcgattttacagatgtctccctgggaatgcattcgttttcccagggttattccttgctgagaaaagaattcagcgatatttctcctattcgctttctgaaagaagagaaatatgactctgttctgcctggccccacaggcagtcagactttatggttatctcccttgttccccgaaaatcgttgttatcctgttcttttcaaggtgcccagatttcacattattcaaacacaaatgctttacaaacaatttgtacaggtaatgcaatcatcacagggtcctcaggcgatatacatccccagcttacgaagatgacgggattaagagattaaagtaaagacaggcataggaaattataagagtattgattggggaggtgataaatgtccatgaaatcttcacaatttatgttcagagattacagtaaagacaggtgtaagaaattataaaagtattaatttagggaactaacaaatgtccatgaaatcttcacaatttatgttcttctgccatggcttcagccggtccctctgtttggggtccctgacttcctgcaacactctggactctccctttttattagtacttggtaggggtggttcagagtcctgatcattaaactcctctctctcctctgactcagcctcatcatctatctgaaaagcctccagtgctgtacacaccaatgaccaaactgaccaaacaggcaaaggaatttcctttccctttctttgtgctcttttaaggtcctttccaattctttcccaatctttcaattccaaagttctctgttccgggaaccaagggcaaaattgttccacagcataaaacaaatccataagattttttgtatcaacttttacaccactacgcttcaagagctgccatagcaagctcaaatacatggcgtacttactttcagtttgtcccatttgtgtccctagctttctccaagtgccccgctcacctgcggagcttaaaactttttcgtctttgggagtcctttgtctgtcggtcctccatttcacacgcttgagcatgccttcactggattctttcgggcctcatgttgggcaccagaatgtaggggaccagcctcaacaccatccgtagggtacctgaagtccggtggcgacaaaggaatgagaagagacaggttaagagttcataaaggtgggagccagggggccagttgcaaaatggaggctgcaaaaggcccagagttctggtctctacactatttattgagtataatcacttagatctaagaagcagatgttcagggcaaaactgtgaaagggaggcagtacgtcatacacgtaatgtgtagcagaggcggtttaagtgaatctcctttgtgctcaagcagcatatctttagttagctggtgggagtgggcttaactaggagcctgcatatctagccacattccaatgcttcagaggagcgtctttcttcttgagcacagtgtttatagataagagagcaggttgtgctcagagcatgggaacataatggtgatcagaagactttcctcctcagagtcctcttgtggctttccacaacttattgtcccatatttttatggccagtttatgcaggcaccccatgagcctttttcccaacgcttaatgactagtaatgttaaacatcttttcaggtgcttatgggccatttgtataactactctggagaaatgcctactcaaatatttttccttttcatttttttaatttgaggcagggtcttactctgttacctgggctggagtgcagtggtgtgatcatagctcactgcagcctcaagctcccaggcccaggtgatcctcccactttagcctcccaagtagctaggaccacaggctcacaccaccacacctggctaattttttaaatttttggtagaggacaaggtctcattatgttgcccaggctggtctcaaactcctggaattaagcagtcctcccgtctcagcctcccgaagtgtgagaattacaggtgtgagccactgcacctgacccttttgcctatttttaaattgagttgcctttcttttttttgagatggagtctcgctctgtcgccaggctggagtgcagtggcatgatcttggctcactgcagcctccacctcctgggttcaagtgattctcctgcctcagcctcccctctagctgggactataggcgtgcaccaccacgcccagttaattttggtatttttggtagagacagggtttcaccatgttggccaggatggtctcaatctcttgacttcatgatctgcccgccttggcctcccaaagtgctgggattacaggcatgagccactgcacccagccttgagttgactttattgttaagttgtaagagttctttatatattatggatataagttaagttctatgtgatttgcaaatattttctcccattctgtgggctgtctttcacttacttgatggtatcccttgaagtacaagtgtctgatttggataaaattcaattctccatttttagtttttttgcttgtgcttttgatgttatagttaagaaaccattgcataacacatgataatgaagatttactttctctgtagaaaattagaaaacttgagggaggtggggggggcggtcagccccccgcccggccagccgccccatccgggagggaggtggggggtcagccccccgcccggccagccgccccgtccgggaggtgaggggcgcctcggcccggccgcccctactgggaagtgaggagcccctcagcccggccagccaccccgtccgggagggagatgggggggtcagccccccaacccggccagccgccccgtccgggagggaggtgggggggtcagccctccgcccagccagccgcgccgtctgggaggtgaggggtgcctctgcccggccgcccctactgggaagtgaggagcccctctgcccggccagccgccctgtccgggagggaggtgggggggtcagccctccgcccggccagccgccccgtcccgtccgggaggtgaggggcgcctctgcccggccgcccctactgggaagtgaggagcccctctgcccggccagccgccccgtccgggagggaggtgggggggtcagccccccgcccggccagccgccccctccgggagggaggtgggggggggtcagcccccctgcctggccagccgccccgtccgggaggtgaggggcgcctctgcccggccgcccctactgggaagtgagtagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttaccctcaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaaaaagaaaatgatcaaaacaaatgacagggctcagggcaaggggcaaaactgttcccctgccaggctgtttgatagaaaaaggaatggttttcttagttctaaagcttcaaccacactggatccttgtgttttcacaacccttaaggttagagccaactttcaaaaagaataattaaatcgggaaataagtggggtcagcaggtttcgtagtgcttttaaacaggaagtctcagaactcatggagggaagtagctgacagcaaaactgctttcctactcatcaacccaaagaactgcttaattccagaagaagatagaggagcacatctcaccaaagacaagttgaccctaactcttaaatcatctacagccaaaaaactgattctgtacctggttgatcatgcctgtaaaaaaaaaaaaattaaaaattaaaaaaattgattctgcctataaaaaaaaaaaaaaaaaaagaaaattagaaaacttgggccaggccccgtggctcacacctgtaatcccagcactttgggaggccgaggcaggtggatcatgaggtcaggagatcgagatcatcctggctaacacagggaaaccccgtctctactaaaaaaaatacaaaaaaattagctgggcatggtggcgggtgcctgtagtcccagctactcgggaggctgaggcaggagagtggcgtgaacccgggaggcagaggttgccgtgagccaatgagctgagatcacaccagtgcactccagcttgggggacagagcgagactctggctcaaagaaaattagaaaacttgcccctgcaagttttattcttggagctcttatgagtacgtctatgatctattttgagtatgatatgaggtaggggtccattttcattcttttgtgggtgaatttcaggttgtcccaacagcatttgttgaagacactattctttcctcattgaattgtcttggcatccatgttgaaaatcagttgaccaggccgggcacgatggctcacgcctgtaatcccagcattttgggaggctgaggctggtggatcatgaggtcaggaggtgaagaccagcctggccaagatggcgaaactccgtctttactaaaaatacaaaaaattagccaggcgtggtggtgggcacctgtaatcccagctactcaggaggctgaggcagagaattgcttgaacctgggaggcagaggttgcagtgagctgagatggtgccactgcattccagcctgggtgacagagtgagactccgtttcaagaaaaaaagaaaaagaaaaagaaaaatcagttgaccgtgatgtaaatgtatgccaataccacactatcttgattactgtagttttgtagtaagtgttggaatcaggacatatgaggcctccaaatttgttccttttcaagaatacttgggctattctaggtctgttgcatttccaaatgaattttgagattagcctgtatattagtccattttcacgctgctgataaagacacacccaagactgcgtaatttattaagaaaaagaggtttaatggactcacaattccacgtggctacggaggtcttacaatcatggcagaaggcaacaaggagcaagtcatatcttacatggtggcaggcaagagagcatgagagccaagtgaaaggggaaacaccttattaaattattagatcttgtgagatgtattcactgtcacatgaacggtatggggaaaccgcccccatgattcaattatctaccatggggtccctcctacaacacatgggaattatgggagctgaaattcaagatgagatttgggtgaggacacagccaaaccaaatcagcttgacaagttttttcttaagacagggtcttgctctgtcgcccagactggagtgcagtggcatgaacttggctcacggcaacctctgcctcccgggctcaagcaattctcctgcctcagcctcctgagtatctgggactacaggcgcccgccaccacacccagctaattttttgtatttttagtagagatggggtttcaccgtgttagccaggatggtctcgatcttctgacctcgtgatccacccacgttggcatcccagagtgctgggattacaggtgtgagccactgcgcctgacctagacttttttaacttgaaaactagtgagggccaggcatagtggctcgcgcctgcaatctcagcactttgcgaggctagggcaggaagattacttgaggccaggagttagagatcagcccaggcaacatagccagaccccatctctgtaaaaataaaaaattagccaccaggtggttgcacatgcctgtagtcccagttacttaggaggctgagaaaggaggattacttgatcctaggagttaggggctgcagtgagcctagattgtgccactgcactccagcctgggcaacagactgagacccgatctcacaaaataatcaagtagtgaggaaatactgaagaattttaagcaaggcttcagtggagaaaatgtttaagtctggatgctggtagatcatttattttaatttgggttcaagatgatagtgtcctagaacggaagctgattacacgttctgaccgtcatttctcatagtgtctataacataggcaaaataatagctccagtgtccacaggcacgcctatggaaagaagtgcatctggaccatgtcacacactccttcctctccagtacccagcctgcttcctagtccacagctcttccagtagtggttgtgccggggagcattgagaagatctggggagcacagtggggcaggtcaaatactattggagtgacattgcactctagaaaaggagccctgaaatcccacaagtgaaaaggcaggcaggccagtagagaccatcccagtcttattcaccactatagactctgtgtagtgtgggcgtgtggaagcatgtcatatgcttcttgaatgactgagtttaggagtgctttggcgtcttcattaaatagtatggctgggcaggtggcttatgcttgtaatcccaatactttggggggctgaggcgggaggatcacttaaggtcaaaattttgagaacagcctagccaacatggcgaaaccctgtatctactaaaaatacaaaaataagctggcgtggtggcgggcgcctgtagtcccaggtacttgggaggctgaggcaggagaactgtttgaactcgggaagtggatgttgcagtgagccgagatcatgccactgcactccagcctgggcgacagagcaatattccatctcagaaataaacaaacgaatccagtatatttaaggccaagtgcgatggctcatacctgtaatcccagcacttcgagaggctgaggtgggaggatcacttgagtccaggagttcaagaccatcgctggcaacataatgagactctgtctctacaaaataaaaaagccaggcacagtggcacgtgcctgtaattccagctacttgggaggctgaggtgggaagatcacttaagcaggggagttcgaggctgcagtgagctgtgattgtgccactgtattccagcttggatgacagagcaagaccctgtctcaagaaaaataacaaatgtgataaagttgaagcagagcatggtggctcacacctgtaatcccagcactttgggaggctgaggcaggaggatcacttgagcccaggagttcaagaccatcctgggcaccatagcaagggttatgtctacccaaaaaaaaaaaaattttttttttaatatgccaggcaatggcacctatattcccagctacttgaaaggctgaggcaggcggatcacttgaacccaagagtttgaggctacagtgtgctgtgatcttgccattgcaccccatcctgggcaatggagcgagaccctgtctcaaaaaaaaaaagaaagaaaaaaaaaacagaaaggaaataaaatgaaaggaatttatgttattctctctctctttttatttatttttaaatattatttatttatttatttattttttgagatggagtcttgctctgtcacccaggctggcatgcaatggcgcaatctcagctcactgcaacctctgcctcctgggttcaagcgattctcccgcctcagcctcctgagtagctgggaaaacagacatgcaccaccatgccaggcttattttttatattttagtagagatagggtttcaccatattgtccaggctggtcttgaactcctgagctcaggcagtccatccatctcggcctcccaaaatactaggatcacaggtatgaaccactgcacctggcctcttttcatttatttatctatttatttagaccagatctgagtgtatcatgcaggctggagtacagtggcatgatcatagctctttaacacctggcctcaagtgagccttttgcctcagcctcctaagtagctacgactacagtcctgcaccaccctggcaaactaattaatttttttcttttgtttgtggaattggcggtcttactatgtacccaagctggtctcaaactcctgggctcaagcagtcttctcatccccgcctcccaaagggccgatattacaggcatgagtcaccatgcccagcctatgtgattctcttgactgtactataaattccttgactataagatcagggactataatagtttgttcaccattccattcacagagcctgacacacagtaggtgctcagtaactgttgggttaattggttgcaactctatggttgttattattgttgctttaaagatttgggttgtgaaaggtgtgtctgggtgcggtggctcacgcctgtaatccctttgggaggctgaggtgggaggatcacctgaggtcaggagttcaagaccagcctggccaacatggtgaaaccccgtttctactacaagtacaaaaattagctggacatggtggtgtatgcctgtagtcccagctatttaggcagctgaggcaggagaatcgcttgagcccggggaggcaaggttccagtgaactccagcttgggtgacagagcaagacttcatcgcaaaataaataaataaataaataaataaaataaaataaagaaaggtgaaaatgatagccaagggggccgggtgtggtaattcacacctgtaatcccagcgctttgagaggcctaggcaggtggatcacctgaggtcaggagttcgagaccagcctggccaacatggtgaaaccctgtctctactaaaaatacaaaaattagctgggcgtggtagctggcatctctaacttcagttactcaggaggctgagaggagaatcgctttaacccgggaggtggaggttgcagtgagccgggatcatgccattgcactccagcctgggcaacaagagcgaaactccatctcaaaaaaaccaaaacaaaacaaacaaaaaaaatttataataggccaggcgcggtggctcacgcctgtaatcccagcactttgggaggctgaggcgggaggatcacaaggtcaggagatcgagaccatcctggctaacatggtgaaaccccgtcattactaaaaatacaaaaaattagcggggcgtggtggtgggcgcctgtagtcccagctactcgggaggctgaggcaggagaatggcgtgaacccgggaggcggagcttgcagtgagccaagatcgcgccactgcactccagcctgggtgacagagcaagactccgtctcaaaaaaaaaaaaaaaatttatagccaaaatgaactaattaattacatagacatttaattcagttattccataactactggatattgagagttacatttaagtattttaaacctcttagctccaaaagattcgggcttttaaattagatatttcctgtatacaaaaaaatgaatataatacacatgatatgaaaataataaattctcatgtatccattatccagtgttagtttattatcagtttccttgtgtgccctgccccaatcttcttcccttttcttctccccaggagtaaccattattctaaatgttgtttttatcattctcttgcttttttgtttcagttttcctatttatatcccccaaataattaatgaagctttttggttttgaattttatatgttatgtcatgccagatgtaatagcgttcactcagtattcatttttgagatccatgttgatgcatgcaatggtaattttttcatttaattgctttctaatattccattttatgactgtctctatctactgttctactaagggacattagttttttctacagtttttttataattcatactctgctagtatgaacctccttatatatatttcccagtgtacatgtagaagttttggttttggtttttgttttgagacagagtttcactcttgttgcccagtctggaatgcaatggcacgatctcggctcactgcaacctctgcctcccaggttcaaggaatcctcctgcctctgcctcccgagtagctgggattaccggtgtgtaccaccacgcccagctaattttttgtatttttagtagagattgggtttcaccatgttggccaggctgctcttgaactcctgacctcaggtgatccacctgccttggcctcccaaagtactgggattacaggcttgagccaccacactttcaactttttgtttgtacattttcaactttgcaaagatagtgtattttcaactttgttttgtgcattttcaactttgcaaagatagtgtatttatactttcattgacatgtatgaaagttgaatacaatgtaatgtttcgcagcctatttaacatttgctattgtctgactttttaattttctttttctgtttttgtttttttttttttttttttgagacagagtctcactctgtcacctgggctagcgtacagtggtgtgatatcagctcactgcaacctctggatgcaagcaatcctcctgccttagcctccagagtagctgggactacaggtgcatatcaccactcctgactaatttttttttttttttttttttgagacacagtcttgctctgtcgcccaggctggagtgcagtggcatgatctcagctcactgtaagctccgcctcccagtttcatgccattctcctgcctcagcctcccaagtagctgggactacaggcgcccaccaccacacctagctatttttttgcatttttagtagagacgggttttcaccgtgttagccaggaccgtctcgatctgacctcgtgatctgcccgcctcggcctcccaaagtgctgggattacaggcgtgagccactgcgcgtggcctccgactaattttttaaaatattttttggtagagatgaagttttaccatgttggccaggctggtctcgaattcctgacctcaagtgatctgcccaccttgacctcccaaagtgctgggattacaggtatgagccattacacctggcctattttcttttttttttttgaggtggtctcactctgtcatccatgctggaatgtagtgcatctcagctcactgtgacctccacctcctcccaagctcaagtgatcctcctgcctcggccttccgaggagctgggactacaggcatgcactaccatgccctgctaatttttatattttttgtaaagacagggtctcactttgttgctgaggccagtcttgaactcctgggctcaagcaatccacccacctcagccccgagaagtgttcctcccaaagtgtggggattgtacatgtgagccactgtgtcccgcctgacttttttattttcccagtatgatgattgtgaatggtatctggttttcatcattttaattagcatttccctgatttgtaatgaggttcaaaaatcttttcatgggttcactagccttttgtgtttcgttttctgtgaaatgcctgttcatgccttttgctcatttttttaatgaagctgtaggcattctttatatattctagatattaatatagattattaatccctattaatctattgtcagttttccatgttgcacacatcttttcccatttgtggtttaccttttcactttttttttttttgtaacagtgcaaggatgatgctgaaaggaataacaaggcttatctctaggatccataaggtgagtcctgactgacctgaacactctgtgcatactgcctttaggttcccagattcttgttttcagatggattcattgtatctagagtgaaatgctctggaaaacttcatatgtaacaggtttcagtagaataattgtgcttgagaatttaccatggaataggagaattaatatttttccagaaaacataagtaagtttgactgtaattatctttattaactttatttctctagccaactagagaatggttatcatcccttaatgaagtatttaaaagaaaaacaagttgccaatttacagctttagcatctaaaatagaataaaaaataaaattgtacatgaaaaagaccattctgctggtttacttcattttttcacatatttaccaaatagtttttcagtacttttttttttttttttttgagacagagtctcgctctgttgcccaggctggagtgtgcagtggcgcaatctcggctcactgcaacctctgcctcctgggttcaagctattcttctgcctcagcctcccgaatagctgggactacaggcgcttgccaccatgcccggctaatttttgtatttttagtagaaacggtgtttcatcatattagctaggctggtctcgaactcctgacttcgtgatctgcccacctaggcctcccaaagtgctgggattacaggcgtgagccactgtgcccggccttcagtaccttctatatggcaggtactcagaattctaagatgcctcatttcactaataatagttattatttgttgggtattattatgtgccaggtactacactaagtgatttatttttttaatcctcatgatcaacccatgaacgagataatatccttgtttcacagatggagaaactaaagatgagactggctaggtaacttacctgaggaaatagcctgtgaggttgcaaagcccacacgagatgccaggtctgtctgacttcaaagcctgtggcctaaccactgtgctctattgcattttatggtccatgttctccagaagcttacagtccagtagaatcatgaaaaaatgactatttcagtatggtgctcttacagcaccaaagaggagcacctgagcgggattagtcgagtcagcaggagatcctgaaaggctcagaactgagccagaaagacttggtcattttcagctgattatttaattacagattagatttcctagaaaaggagcccttcctcctatatggctccccctgcatgtgcccccttccctcaggcctatatattaatacataaaataacccattattataaaatgaaacgaaagcaaggatcagcagagggatggattctggactcaactgatcatattacaaggctaaaataaatttcctctctcggccgggcacagtagctcatgcctgtaatcccagcactttgggaggccgaggcaggcagatcacctgaggtcagcagtttgagaccagcctggccaacatagtgaaaccccgtctctactaaaaatacaaaaattagctgcgtgtggtggcacacgcctgtaatcccagctacttgggaggctgaggtaagagaatcgcttgaacccaagaggtagaggttgcagtgagccaagatcacgccactgcactctagcctgggcaatagagcgagactccatctcaaaagaaaaaaaaaaatttcctctttcttaataacagacaacaaagacctgaggctagactgtagagtgctgttggtgagagaaagttttgtttttttttttttactagtttggttcagggtgactgtattagtcagggttctctacagggacagcactaataggatagaagtatatatgaaggagagtttgttaaggagtattgagtcacaccatctggcgaagtcccacagtaggccgtgagcaagctgaggagcaagtaagccagtccaagtcccaaaacttcaaaagtagggaagctgacagtgcagtcttcagtctgtggctaaaggcctgagagcccctggcaaatcactgttgtaagtccaagggtccaaaagctgaagaacttggagtccagtgttcgagggcgggaagcatctagctcaggagaaagatgaaggctggaagacccagcaagtcggctcatcctaccttcttctgcctgctttattctagctgccctggcaggtgattagatggtgtccacccacactgagggtgggtctgcgtctcccagtccactgactcaaatgttaatctcctttggcaacaccctcacagacacacccaggaacaatactttacagcctttaatccaatcaagttgacgcttaatattaaccatcacggtgatcttctagattggctcacaaatgctctttcagaaactgcaggatgttcattctggaactgtacagaggcaattgtacagatggttgttttctctggaaacaacagtctacttgagtgataacatatataaaactttaagaactaaagattccattttgctgtaggccaggcatggtggcttacacctgtaatcccagcactttgggaggccaaggcaggcagatcacctgaggtcgggagttcgagaccagccagaccaacatggagaaactccgtcactactaaaaatacaaaattagccaggcgcggtggcgcatgcctgtaatcccagctactcgggaggctgaggcagcagaatcgcttgaacctgggagacagaggttgcagtgagccaagatcacaccattgcactccagcctgggcaacaagagtgaaactccgtctcaaaaaaaaaaaaaaaaaaaaaaagattccattttgctagcttttaatttgcttcaaaaagtacctgtagtttcagctacttgggaggctgaggcaggaggatcatgtgggcccaggaatttgagactgtccggggcaatatagcaagaccctaccctatgtcaaaaaaaaaagtgtaacaaaaatgtcatcacattactgtagaaataggaccaccttgtgacccttgaatagtttgttttccactctgctttctctccagctaaagaggcatggtgctttctctccggtagataaaattgagtagcgtttaagtagtactagggtgtgttattcagattgctaccctgaagtaacaagccttgtattctcagtggcctaacacaaaggatattgtttgtgttgtgtgtatgtgttttgctttgtttttgctgttcctgtctttcaaaaaggctttgcaagcaagactgaagtctggatggagggacaaaagtttaccttcttgggatacatcgcaacatatagcttttaaggtggggagggagagataatttatacctcacacttaattggctctgattagaaaggacacaatgacacaagttattttcattcataggtctttagccaaaggaatcacatgacccctcctgtttctgcaagggaggctgagaagtgtagagaacgatttggatatttggatatttcccaagcattgctgcttcagctgtaatttacagtcatacattctcagacaaagctggagcaactctagtacttgacagttactttatattaaaatctacaagtaatggttcagaagtttctgtgtatacttcactaagtttcctatagagcatttactttccttcgtggatgctttacgtactctctcattgcatgttttcagtttcagattctttattccagggcaaactaaatacctgtagtgtgttaagtactcagagagggagatatgaaaatgaataaaatctgaccccttttcttccgagcgtgtagcctaggagacaagcatgtgtaagataacatgatacagtttttttaaaatagagacaaacttggatgtcaattctagttcaccacctaaaactctgtgaccttaatcaaaattactcagcttccctgaaccttatcttccccatcataacacagggttgataatattctgcctatcttctaggatttctaggtttaaaactagtacatgtacaatactgtattgcctaacatctaatagatactcagttaacagtaggcatgagtacaactcaaggcagtgtaataaaattgctgtgcaatacaaagagtgctattagcagaaaggaaagagaattacttttgactggaggtgtctggcaaattttcactgaggatgtgacattcgagttgaggcttgatgaatgggaaagatttaaatggggagagagggaagttgaagtagaatgagcagaagtatagaggcataaaagtgacatgtttcagcatggtcatatggttataaatgaaattacaaaggtaggctgaagtcatcacagtggtctagattgttatgctaaggaatttgagacttattttgacatcgttctggaaccttctaagctttttaaaatttttttattgtcggggtctcactgtgcttccctggctgatgtggaactcctgccctcaagcagtccttccactttagttcccaactagctgggactacaggagtggaccaccacacctggctccatccaagcttttagattagtcgaaggttaaacctattttcgggaaggttaaggactatgaacgatgaaaaaatcaaagatttagagataaagatacaagttaaaatgttatgtgttggctgggcatagtggctcacacccataatcccagcactttgggaggctaaggcgggcagatcacctgaggtcaggagttccagaccagcatgaccaacatggtgaaacccagtctccactaaaaatacaaaaattagtcaggcgtgatggcgggcgcctgtaatcccagctactgaggcaggagaaccacttgaacctgggggcagaggttgtagtgagctgagatcatgccattgcatcccagcctgggcgacaagagtgagactccgtctcaaaaaaaaagaaaaacaaaagtgatgggtacaatactgtctctcaacctgtgtagtgggaatgttagacacataatttaggatcatgtcataaaatgggtgtaagtgtgaggagggatggtacagagataacatatattttctgcactcaaaaagctgcttggtaggctgggcacggtggctcacgcctgtaatcccagcactttgggagcctggggtgggaggaccacctgaggtcaggagtttgagaccagcctggccaacatggcaaaatcctgtctctactaaaaatagaaaaattagctgggcatggtggcacactcctataatcccagctgctcaggaggctgtgtcaggagaatcacttgaacccaggaggcggaggttgcagagagccaagattgtgccactgcaccccagcctgggcaacagagcaagactccatctcaaaaaaaaaaaaaaaacccacaaaaagctgcttggtgagccaggtacagtggctcacacctatcatcccagcactttgggaggctgaggcaggaggatcgcgtgagtgcagcaagttggagagcagcctgggcaacatagcaagaccctgtctacaaaaaattaaaaaaattagctgggcatagtggcatgcacctgtagtcccagctacttgggagcctgagatgggagcatggcttgggcctgggagtttgagactacagtgtgccgtgatcgtgccactgcactccagcctgggtgacagagcaagaccctgtcttaaaaaaaagagagagagagagagagagaagctgcttggtgagactataaaatactggtagctttcatatgataacctatttattaagcaactcccttattacactatccattatatttctgttctcttgcttctcctggctgcattccctaatcttttcctcataacacatcttttcactttctacataaggtttgttatccttaagctcagttttggggtttttcacttaccattttgttagatttgtctaccgaaatccgcccccttcccctccctgttggttcagaggtttcggtgtacagttcactgagttacctatagagcagtttgctttcacttagctgtgtatttgacatactcccttattacatgtctctaatgaaagatcctttattccagggcacaattagcaggaaaattgttacagggcatgtaattatagctgtcacatagtgaggagcattgcactgatcccctgataactgaggtgactgacagagaatgagaattacacagttttgacaaccattcatcgctgtgcaagcgcattaaaagagctttcctgcttcaagtttgctaatggctatgctatgtatgctcctgaataatctctgacagaattgtttgtttccgtataggacagacccctgataaggcaatacacagactggaacagatacagaatatgaataatgtcattggacttagtgaattttaaataataacagggatcctttttacatagaagaaaaatgttgccgggcgcggtggctcacgcctgtaatcccagcactttgggaggcagaggcgggcggatcatgaggtcatgagatcgagaccatcctggctaacacagtgaaacccctactaaaaatacacctctactaaaaatacaaaaaattagccaggcgtggtggcgggtgcctgtagtcccagctactcgggaggctgaggcaggagaatggcgtaaacccaggaggcggagcttgcagtgagccgagatcgcgccactgcactccagcctgggcgacagagtgagactccatctcaaaaaaaaaaagaaaaatgtatgttagtgacatccctattgcagacatggctcaccttctcagtgttttggcaagcataaaaagtttgattagccaggtgtggtggctcaagcctgtaatcccagcattttgggaggcagaggcgggcagatcacctgagttcaggagttcaagaccagcctggcccatatggtgaaatcttgtttctactaaaaatataaaaaatcagccgggtgtggtggcgcacgcctgtaatcccagttactcaggaagctgaggcaggagaatcacttgaacctggaaggcggaggttgtagtgagcctgagatcacgccattgcactccagcttgggcaacaagagagaaactccatctcaaaaaaaaaaaaaaaaagtttgataaccccgtaacactgaaatggtttctcttatagttggaccctgggcgttttttacacatggggacccaggctcgccaaagcattgctgctcacctagataaccaggttccagttgagagtccgagagctatttcccgcaccaatgagaatgacccggtgagttactaatatgtatatggggtttctcagggcttatgatttgtgttcctgtcctcattttgcataggaaaactgaaactgaaagaagcttagtagatttgcatttactcagatagtgcacctgagatagcactctggaacccagattctccctgtccctgtctgatactgtggtaacatacactggccagctcggtctgtatcagttcccatgtaatctctactagtgaattcacctagttccacggattttgctgagcatagagttgtcgaatactcaatacttactaagtttaatttcttactgggcaagtttaccaattattattgcttatattatgtgttgggtgacaggctttttcttaaaggaccatgtagtgaatatttcaggccgatggactgagatgatctgtcacaagtactcaactctgccataaacaaatgggtgtgaacatgttccagtaaaactctatttacaaaacaggtgcccagccataacttaacaaactctggtatggagagtactaaagaaattaaactacttgcccacaattttctaccagggcaggttcagaacccaatttttctaataaccaatctggtgctattttgcagttttgtaagtggatttcctagggtctggagagggaactaacttggtttgttgtgagaagagcagcatttaaagtgaattttgtctgcagaagccaggattccagcagtatctagtgttgcattttctagtccagttccccattagactggatattgatttctttttgttgctgcctctcataaatgaaattaatttgtggtgtgtgctgtaatgttaggaaccaatagctttctttccctgcccctaccctctgagtcttcccatcttaatatagtctgtgtggaaagaaaaagtaaacacccattacccaaaacatgatctcagcagggtgtgttttaaatatatctctaggcttcggccatgcggggtggctcacgactgtcatcctagcattttgggaggccgaggcaggaggatcacttgaggtcaggagttctagaccagcctagccaacatggcgaaagcctgtctctactaaaaatactaaaattagctgggtgtggtggcgggcacctgtaatcccagctactcaggaggctgaggcaggagaattgcttgaacccaggaggcagaagttgcagtgagccaagatcgcgccactgcactccaggctgggcaagagagcaagactctgtcttaaaaagtatatatatatggctgagtgaggtggctcacgcctgtaatcccagcattttgggaagccaaggcaggcggatcatgaggtcaggagactgagaccatcctggctaacacagtgagaccccatctctactaaaaatacaaaaaaaaattagttgagcatggtggcgggcgcctgtagtcctagctactcgggagactgaggcaggagaatggtatgaacctggaggtggagcttgcagtgagctgagatcgtgctactgcactccagcctgggcgacagtgcaagactctgtctcaaaaaaaaaaaaagaaagaaagatagatagatagatagatagatagatagatagatagatagatatagatatagatgaagatatatatatataccattcacctcttttcacaaacacaaaatgaagtagaataaatgaatcaagccactgaagtgtcttttcagctttctttgtaattgcagtccttttatctgccaattcctctggggtttctatggaaacagcagcatgcagatgatcttgtcacatgactggagcatctctatacacagcacagaagaatccagatggcaagaattgtctttgctacccctacatctacggtttactttgatgagcaattggcttcattatttgggccaccacttttatatacatactgggtttgagggcagcaaccagcattcttggctaagataaatgaggctgggcacagtagcttatgcctgtaatcccaggactttgggaggcctaggtgggaggatcacttgagcttaggagttctagactagcctaggcaacatagcaagaccctaactctaaaacaatttttttttttttttttttgagacagagtttcactcttcttgcccaggctggagtgcaatggcgcagtctcgtctcactgcaacctccacctcctgggtttaaatgattttcctgtctcagcctcccaagtagctgtgattacaggcatccaccaccatgcctggctaagttttgtatttttagtacagatggggttttaccatgttggccaggctggtcttgaattcctgacctcaggcaatccgctcaccttggcctcctaaagtgctgggattacaggcatgagccactgtgcccagccaaaaaaattttctttttctttttcttttttttagacggagccttgctctgtcacccaggctggagtgcagtggcgtgatcttggctccctgcatcctccacctcccgggttcaagcagttctctgcctcagcctcccgaatagctgggattacaggcgcctgccaccgtgcctggctaattttttgtattttttgtagagacaggctttcaccctcttggccaggctggtcttgaactcctgacctcataatccacccaccttggcctcccatagtgctgggatgacaggcatgagccactgcactcggccaaaagtttttcaattagcagtgcatagtggcatgcgcctgtagtcccagctactcgagaggtttaggtacaaggatcacttgagcccaggaggtcaaggctatagtcagctgagatcaggccactgcactccagtctgggcaacaggctttctcaaaacaatgggagatatcttttccagctttaagagatgagtggtccaggtgcagtggctcacgcctgtaatcccaacactgagaggccaaagtgggaggatcacttgagctcaggagttcaagaccaacctgggcaacatagcaagacctcatctctaccaaaaaagtaaaaaaatgagccaggtgtagtggtgcacacctgtggtcccagctacttgtgaggctgaggcgggaggatctcttgagcctgggaattggaggcctcagtgagccgtgattgtaccactgcattccagcctggtaaaccgagcaagatcttgtctcaaaaaaaaaaaaaaaaaaaaaaaaaaaagacataaaggccgggtgcagtggctcacgcctgtaatcccagcactttgggaagctgaggcaggtggatcacttgaggtcgggagttcaagaccagcctgtctctactaaacatggagaaaccctgtctctactaaaaatacaaaattagccaggcatggtggcacatgcctgtgatcctagctacttgggagggtgaggcaggagaattggttgaacccgggaggcggaggttgtggtgagccaagatcgcgccattacacttcggcctgggcaacaagagtgaaactccatctcaaaaaaaaaacaaaacaaacaaaccaaaaaaaacacataaagacatgagtgaatagcaggccttatccaattttcaaagtcttggtcacagataaaaagacaaggctgggctaggcgctgtggctcacgcctgtaatcccagcactttgggaggtcgaggtgagcggatcacgaggtcaagagatcaagaccatcctggtcaacatggtgaaatcccatctctactaaaaatacaaaaattagctgggcgtggtggcgcgtgcctgtagtcccagatgctcgggaggctgaggcaggagaatctcttgaacctgggaggcgggggttgcagtgagccgagattacaccattgcactccagcctgggtgacagagcgagactctgtctcaaaaaaaaaagaagacaaggctgggcaagatggctcaccctgtaatcgcagcattttgggaggctgaggcaggcagatcacctgaggtcaggagtttaagaccagcctggccaacatggtgaaaccccgtctctactagaaatacaaaaattagccgggtgcggtggcagattgtaatgccagctactgggaggctgaggtaggagaattgcttgtacccaggaggcggaggttgcagtgagctaagatcgcaccattgcactcctgcctgggtgacaaaagtaaaactccattttaaaaataatatatatatatgtatgtgtatatatatatgtatgtatgtgtatatatatatgtatgtatgtatatatatatatatatacacatagacatacatatatacacacacatagataagacaaaaaagaaagtcttggtcactttgtcaccattatacctgtttgcactcttatttcctaggccaagcatggggatcagcacgagggtcagcactacaacatctccccccaggatttggagactgtatttccccatggccttcctcctcgctttgtgatgcaggtgctcaagacagggaatggaattggagggagcccagaatacaagctgctgctagcaaaggggtggggctaaatgagaagaaaatttaaaaagatgaaatttaatctgaaaaacagaaattcatgtgttgattaccttttgtgactagtacaattactttaagctcatgtttaaacaatattgatgttttcctccttgtatagcccaagaagattccagtaatttcagcatcaaataactgttttaaatgaacttaaaatttgccttggcaaaatatcatgaaaatagttaatatgctgcacaaaagcaaaatcatagtacactcctgagctaaatagaagcaatattttgattagatgcattggtttttattctcttgtggattttgtgaaaatgttatcaaacttgcctgtgcaggtgagttttagcatgcgagccagaggatctcatttctttagtgtggtttatttcgggaaattagatgaataataagggcataacaggccgggcgctatggctcacgcctgtaatcccagctgcactttgggaggccaaggtggaaggatcacttgggcccaggagttcgagaccagtctaggcaacatagggagacctgtctctacaaaaattaaaaattaaaaattagctgggcatgatgcacacctgtagtcacagctactcaggtggctgaggttggaggatcgcttgagctcaggaggtgagggcttcagtgagccatgattgcaccactgtaccccagcctgggcaacagagcaagaccttatctcaagcataaaataaaataaggtataacaggccaggcaaggtagtttatgcctgtagtctcagcactttgggaggtgaaggtgggaggattgtttgagcgcaggagttcaagaccagctgggcaatataatgagactgtatctttatttagaaaagaaaaacatgggcaaccctctcgggtccccttccacactgtggaagctttgttcttttgctcttctcaataaatcttgctgctgctcactcaaaaaaaaagaaaaacatttagtcatgtgtggtagctgcttcggaggctgaggcaggaggatggcttgagcccaggagttcaggctgcagtgagctacgatagtgccacggcactccaactcagacaacagagtgagaccctgtctccaaaaaacaattttaattaaaaaaaattttgttgaagaaatcatctgcagtggcactttaaactgttccaagacatacacagtacaatgtttattcagcttcagagctgtgaggttctatctttaattaactatttgaagttgttttcagactggcttaaccaacaatgctctgtaagaacttacaggttcttttcataattttcatttacatgaaggcctacttcctcaccattgtttgtggatattagcattgtcatactgcctaatatgacttttttttttttaaatactgctccttttggagcagacctaactcacggacagtgtgcccagggtagctgactttattttattactattattttaattatagagacagggtctcactctgacaaccaggctggagtacagtggcgtgaccacagcccacagcacactctacatctctgacctcctgggctcaagcgatcctcctgtattggcatctcaaagtgctgggattacaggtgtgagccacagctcccagccctgatgtgacttttttttgaaatggagtttcacttttgtcgcccaggctggaatgcagtgatgcgatctcagctcactgcaacctacgcctcctgggttcaagtgattctcctgcctcagcctcccaaagagctgggattacaggtgctcgccaccacgcctggctaatttttatatttttagtagacatggggatttgccatattggccaggctggtctccaactcctaacctcaggtgatccacctgtcttggcctcccaaagtgctgggattacagggatgagccaccacgcccagccaacatttgttttaatacctttatcatgtttttttgaacattgagccttccattaagtttggaattgcctgtcaaatcctacaccaattcaattgttttgttaggatttcttttaaaaatatcaacactggctgggtacaatggctcacgcctgtaattccagcactttgggaagctgaggtgggcagattacttaaggccaggagttcaagatgagcctggccaacatggtgaaactccatctctactaaaaatacaaaaattagctgggcgtggtggcacacgcctgtagtcacagctacttgtgaggctgaagcaggagaatcgcttgaacccgggaggcggaggttgcagtgagctgagatcgtgtcactgcactccagcctgtgcgacagagcgagactctgtctcaaaaaaaaaaaaaaaaaattaacactattttagttatacttacaaacagtatttgttagatattcttattagtagacatattttaatattttctttgcaaatcagtttcacacacattagtacttcccaaatttcccaccaaagtattctggtagcaaaaggggaattaaactctgaaaggttagtatgctggaggtatgaggtatggatggccttagagttgtgaggcagctggtcacacctgctcctgagccgccatgtatttagttctagagaaaaaagtctaaatggttaaagtaataaaaataaattttaggccaggtgcggtggctcacgcctataatcccagcaccttgggaggctgagacgggtggatcatgaggtcaggagttcgagaccagcctgaccaacatggtgaaagcctgtctctactaaaattacaaaaatcagcctggcatggtggtggcacctgtaatcccagctactgaggagactgaggcagaagaattgcttgaaccccggaggcggaggttgcagtgagccgagatcacaccactgcactctagcctgggtgacagagtgagactctgtctcaaaaaaagaaaaaaaaaaaaaatcaactaaaaataaattttaggccaggtgcagtggctcacgcctgtaatccctgcactttgggaggccaagacgggggtgtcacctgaggtcgggagtttgagaccagcctgaccaacatggagaaactccttctgtactaaaaatacaaaatagccgggcatggtggtgggtgcctgtaatcccagctactcgggaggctgaggcaggagaatcacttgaactgggaggcagaggttgtggtgagccgagatcgtgccattgcactccagcctgggcaacaagagtgaaactccgtctcaaaaaaaaaaaaagaaaaaaaatttaaagagttaatgtttattgaattattaacttgtgtcagaaattttaagcatttttctatatgctttccatatttacagtggccctaagtggtatacataattttgttatgagatatatcaattatttatagatttcagctgagatagaatatatgcttcagtaataggaataatcaaaagctgactatcatgttacttagtgcggaataatgtatttcagtttttagctaagttatatggatagattttcaaactcagtaccaacccagcttctcctaactgagtaaattagaggcatgcaatctgatggtcttggttgccactttaggcagagtatatataccaccccccacccactccttccacacccacccactctttccttctttcctactttatcaggtgaagacattcagtgaagcttgcctgatggtaaggaaaccagccctagaacttctgcattacctgaaaaacaccagttttgcttatccagctatacgatatcttctgtgtatcctttcctgcctgcgtggaccctcatgaaccaatgctttctcccctcaaataaggcaacagaagaaatgaaaaaaagtactgttgaggccgggcatggtagctcacacctataatcccaggagtttgggaagccgaggcaggcgtatcgcctgaagtcaggagttcaagacctgcctggccaacatggcgaaaccccgcatttactaaaaatgcaatatattagccgggtgtggtagcgtgcacctgtaatcccagctacttgggaagctgaggcaggagaatcgcttgaacccgggaagcggaggttgctgtgagctgatatcaagccactgcactccaaccccatctcaaaaaaacaaaacaaagcataactactgttcacatacaagtgatccttccagtcatgttttctttaacaacatatactttagatggagagaagggaacaggaaaaaccctaagtctttgccatgttattcatttctgtgcaaaacaggactggctgatactacatattccagatggtaagaacttcctgttgtttcttctgtctgttaggtttagttatcctgttactgtggtagccttgcagctttaattttcttttcttttcttttctttttttttttttttttgagatggagtttcgctcttgtcggccagtctggagtgcagaggcgcaatctcaggtcaccgcaacctccgcctcccaggctcaagagattctcctgcctcagcctcccaagtagctgggattacaggcgcccaccacaccaccacgcccagctaatttttttttttttttttttttgagacggagtcttgctctgtcgcccaggctggagtgcagtggcacgatctcagctcactgcaagctccgcctcccgggttcacaccattcttctgcctcagcctcctgagtagctgggactacaggcgcccgccaccatgcccggctaattttttttgtatttttagtagagacagggtttcaccatgttggccaggctggtctcgaactcctgacttcaggtgatccacctgccttggcctcccaaagtgctgggattacaggcatgagccattgcacccggcctcagctttactttcctaacagggatctgatagctaaaggaaaagcctttgccagtcacgatggctcaaacctataatcccagcactttgggaggctgaggctggaatattgcttagagcccaggaggaggctgcagtgagctgtgatcgcaccactacactctagcgtgggcaacaaagcaagaccctgtctcaaaaaaaaaaaaaaaaaagaagaagaagaaaagcctttactccagatgtagagcagactgagctcatccatcatgatttcttcgtgatattactgccaagcagattataaggtgaagtcaatgtgacaaaaggaaattcggctaaaagcttcctgaagccttttgatgctaagcagtccttcttttgatatttaatacccatggacataaacttctgccttagaggtcgccatggagttttgttttgttttgttttgttttgtttttgccatctgttaacagtcctgagtacccatagagccttttactatttatcagcattctagagtcgtcagtatggattgtcaaaacttgcatttgtctcttttttgttcagtgttgtgtgcatccacattttctttcttttttaaacaaccctgcttatgtaacatccacattttctgacttacctttcaaacctgccagaaagcagaagtgatatttaatacacttggtatgttttatatattgattctaatgataatgtttagtctaagatggacctgacaaggccaggcatagtggttcaacagcactttgagaggctgaggcaggatgattgcctgagcctaggagttcaaggttacagtgaactgtgatcacatcctgccttctagcctgggtgacagagcaagaccctgtctcaaaaaaaaaaaaaaaaaagaaaagaaatatatatatgagaaactaaagtcatttcccataacttaaaagaggcatagaatatttcgagttgaatacagtttctgcctggcttgttttcttctgcctcttttttttaaagctcatctttgggtgaaaaattgtcgggatcttctgcagtccagctacaacaaacagcgctttgatcaacctttagaggcttcaacctggctgaagaatttcaaaactacaaatgagcgcttcctgaaccaggtgactagactcccagaagttgagtgctaggtagtccttacatggattctttgtgccctgagtaccaatagactatggagaactgatactggagttggaataactgtatcatttttaatttctttcatacgttttgctcacagtggactcataacttgaaactcatttatccatgtgaaataaataggcaacagtaagttgttcccattttgtgggtagcaaagtgaaatccagttgattcattgacttttcaaggtacagcctccaatccctcgcaagcacatttccaactacatgattttctccagacaatatctttttagggaaccagaaatgtattggaaaaattcttctttaccctggtgattcttagataccctgtctagaccaggggccttcaactctggatataaagcagagtcacctaagagcttgttaaaaatgcagatgccagagtctcattctggacattttcatcagaatcccttatgtatgtttattcaaggctccaagcagaaatggattagaaagcattcactttggtcaggcacaggggctcacacctgtaatgtcagcactttgggaggccaaggcaggcagatcacctgaggtcaggagttcaagatgagcctggccaacatggtgaaatcccatctctactaaaaatacaaatattagccgggtgtggtggtgcacgcctgtaggcccatctattcaggaggctgaggcaggggaatctcttgaacctgggaatcagaggtttcagtgagccgagatagcgccattgtactccagcctgggtaacagagcgagatatggtctcaaaaaaaagataaaagaggtcaggcgtgtggctcagacatgtaattccagcattttgggaggccgaggtgggcagatcacctgaggtcaggaattctagaccagcctggccaacatggcgaaaccccatctctactaaaaatacaaaaattagccaggcgtggtgacacacgcctgaaatcccagctacttgggaggctgaggcaagagaatcccttaaacctgggaggtggatgttgcagcgagctgagatcatgccactgcacttcagcctgggttacagagaaagaagctgtctcaaaaaaaaaaaaaaagaaagaaaagaaagcattcacttctacattgaggtctcttacagaacctgaacaatagattaaaatgaactcctgttaaccttagcctccaaccttttcaagggatggtttcacccttaggccaagtagccttttttttggtttttattttctttgcttgcttttagataaaagttcaagagaagtatgtctggaataagagagaaagcactgagaaagggagtcctctgggagaagtggttgaacaggtataagaaaaaacactgaatgtgtaacatgcgataacaagagaaggcctctggtagcactacaatccactgtctctcccaatagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccggtaggaaaactgggtgtctctatcttgtttctctgatttctgattccatcagtatggaggctgggtcttagccttgtagaccatgcaatatgttttcttgccctaggaatatttgaagataaacagtaaagagctgggtgcagtggctcacgcctgtaatcccattggctcacgaggctgaggtgggaggatcgcttgaggccaggagttcaagactaggatgggcactatagcaaggcccctgcctctaaaaaaataagaaattagccggtagctggcatggtggcacacacctgtagtcactgctactggaaggctgaggccagaggatcacttgagccctggagttcaaggttgtagtgtggcatgattgcaacactgcacaccaacctgggtgacagagtgaaatcctgtctcttaaaaaatatatatatggctgggcacagtggctcatgcctgtaatcccagcacttggggaggctgaggcgggcggatcacctgagcttggagttcgagaccagcctgaccaacatggagaaacccatctctactaaaaatacaaaattagccgggcatggtggtgcatgactgtaatcccagttactcgggaggctgaggcaggagaatcgcttgaacccaggaggcggaggttgcagtgagccgagatcgccatatatatatattcatatatatgtatatatacacacatatatattcatatatgtatatatacacacatatattcatatatatttatatatacatatattcatatgttttcataatatacgaatatacctatatgttcatatatgtatatataatattcatatatgtatatatgtatatataatattcatatatgtatatatgtatatatacgtatatatgcacacatacatattcgtatatgcatatgcacacatacatattcgtatatatatgtgaagataaacagcaaggcctggtgtgatggctgataaatcccagcacttttaggaggccaagaggtgatttgcttgagtccaggagtttggagtttgaggtcagcctgggcagcacagtgaaaccctgtccctacaaaaaatataaaaaactagctgggcatggtggtttgcacctgtatgtagctccagctacttggaaggctaagatgggaggatggcttgagcccaagaggcagagcccgcaatgagtggagatcgtgccactgcattccaggctgggcaacagaatgagactctgtctcaaaaaaataaaaaaaaagaaaagataaacagtaaaatggaatcagaggaggaggtaatgccaagagttccactattcattgaaaactaagggagtatgttgtggaaagagaatgacagcagaagctatgttttctttcttaatttttatctgtcttttgattcttttttcaaaatgagtctagatggtctaagcagaggagatcagaagcatcaaaatggggctggtttggggcagtgggtgtttttctcagtgactgttaatctccagaagcatggcagttctagggccagaggctacgtggcttatcctagagggagtaccttcaggtatacaattatgtcttagttgagggttttaaaaaaattgttgtcaccaggtgcagtggctcatgcttgtaatcccagcactttggtaggccgaggtgggtggatcacaaggtcaggagtttgagaccgtcctggctaacacggggaaaccctgtctctactaaaaatacaaaaaaattaggctctggtggcgcgcgcctatagtcccagctactcaggaggctgaggcaggagaatcgcttgaacccaggaggtggaggttgcagtgagcccaaatcgcgccactgcactccagcctgggcgacagagcgagactctgtcaaaaaaaaaaaaaaattgttgtcaattgtttcgggagaacatctaggaaaggcacgtgatgatctcttctctctttctgtccgatatgcagattgcccccgaggaattagcacttgttcacaacttgaggaaaatgatgaaaaatgattgggtaagtgcatatgatacctcacacatttcagaaagaaatgtattatcattttaaacatgttctactatttcattgctaatactttacagtctctaattttatggacagtaagttattatgtcttatttaattcctgtatctgtaccaagttagaaataaagtctgaattaaaatctatatatatgtggtttataatctttccaaagtaagtttattcaaaaccattttatttaaatattggcctaattttattttgcttgcagacatttaaagtgtttttgtatctccttaccgtctttggaaaagagtttgagacccacaaatatgtcatggtaaatttaaaatcaggtagcagtttattgtcagagccaaatctggaataaccaatttagttgccatttaactgtgctagaccacacttttgtaacactgtatgcccaagaaagaaaaaaaaaatctacagatgattaatgcagttttccatcctttttaactttttccagttcagccttttctcttttctttcagcatggaggcgccattgtgtcggctttgagccagactgggtctctctttaagccccggaaagcctatctgccccaggagttgctgggaaaggtcaagtcaaaggaaaatttgtttctacttagattgttatcctgtttaaagaaaaatatttttattaatctatgtattttgacataatttcagacttagagaaaaatcatattcctgtatgcccttcccctggattcctaaaatattaacttgatcatcattgctttatccgtctccgtctttctccagagtttcttttcttttttttttttttgagacggagtcttgctctgtcaaccaggcttgagtgcaatggcgcaatttcggctcactgcaacctccgccttccgggttcaagtgattctcctgtctcggcctcctaagtagctgggattacaggcgtccactaccacgcccagctaattttttgtatttttagtagagacgaggtttcaccatgttggccaggctggtttcaagctcctgacctcaagtgatccgcctacctcagcctcccaaagtgctaggattataggcgtgagccacggcgcctggccttgatgcttctttgtctccaaataatgtctcattcctaagaacaaagatactctaatataccctgagcataattatcaaagtcagaaaattgacattgatatcatacttttacctaattggtgggatttattctgatgtagccagttatcccagtatcttttatagaaaaataaatcccagataatgtgttacattaagttgtcatgtctctggctgggtgcggtggctcatgcctgtaatcccagcactttgggaggccgaggcaggcggatcatgaggtcaggagatcgagaccatcctggctaacatggtgaaaccccgtctctactaaaaatacaaaaaattagccaggcgtcgtggcgcgtggctgtaatcccagctactcaggaggccgaggtaggagaatcgcttgaacccgggaggtggaggttgcagtgagccgagattgcgccactgcactacagcgtgggtgacagagcgagactccgtctcaaaaaaaagaaaaagttgtcatgtctctttggtctcctttaatctgtgacagtctgtcagtctttgtcatttgaaatctttatgtttttggcatgtgcatgccagctattttgtaggtcactttttggggttgtctgaggtttcctcctgaatagaagtgatgttagaagtgatgacatgtctgagtgagtgcatcctatcaggaggcacatttctcccattactggtaatgattttggaactgttagctgaggtgttgtccatctggtttctcttcagtaaagttattattttgctttggaattaatatgtatgttgtagagatatactttgagactaggtaaagatcctgttacttctcaaacttccacctactggttttagtatccattactttagttatacctggcatggagcctccgcagctggtatggtcttgtggatttttatttaatagaatctaaatcattactgtcactttttattttggtgctcaaatcatcttagatttggccattaaaaattccttcattggccgggtgtgatggctcacgtctgtaatcccagcactttgggaggccaaggcgggtggatcacgaggtcaggagttcaagaccagcctggccaatatggtgaaatcctgtctctactaaaaatgtaaaaattagccaggtgtggtggtgcgtgcctatagtcccagttactctggaggctgaggcagaagaatcggttgaacccaggaggcggaggttgcagtgaaccaagattgtgccattacactccagcctgagccacaaagcaagactccgtctcaagaaaaacaaaaaacaaaaaaacaattccttcatggccaggcttggtagctcacagctgtaatcacagcactttgggaggccaaggcagaaggatcccttgagctcaggagtttgagaccagcctgggcaacaaagtgagaccccatctctacaaaaaaaaattttaaaactagctgggcatggtggcattcacctgtagtcacagctactctggagactgaggtgggaggatcgcttgagcccgggaggtcaaggctgtagtgggccctgattttgccagtgtactccagcctgggcaatagagtgcggccctatctcaacaggaaaaaaagctccttcaagctaacttctatatccttttaaaatgtccccatcattatttttttggagatagggtctcactctgtcacccaggctgtagtgcagtagcaccatcatagctcactgtagccttgagcacatgccaccacacccagcactgaatgttgtctttttcttttctttcctttttttttttagaggcatggtcttaactatgttgttgcctagggtggtcttgaactgctagcctcaggcaatcctcccacctcggcctcctaaagtgctgggattactggcgtgagccaccatatccagctcctatcattctttgaccacttctttattttctgtcatgagaatatgttccagacccctcttatacttcccatgcccagccctggaatctccatttctccaaagagcattggcttattttagaggagactggtatttagcaaccaaggcctgagtcctaggtatactcactgctactgaggtgtcctttctcctaggccctcacagcaaagttcataaatagatgtacatacatacatgtatgtatgtatatgtgtgaaccatatgcatatacatgtttatacacatccacacacatctgcgtttgtttctctaatcatattaaaaaactatgagttcctactagtagccaattccatgctaccatcacagcagtcattataccctttccatatctgtaactctaatctaaaataatgagaaatctgctgccagtagccatagtatatttacttattagctcaatactagaatatatgaaaagtagtttcagatttgatagctctcaggctgggcgtggtggctcatgcctataatcccagcactttgggaggccgaggcgggcagatcacgaggtcaggagatctagaccggcctggccaacatggtgaaaccccgtctctaccaaaaaatgaaaaaaaaaaaaaaagaaaaaaaaattagccgggcgtggtggggcgcctatagtcccagatactccgaaggctgaggtgggagaatcgcttgaccctgggaggcagaggttgcagtgagctaagatgtgccaatgcactccagcctgggagacagtgaaaaagaaagaaaaaaataagttccttgggccgggcgcagtggctcacgcctataatccctgcactttgggaggccagggcgggcggatcacctgaggtcaggagttcaagaccagcctggccaacatgatgaaatcctgtctctactaaaaatacaaaaaattagctgggcatggtggtgcaggcatgtaatgccagctactcgtgaggctgagacaggagaatcgcttgaacccaggaggcagaggttgcagtgagccgagatcgtgccattgcactctagcctgggcaacaggagcaaaactcagtctcaagaaaatgaaaaaaaaaaaagaaatacagtttgattacttcatttgtttccatttgttttccatctagcgtattttttcccattatttttattttttattttattttatttgagatgaagtcttgctctgtcacccacgctggagtgcagtggtgcaatctcagctcactgcaacctccacctcccaggttcaagtgattctcctgcctcagcctcccaagtagctgggattacaggcacgcatcaccacgcctggctaattttttttttttttttttttttgagatggagtcttgctctgtcaccaggctggagtgcagtggcttaatctcggctcactgcaacatccacctcccgagtttaagcaattcttctgcctcagtctcccgagtagctgggacgacaggtgcatgccaccacgcccagctaatttttgtaatttagtagagatggggtttcaccatattggccaggcaggtcttgaactcctgaccttgtgatctgcccgcctcagcctcccaaagtgctgggattacaggcatgagccaccgtgcccggctaatttttgtatttttagtagagacagtaattttgtatttttagtattttcaccatgttggccaggctgatctcgaactcctgacctcaggcgatctgccctccttggccacccaaagtgctgggattaccagcatgagccaccatattcctttgaaaatatgaaacattaactttgtttcaaaagccaaaactgtccaaaatacatacacacaatatgtgtgtgtgcgtgtgtatgtgtgtgtattcacacaagtagcatccgcctcctcaagcattgcctttttttttgtgtgtgtagacatggtcttactctgtcacccatactgtgacagtatgtgtagtggagcaatcgcagctcactgcaatctcaacctcctggtctcaagcaatcctcagcctcccgagtacctggggctagaggcacgcagcaccactcctggctaatttttgtattttctgtcgagacagggttttaccacatggcccaggctcgtctggaactcctgggctcaagcaatatgcccatctcagcctcccaaggtgctgggattacaggtgtgagtcactgtgcccagccacctctttttaatatatagcatttgtggccacgtagagcacgagtagccagccaccatatgtggagtccatatgtggagtcctgtatcaggcaatgttgccagagaatgagaagtagagttacatagaagaaaaacaaataccttaccttcaaagtgcttaagtagagtctgtctgtctggtgctttgttccttaactaacatgtttcctgatcctttttcttccccaggaaggatttgatgccctggatccctttattcccatcctggtttccaactataacccaaaggaatttgaaagttgtattcagtattatttggaaaacaattggcttcaacatgagaaaggtccatcatttagttttttcctatcagggctttgtgatcacagtagaatcccactcagtcagagccttgatctcttcttcccttaacaacagcctctaatttgtacttcatcctttatcttgacttctttctggctgataaatggtacagaaaagcgggtgggaggcagttaaggtttaatttacaaaagagattttatccctaaattttccatgataaagaagggaacaaaggcaactccatccactgggcagaatttccaggtaattgggttcctgccacattctccttattgaatttatttattcaatagacttcactggagagactcatgctgggacacccacagaaaaattcatactgtgcaagggctactccagcacctaagtaaatctttgccacacctgtcctagtatatgtacagaaattaactttcagcactatatttcatctactctgactgaaagcattccaactgttcatttacttgcccttgacctcacatttgagtatgaagaggggatatagaagaaaagctaaggctgctctatcactagataatagagttaatagtaatcggaggcctggtgcagtggctcacacctgtaatctacactttgggagggcaaggtgggaagaccacttgatgtcgggagtttgagaccaggctaggcaatatagtgagaccccatctctattgaaaaaagcaaaaaaaaaaaaatactatttagaatagcttattaaaggagtacagtgaagagtgtaagactaactgtagcatgttaagttgggatgcacaatagacagatttctaagagttgggagatgtcacaaaatcctgaagtccagaagacactcttggagtggagagagagctccatgctggtttggaggagtagacacagaaaaggaagtaatgcatacaaaagaagagtagcttgttggggtgagggtctagaagtaagatctcttgggagatgataattacctcagaacgtaatttggatatggtagcctctgactacacgatattctggggaacacagtgcagcaggaggaaactgccacttacctgtgtttgtctccattttagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttctaaagtgttgtgttagattaataatatggaaggagtctttagattggccaaattgcatttctctgatattcctcttgttgcaggtcagaagagatcaattctacagaaatttccagtggttctgttgaggctttatggaattcagcatgtcaaaattcacagctggctgggcacagtggctcatgcctgtaatcccagcactttggaagcccaaggcgggcagactgcttgagttcaggagtttgcaaccagcctgggcaacatggtgaaaacctgtctctactaaaaatacaaaaattagccgggcacggtggcatgcgcctgtaatccaagctacttgggaggctgaggcaggagaattgcttcaacttgggaggcggatgttgcagtgagccaaaattgcaccactgcactccagcctgggcagcagagcaagactccgtctcaaaataaataaataaataaataaataaataaataataaatgtatactgtactgttttacatgaccgacttcagcatctaaggatgttgctacctggaggaagtgggatcctggaacgaatcccacataggtatgaggaataacaataatggaaaatcaggtatcttccctttctcccagtgcttttctaaaaggaatttctgttaccaaatcctagagatgatacaattctacacaaatatatatatggccgggcgtggtggctcatgcatgtaatcccagcactttgggaggccgaggcgggcagatcacttgaggtcaggagtttaagaccagcctggccaacatggtgaaaccccgtctctactaaaaatacaaaaagtagccgggggtggtggcacatgcctctaatcccatctactcgggagggtgaggcaggagaattgcttgaacccaggaggtagaggttgcagtgagccgagatcatgccattgcactccagcctgggtgactgatagagactctgtctcaaaaaaaaatatatatatgtgtgtgtgtgtgtgtgtgtgtgtgtgtatatatgtatatacacacacgatatgcatatcatatgtatatattatgtctgttatacgtatatatatgttatgtttatattagtattactattaatatgttagatacatattaaaaatatgtttactttgacagtaatatataactatcaaagtagtatactaataggttgtatattatatattgtatatgacaatatatagtatattactcataatattgggtcctatatattatgtatatgtattatatatgttatatgtatttgtatatattttatatatatgttatatatatatttttaatttatatttatatatttttaagagacagtcttgccctgtctcccaggctggagtgcagtggcatgatcacagctcactgcagccccaactcctgggttcaatcagtccttttgcctgagcctccctagtaacttgggaccacaggtgtgtgctaccacacctggctaattttttagtgttcagtagagacagaatgtagcttggtttcccaggctaggcaatatggcaaaacctcagagtgagagagaccgaatctctaataaataacttgaacaaaataactgctaaatgtacactagaaaccatattcctttttctttttttttttgagacggagtcttggtctgtcacccaggctggagtgcagtggtgcgatctcggctcactgcaagctccgcctcctgggttcacaccattctcctgccgcagcctcccgagtagttgggactacaggcacccgccaccgtgcccggctaattttttgaaattttagtagagacagggtttcaccgtgttagccaggatggtctcgatctcctgaccttgtgatccacccacctcggcctcccaaagtgctgggattacaggtgtgagccaccgcgcccagcctagaaaccatattcctgatgataatttaaaagatcttactaaatggaaagattctccatgttcattgattggagtactcagtaataagatggcagttattcccatattgacctatagattcaatgcaatcattatcaaaatttcagaaggttttttgcaaaactggaaaactgaccaagcacggtggtccatgcctgtaatctcagcatgctgggaggctgaggtgggcagatcacttgagcctaggagtttgagaccagcctgggcaacatggagaagcctaggctctacaacaaatacaaaaattagccaggtatggtggcatgcgcctgtagttccagctacttgggaggctgaggcaggaggatcacttgaaccccagaggttgaggtttcagtgagccgtgatcatgccactgctcatcctcagctgcagagtaagaccctgtctcaaaaaacaaaaaggaaataaaaaagggaaactgacctaaagtttatgtttttattaatattattttgagacagggtctcactctctgttacccaggctggagtgtaaggccacactacagcctcgaccttctggactcaatcctcctacctcagctccacgagtggttaggactacaggcacacaccaccacacgtggctaattttgatttttttttttaataaagatgggatctcactatattgcccaggctggtctcaagcttctggactcaagtgatccacctgtctcagcctcccaaattgctgggcgtataggcttgaatgactttggccaggctataaccccatcgtctgtttctgggaagacctaatgcacccaaacgcaatgctacccttcaagagacaaatctaaaattgcaagtaaaaattcaaaagagggccgggtgtggtggtgcacgcctataatcccagcactttgggaggccgaggcgggtggatcacctgaagtcaggagtttgagaccagcctgagtaatacagtgaaaccccgtctctactaaatacaaaaacatcaaccgggcatagtggcgggcacctgtaatcccagctacttgggaggctgaggcaggagaattgcttgaacctgggaggcggaggctgcagtgagccgagatcgcgccactgcagtccagcccggtgacagtgtgagactctgtctcaaaaaaaaaaagtaaggatataaaagattgagtagcatgattaacacttgtcctaatggaagtatttttaaaaattgaatccccaaacaacttttttttggtagaagctcttttacattcacatactttatttttaatagcctaactacagttatccttttctttaacccaggaaggcagagagaaaagagagcaaattaagttgcctaaagctgaacttggacatcatcaaacttctagaaaggcagattatgaaataatgctttaataaacatattattaatttaataagcatctgttgttctaaaaagtagaaaatacatcaggtcattattgttgacccttaaacaataacgtttttggactgcatgggtccacttattcacatatatattttttttaaagggtcttgctctgttgcccaggcgggagtacagtggcatgatctcggctcactgtaacctctgcaaccttggttcaagctatcctcctgactcagcctccctagtagctgggcttacaggtgcacaccaccacgtccggctgttttgtatttatagcagagacggggtgtcaccatactggccaggctgttctcaaactcctgacctcaggtgatccgctcacttcggccttccaaagtgctgggattacaggtgtgagccaccgagcccggcctcacagatctttttcaatagaagttatacggagtggacctgcctttctggcctcaccttccacctatcaaatcccaaaacttctgaatgtactttcttttgaagcacataaagaacctgttcaaaattgactgacaatggaccataaaccagctcaatatatttcaaagaatttaaatcatacagccgtgtactctgattctaatgcaatttaaactagaaaccagtaacaaaaagagaaatagaaactcctcatgtgtctggaaattaaaacatacttttctgatgtgcccattggtcagggagaaagatcagaatggaaatgagaaagtaattcaaattaaatgattgtgaaattactaaacacaaaacttaaaaattttgtacgttgaaaatactggctggcagggcacagtgactcaggcctgtaattccagcactttgggatgccgaggcgggaggattgcttgagcccaggacttcaagaccagcctgggcaccatggtgaaacctcatctctaccaaaaatgcaaaaattgaccaggcgcagtggctcacgtctgtaatctcagcactttgggaggccaaagcgggcagatcacctgaggtcaggagttcaagaccagcctgaccaacatggcaaactcctgtctctgctaaaaaaatacaaaaattagttgggcgtggtggcaggcgcctgtaatcccagctactcgggaggctgaggcagggaaattgcttgaacccaggaggcagaggttacagtgagctgagatcacgccactgcactccagcctgggtgacagaatgagactcagtctcaaaaaaaaaaaaaaaaaaaaaaaaattagctggattcgtgatggcacatgcctgtagtcccagctacttgcgggagctgaggtgggaggatggcttgagcccaagaggttgaagttgcagtgagctgtttgtaccactgcactccagcttgagtaacaaagtgagatcctatctcaaaaaaaaataaaaaattaaattaaaaattaaatattttaaaatattaaaattggccaggtgcggtggctcacacctgtaatcccagcactttgggaggctgaggctggcagatcacgaggtcaggaatttgagaccagcctggccaacatagtgaaacccttactaagaatacaaaaattagccgggtgtggtggcgcatacctgtaatcccagctactcaggagtctgaggcaggagaatcgcttgaacccgggaagtggaggttgcagtgagctgagatcgtgccgttgcactccagcctgggcgacaggacgagactccggctaatttttgtattcttagtagagagggggttttgtcatgttggccaggctggtctcgaactcctgacctcaggtgatccacccacgtcagcctcccaaagtgctgggattacaggcatgagctactacgccaaacccagatccagtattttaaaaggataatcaacataaatgagtttgggataattttaggaatgcaagatagtattacatgaaaatcagatgtattcattagtgcaacaaaggaatgataaaataatgtaattatcttagtgcggagaaagctgtaaaaaacattcaaatctattcatgaccaaaattcttagcaaaacaggaatacagaatttccttaagctgtcagagtacctacagaaacttttcagcccacatcatacttagaagtgaaatggtagctgcgcacagtgcctcacacctgtaatcccaacacttttggaggccgaggtgggcagatcacttgagctcaggagctcaggagtttgagaccagcctgggcaagacggtgaaaccccatatgtacaaaaaataaaaaaaattagccaggtggtggtggtccatgcctgtaattgcagctatgcaggaggctgaggtgggaggatcgcttcagcccaagaggttgaggctgcggtcagccgagattgcaccactgcacaccagcctgggcaagagagtgagaccctgtctcaaaataaataaataagactaaataaatatggaattacaaggagctcagaatagacaagagaggctaagattttattttttattttcagacggagtcttgatctgtcgcccagtttggagtgcagtggtgctatctcagctcactgcaatctccacctccggggttcaagtgattctcctacctcagcctccggagtagctgggattacaagcgcccaacaccatgcccagctaatttttgtatttttagtagagacgggtttcactatgttggccaagttggtctacaactcttgacctcagtggtccgccgacctcggtctcccagactgctgggattacaggcttgagccaccgcgcctggccacttttttttttttattttttgttttatctgtatttttttgagacagggtctcactctgtcgcccagacaggagtgcagtggtgcgatcatgggtcactgtagcctcgaattcttgggcccaagcaatcctcccatctcagcctccagttgggacgacagatgtgagtcgcctggctaactttttgaaatattattttatagggagttgggggctggtgtctcactaggttgcccagtttggaatttctggattcaagcgatcctcctgcctcagcctcccaaaacctgggaatgcaggcatgaggcttagcgcccggccaatatttgctttatctttctaaatatacacaaggatgttaatcatagcacctaataggccaaaattggaaacaatggaaacaatcccaaaagctattatcagcagaatatattcattctttagaatagatcagtggtggtgtattcatacaatggactattccacagagatgaaaaatatatatgcaaaaacataaattgcataaaccatattgagcaaaagacagacgccaatactctatttacataaagtgttacatacacagagatagattaatacatgtaaatgatacagatatgatagctaggtcagtccacggggatctgtggacttctgaagagtcgtgatccgtgtgacttctgaagagatgagggggcatgggaggctttagcggagcttccgctattctggcaaggtttcatttttgcccggggagctatcagccagcggagagatctgtaagaagagataagacctcaagggaagtacgaggcagagccttccgcggcccgcgccctggcggccccaagtcagcggcggagacagcgcccaccccgctccagcgtggagcaggagcaacggcgtggcccgtggagccccgcctctcgcggcaaccacagagaagccggactgggccacgtctaggaagaggtaggaaaggatcggcgcatcatttctccaatgggaaaggatgtgtttgcggaccaataagtcgccagtataacacccgcccacgcgcctgccaagccaatcggctaggagcagcgagcggcgcggctgaggcgcggcggccccgtggagcagcgcagtatggcgggcggggcccgggaggtgctcacactgcagttgggacattttgccggtttcgtgggcgcgcactggtggaaccagcaggtgaggtcagccggcagctgcccccgaggagcccttcgggatctacagtcccgacgttcagccggcctgcctcgtcctctctgcttccccaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtgaggtggtggcagagttagccgatgccccttatttcccttccgcgtgcctagtccttgcgctgccgttatcttcaagaccctcccactttaccgagctccaggaccggagatgaggagctgagcacaacatgccaacactcgaggggcccacgacagttgctcaagagccatttcgggaataggctgctaggccctggagacagtgaggacttgaactgcagcactcctgtcagacccctggatgtggttccccccgcgtcccacagctaatgactaagctgggaaccgaaagatggaatctagattctcctaagccaaggtttttcccccaactagtgtatatcccagaaagcttggaagagccaagtgctggagagatggtgacagcaggttgtcaggtgatcagaggaaggttagctagaggggaagggtgcccaggctttgacctaacattgtctctgttatttctgtacaggtagtttgagctccctaaaagaggaaggtggactctacagggacaaacagttggatgctgcaatagcatggtgtgtaactgatgtatggataagggtggggatcgtgtatgtacgcagaacgctggataactctgatcagagtgcagtttctttgatcaatctccaaactctttcaggcaggggaagctcaccacacacaaagaggaactctatcccaagaacccttatctccaagactttctgagtgcagaggtgagggcctctgtcctgaactttttaacccggtgccacaacctgagggtctccataggggcaggtaaacggggattttaatcattttaaatgtcttagaatgatattttgggaaaaagcactccttttcctaaggactgcgactcggtgaacagaaaggaggctatgcggtgtggccagccaactcaaggaggatgaagcaacctttgcctctaaactgcctggaactaaatgtcgatttttctgacccctcccagggagtgctgagtagtgatggtgtctggagggtcaaatccattcccaatggcaaaggtgagacttctccagatactgatggatgggggcttgggtagagcagaaacatggagaaaggtacatttcctctgcttgtcttcaggttcctcaccactccccaccgctacaactccaaaaccacttatccctacagaggccagcatcagggtctggtcagacttcctcagagtccatctccatccccggagcatctgtatgattcagaagtacaaccacgatgggtatggggaccccagaggctttgaggcaagaaacatgggtccccaccaatgcaggatgaggctcttgaggccatcttccctgcccttccccaggacaagaggctgaggagttgagggaagagatgtaagtcttggatcgtgtttacttgtggcagggaagcaggtcggctggaggcttttggccaaggggaaagtgtcctaaaggaacccaagtaccaggaagagctggaggacaggctgcatttctacgtggaggaatgtgactacttgcaggtagtggcgtggcaatgtgcactccagggtggaagctcttctcatcctgctaactatctttcgtcactcacccccgcccagggcttccagatcctgtgtgacctgcacgatggcttctctggggtaggcgcgaaggcggcagagctgctacaagatgaatattcagggcggggaataataacttggggcctgctacctggtccctaccatcgtggggtgagtggaacttggaggagtaaacattcgaatcccattgggagagtggcttaatgcaaactggtttttttctttacgaggaggcccagagaaacatctatcgtctattaaacacagcttttggtctcgtgcacctgactgctcacagctctcgtctgccccttgtccttgggtgggagcctgggcctgcgacctgagccacctgtcaacttcccttacctgcattatgatgtaagtctcggtgctcttgttctgactgcggcaggctacagggcctcctcatgctcccagtcagtcgctgtctgtactggctctgttcctgaggcccgagcttgaactcagctgtgatgtggcctctcagatcacactgtcctatgcttgtccagcctggggtcaaacatacccctgattcatcccctgggtctctctggtgttaacattctgcctccacacattcttttccaggcccgaggccaagtgcccctcttggtgtcttcttacaggccattctgcccttccactgcagtgccatcctggctacagccctggacacagtcactgttccttatcgcctgtgttcctctccagtttccatggttcatctggctgacatgctgagcttctgtgggaaaaaggtatgaagctttgtgaggggttgggtcagtgctgagaaaatgtcctataacgtgttctcttccttctctttaagtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgagggtatagacagagcatgccacacaaggtgagagctgttggtccttaggagtccttgtcagatttttgtttcatgtccttttccccctaatttctcgggcattctaatgatgttgttccctccccaccccttaaaaaggataaaaagaagggctttgaatatcttgatccagctgatggcctgataacataaaaattcttaagtttcttgggctaggcatggtggctgacgcctgtaatcccagcactttgggaggctgaggtgggcagatcacctgaggccaggaattcgagaccagcctgaccaacatggtgaaccccatctctactaaaaacataaaattagccaggcatggtggcacatgcctgcaatcccagctacttgggaggatgaggcagaagaattgtttgaacctgggaggtggaggttgcagtgagccgagatcacaccattgcactccagtctgggcaacaagagcaaaactctgtctcaaaaagaaaaagaattcttagtttgttattcatgctgccacagactaatggtggttttggctttgttatggcagccagctcaccccagggacacctccaccctctgcccttcatgcatgtaccactggggaagaaatcttggctcagtatttacaacagcagcagcctggagtcatgaggtcagtgtaacggttgctcctgcccttcttgccaaccgcaaccctcccttgacttcttacgcacttaatggctgttctctgcccccacagttcttcccatctgctgctgactccctgcagggtggctcctccttacccccacctcttctcaagctgcagtccaccgggtatggttctggatggttcccccaagggagcaggtatgtaggaggtgaagaaaactgagatttcaagtatgggagaggttttactatctccattcctggattaaaagtgctgaaaaagtccacagttaaacattcctttattcaccctatggctcccaagaaaagcattcttcctctggagtactggtgtactaaggggacaatacaccaaatttgttgagtttacaatcaagtctactaaggttggacttccttatcagtttggcgagtcccagggcagaataatcatccatctacaggtctctgtttcctctccctccacagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctatttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactaccccctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaacggtgggaaacctaagaaaggaggagggctgtattcactggtcttttttttttgtttttgagacggagtctctctctgttgctgagactggagtgcagtggcactgtgtcagcttactgcaacctccgtctcctgggttcaagcaattctcctgcctcagccttcagagtagctgggattacaggtgcccaccaccacacctgactagtttttatatttttagtagagatggggtttcaccatgttggccaggctggtctcaaattcctgacctcaggtgatccacccacctcggcctcccaaagtgttgggattacaggaatgaaccactgcgcccagcctcactgatgctttgtaacaatgttaacatttatgaagcacaatatactgatttgaaaaatctcttgtttattcctcacagcaaggttgggagagctatgtcattatagataaggaaactcaagaggctaaatgttttgcccaaagtcacacaactcctaaaaacaaaactggaatggaaactggggcttccactttaaaatcctggccgggcgcagtatctcacctattcccagcactttgggaggctgaggcaggtggataacctgaggtcaggagttcaagactagccttgccaacatggtgaaaccccgtgtctactaaaaataaataaattagcctggcatggtggtgggtgcctgtaatcccagctactttgggagaggctgaggcaggacaatcacttgaacctgggaggtggaggttgtagtgagctgagattgtgccactgcactccagcctaggcgacaagtgaaactgcgtctaaaatacataaataaataaaaatttaaaaatcctcaaaatctagtgtcctttctcttctagaaccactaccaccctgatgagtcaagcctttccttagatcaaacctttacaaaaaccacttattatcttggatatcaaaactccttctttggcctttctgtctgttagttggccaccttgacctctttttgccaggtcttcaccccaacccgcacctacctcagcaggggtcttatttcccagctgctgggagatgatgttgaaggtctgtggctgtgccccttgctcctggcacatggtgaggatcacacggtcagcttccctgtaacccaggtatcatgattaaccctagggagccacatggatgtggtctatgctcttttccaaacacacgtcatccacccttacctaccttgtccacaggacaaccttttccccagtggagctgaccttgctgttgttggcacacaccgtagcttctgcggcctttggctgctgctccccctctggacccttggcctgtgttccactgtctttagccaaaccccctctaggggctttgggagaagtctctgaggtgtcaattcctgatggagattcatggacagggcacgtcctgtctcttgtcttcacccgagctctgcttgagggcagccatctctcttgagtgtctggtttcccggacacatgtcttctccctgcatctctggtctttgaggaaacaggactcaggaaggaagcagggggttccacggtaccaggcaatttctcagtttctgatgcatcccagaccagcatcaaagcctctgactcactcactgccttttggccctccctctctttctgaagtctgggggatgccttggggcaggagcgaacctcaggcccaacctggtttctcttaacagtgtacagtacagctccagttgtggggggaaattgaggagtctctggtgaatgaggtggtgggccatccaggaggagccgttctgtaacagtcacttctcgaggggatggcaaagtgctccccactgccaatcctgcttaggaggaaaataaggatctcagggtactgtcaggttcaagatgcacctaagcacgagaaattacctgtggccaggtactgtgcaaaaattctaataaaaaagagggctgggcatggtggctcacacctataatgtccgcactttgggaagccaaagtggtgggactgccaggggtttgagactagcctgggcaatatggtgagactccatctctacaagaaaatataaataataaaagagttgggtggaggtggggggcataatgtcacttatgcaaagatataaagtcctactgccaaagctgagaacggcccagtctttaggatgtagattacactagatttggagacagggggaagggtttttggaataaaacacaagacaatgttgaattgcatgaaatttgtggcattcttaattctgcaagaggagtgaggccatatgatagaaaaagcctgaacagcagaagggcttcctatgggtccatcagtgaaagaggtggtatatccatccctgaaaaggctatttatccaggctcatggaggttcctgtctggagtacaggataacgagactgaggaacagaagggctgcgttggcaaatcactcacctgaaacaggcatctctccctttctggtggtcctgacagtcctgctctgggtggcctcagtgctctcccgctcctctggggcttcctcttccatcatatccttgccctgcccagcttccttagcaccaggcataggactagcctctcggtgggggctgctgcccaccaactcatggggctccttgctcttgtaggatttgctgtcacagacctgcagggatggtcttccgggtcaaaggtgttctgactgcctatgtctttggttggggcccaccaaaggaagaagccctgcctgatgctcatcaagtcaacccacatgcatgtctgctccaacaattttgttgacagagtttcaactgggtgcagtggtacatgcctataaacctagttacttgggaggctaaggtgtgagcatcacttgagcctaagggttcaagatcagcctgggtaacatagtgagactctgtctcaaatgacaaacaaaaagaaaagatagacagagacagggtctcagatgacacagattatcttgcccaggctggagtgcagtggctgtttacacaggcatgaccatggtggtacactatagcctcagactcctgggctcaagtgatcctcccacctgagcctcctgagtgccctgttgcccagctattcctccaaggatttgattttttttttttttaaacacggtctcactctgtcacccaggctggagctcagtggtatcatcatggctcactgcaacctctgcctccctgctccaaggattttaaatggccccgaatagagtattggattccacaactccttctctcaccaagaactgtgtttttcctgccaaccaactccattctagagaaccaggattacttgtagagactattttcacgacagaggtttatttcattttctaatatctgagggaaatattttaactggtattttgtttttccaattccaaaagctttactcacagaattctctttaaaaaacaaaatctatcacgtatttctagcagattccatttattttgcatatgtacacatatgtgtatactgaatgttatttatatatgtgcctttttaggaattcagtaaggtacaattcttggtagcaaacaatcccccagcagctctgataccctcgggacccttgatactttcctcaccttgctgctacagtggctacagctccgccttttgctcttcttcagcttggaatctggacctccttcatggcaggagcaggcacagtccttggccccatctggccattcagtctcctaggagatacttgggcttgattagctgccaagttgtttttttttttttttttttttttgagacagagtctcgctctgtggcccaggctgggttgcagtggcacgatgtcagctcaccgcaacctctgcctcccaggttcaagggattctcctgcctcaggctcctgagtaactgggattacaggtatgcgccaccacacccagctaatttttgtatttttagtagagacagggtttcaccatgttggtcaggctggtctcgaactcctgacctcttgatctgccctccctcagcgtcccaaagtgctaggattacaggcatgagccactgtgcctggccgtatttttggtaccaagagaggaagctaaagttgtgagccatatgaacacaacacagcccaccctctccccatgctttttttttttttttttttttgagataaggtctggctctgtcacccaggctagagtgcagtgtcacattcatggctcactgcaacctctgcctcctgggctcaagtgattttcccacctcagcctcccaagtagctgggactgcgcaccaccacgcctagctaatttttttttttttttttttttgagatggagtctcgctctttctcccaggctggagtgcagtggcgtgatctcagcttagcgcaacttccactccccgggatcaagcgattcccatgtctcagcctcccaagtagctgggattacaggcgcatgccactaagcctaattttttttgtattttcagtgagatgggatttcgccatgttgaccaggctggtttcgaactcctgacctgaagtaatccgcccgccttggccttgcaaagtgctggcattagaggtgtaagccacagcacctagcctatggctaatttttgtatttttagtagagataggaattcgcaatgttactctggctggtcttgaactcctgtcctcaagtgatccacccacctcgacctcccaaaatgctgggattacaggcatgagccaccacgcccggaccccatcctcttttatgtatcaactcctcacatcgcctggggaaatcaatagcccaaactagattaaggcctattatgaatccctgaaacaatccctaaatgacctaaagactgacatat

SEQ ID NO: 175 - DNA, 355753 bp, Homo sapiens
  misc_feature (156263)..(206262): n is a, c, g, or t
tctagtgacttgtgagtagaaaacagaggtaacaaatagagagtaactcagcagatgactttacatttaaatgtatttcctccaaagacactttgggaacactccactccccagaggtggcttgttcagcatgcactgatattgtcttgtcattgaaactcctgccaaggtcacatgcaccaatgccagatggtaaattcagcatggggaggggcagaggcctctagagatgttaagtcaactgctgactttactctccttcctgcaaatctgagaacgagcacaagtgacctttcattcttatcttaatggtaagagctgcttgagtctagggcattttggtttggagctgagaggctgtggaataccttctcagtccattagggactagttaggcagcctcctgcgcccaccctcacccctgcccactgggggcacaggcatttatcatgaaaagaatgtagcgcctgcttcccccaacccccatcagatttcctgttttttttttctttctttctttctttctttcttttttttctaaaagcttccaaaatagattttggattgcagcgttttcctcaaatgtttcttcaaagtgtttcttgaataattatttgtgcttagtgtttgaaaaataaccttgctcaaagagaagaaatataatgaacccatttgagataatctacattaatgcaagcagcccaaagcaaaggagataaagagggaacatgaggagggtcaacatttgggctcttggaagggagccctaagaaacaagatcagcaagactttagtgatcagtgctcactgagcttccctcattagacagggcaactggagagcacaaccaatatacacacaggtgcacagacacacacatgagggacataggaatgagcaattggtccaagcatcctaccaacgtgacttctgcttcacctcaacatgagtttaagtagtgtggaaagtaggaaatgctcctgtagttcacgaaataaagcaagaaaggagcttccagcgaggtgcgctgggtaggacagccacccaaagcccaaaatagaaacagctcctcatcagcccagaaggaaaggcatcctactccctgcccaggctgaagaagacaccatccagaacattaatcctgccacgctttagtgcatccagagctttgcagcagaaaaagtcctggtagaaataatttttgcaaaattattgaacaaaaaagaatacgctttggaacagacgggatcgaagataatagatgtgaaggtgctcaggaaaattaaaggggttatataaaggtaagagatcattgttattagtgctgtgtttgcttcgaagatgctggaatatttcttctcaatcgatgatcttgacaccacaagggccaattctgtcgggatgaggagagcattgagcctggagccagaagggccagagtccagcgcagctgtactgctcatgaaccaccaactaccagcaagcccctcggctctctggccttgagatgccacctctgtaaatggggcctaatcatagggttgatggaacgtcacgtagatgaaagcgtccagtactcaggagacacttaaagcagctactgtttactgagctctgtttactttgctctaaacaccatgccggcactgtgtcttccttctctcgctaatcttcacaagaaactacaaggtaagaactgctgttttccagttacaaggaagacacagaagtgccaagaggtcaagcagactgccctaagtgacaggatttcagagcccaacacaaacccagtgattctagtcccaggctctgttcattcactaccatgttttcctcaataaatattggttgaatcccgagtaggttatccatcctttgacggcaggtactatttgttcttcctgaactctcatcccagagcatctgctcccgcgctggctgccagtaaaatttactgaaattgaaatgttacagctctgtgagaagggccctgctggccaggtcagggctctctgacagctatttggtgagctccacgtgactccccaatccaggtgggatgacttctgcatgagggggcgtgggaggccctcacacatgcagcttccaagggcaacagatgagctcattgtgcccatccctgacctgtaaagagggaactacctctggtacactctacgtggccagacaggtgtctgagatactgggacaccatctagccccgctacaggagtgaagttttagcttatctcaaagtgtcaagaaaataacttcagaagtaacatttgagagcatggctatcctgctttgtaaatcttggcatgttttctaaaacttgatgtaaagactgtattgtataaaacactgtaccaccagcaacttccaggcaaaaatggctaaagtgaaaacaatgaaaaatgcacccagcgtttcaaattaaggcttcctaacgtcatatctcttcattcttaaagacaggtgcactgggcttgatttgatgtgatacccaaatacaacggaactgtaatttaggaagctcaagttatctttgaatcaacgataaattaatactattgtaaattttctttaggataccttcttcacatgccagagataataatgttctggtcttcaattaaatgaaagatgggattaaataattccctggggagctaattggtagatttggtgaagctgcttttctcatgcaaccacatagcctcatgctctcttccttgggtattttctttgacacaagtcttattatgcatttgccattctacacaagtgcttagctcagagttggttcctttggggtatgtgtagtacactgcaggagaaggattgttgctgtgccatgcaaaacccaaggaaggacccatgaatgagcaggacacaaccaaattgtgttgaaaagcatgggaggctggcagatggagccgcttatcaacttggcaccatgctctggatcaaatccaagccctgcctctattttgattagttaaaaatttcaaggactgtttgccagactaaaacacagtatggatcagaattcatatcccatggtgtctccagcctctagcatgaaatacccctcaactttaattggctttggtctcagcctgcttacataagctcttaggcccctgcaaggttgcccctggaagtacacagaggaggcccccatgttcatgaactggatagtgagtgcagccatcatgattgacatgtgggccatgttctgcctctctcctactcccatcctcctgaaagtaagagtggctggcatggctggagtgagcccccaatgcccctgttcccctgcactgccactgctactggtttcaggtgttctacagtacagggtgctgtgtttccagaatacgtataatgaacattgctgtcccccacagtgagtcctactttgtcacagggacacacatacctgctgatcatattcttagactcctagtctttcatgccagacagtgtcttcagccttcacctgctgctgtctcaaccctgcccctggtccagaaacccaacacaaattcccctcagccacactcagggctccagtgcaattcacgtcttgcaaaatgactcctctaaccagctgaccagctcaccagacaggcctagacaagtttactctcgctgagggatcaaggaaaaatgctcacaccaggattaattttatgctgacagttttgttttttaaatatgagggaataaattagtaaataaataaatgaataaacaagatagatttccttacagtagaaagtcaacaaatacatgtaaaaggaataatattgaaaaacaaaacccagcatttgacaaccatcgtcattattatagattcaggccagaaccatcaatggatgctaaagctagtgagtaaaatttgaaggaacatatttgtaatctcaaagtaccttcccacaagatgcttattaattacaaagtaactttacaaagtaaaataacattattattttagaaagtaatattaccatggagaaacttggctgatgttacctgtcaacgaaaagagtcgaactctgtaaaatatttgaagagatttattctgagccaaatatgagtgaccatggcctgtgacacagccctcagggggtcctgagaacatgtgcccaaggtggtcagggtacagtttggttttatatactttagggaggcctgagacatcaatcaaatacatttaagaaatacattggcttggttcagaaaagcgggacaactcaaagcagaggcttccaggctattggtaaatttaaacgttttctggatgacaattggttgagtttatctgaagacctgggattaatggaaaggaatgttcaggttaagacaaaggattgtggcaaccaagttttacagtgcagaggaatctctcagcagacttcaaagagagagcaggttgtaaaatgtttcttttcagacctaaaagggtgcctggctcttagttgattatctcctggatcaggaaggaaaggaaggaaaacaaaggggagaagggattccctatagaatgtggatttttcccacaagaggttttgcagggcaatttcaagtcatggcaagaagatatattttggagtgaaatattttcttccttgtctcataatgttatgccagagtcagattgaaaagcaagtcacaatatacagggtcaaataaaacccatctgatgagaatccatggtttgcagggcatgactccccagaccccttagagaggaacttgggcaagataaaaaatcagagcttagtcctcataccttaaccaaaggatcaaagttcacattactagtaatgagacaagggttcagcaggtgcctcctgataagctgcaccgagaggaacccaacaccactcctacagcattgccactgaaagcatgcaacccaaatgcaatcacaaggaaacattggaaaaaccccaattaagggacattctacaaaataactgtctggtactatgaagaaaagtcaacatcatgaatatgaagagagactcaagaacagttccatattaaaggagactaaagagatgcaacaattgaatacgtagtcctgggtgttttttttttttgctataaaggaaattatcagaaaaaattgatgaaatttgaataaagtctatagactggaaaataacattgcagcaatcttatcagttattacatcaacaatcaatatatatggtaagaaggaaaaggataagacaaatgtagtaaaatgttaacatttgaggcattagagtaaaatgttttctactattcttgtaaattctctctaaattgaaaaattacgtcaaaactaaatttttttaaaaaataatttgggctattctttgagttatctaaagacatgtgtacatgtttccaagccagggttgggggctgggaatgcttgctacttttcaagcaatggccaagcctggtcttcttcttggacatgagaacacagctggcttctgagacctttgtgagccacatcaccatgtgatctgaatttgagccagttctaaaccttttgtggttgtttcaaaatcgcttaggaaaaaaattggtgatgatggggaatggtggggaggagcagctgcgtttctaagagaacacatgccctatacacccctgcccagtcgtcccataggatattcttggctgctgagagggagaaatcagaaagtcaaggaccatgtgctcctgtctctaagcctgttcagtgatggctgagccagagactcaagccttaggagctgacttgttatggccctaaaaataattcagaagtagcccgaagctactgactcatcagacaccctgagggctctcttgctggcattaggaaactctgagaaatctaattaaacttttattcaaccccctctctgggagcacagactagtgaagagcaagtgacaatggtctggttcagcttgggtgtctcctgaaggtgggaggtgcggagacagcctccaatcccagtgagggagcatgggcagtgggaagaccctgcaacatgggattcctgaggctgggtcccaggaaggacaggctcattttcccacttcatatcaggggccaagtgctccatgtccatgcatttctctgagcctgcttagttactggtgaatcaaataaataaaatcaagacaatatttaatattcattgagtacttattgtgtgcccttcactgtgctaaccaccctaatagaaaatctcatttaatcctatgcaggtgttagtagtcccattttagagtcgagggtattgaagctaagagaggcaaagcaatttatcaagcctcctttgagagagtgaaggagcaactaaatttaccattaaacagggaagccaagtataaataaccacatgaaatatgaaatagcaatgaaagagccatcttagaaaaggctatcttcatggacttttcatcagtgacctcatccaatctcaagactccaaacatctcctccatcaggggatccttagatctctagctcttggtccagcctctctcttgagctacataaactccttatttttagctgtgggcctgacctttcctctaggcagctctgcctggagctcacactcagcctggccaaaactgagctcatgtcatttctctcttcttccaaaatgaaccccacttccgatgtttctatttctggcccaatgacaccattgtcctgaggaataaggtttgaaatcttgagctttttcatccctgttccattatatgctgcctaatatactatttttctccttttacttcctttaccatgcctgccccattccaccaccaccccaccccaccccacctgcctgcacatctatctaaggaaatgtgggctctcttagcagggaaatgtgatataaatccttccttatccatccctcagagcacatgctacaaaactgacccagaataatattttgaaagttgatgaatcagagaacaaaaaggtcaaatcctggacactcactttgtgtagatctgattttaatggctcatacgaatacttttatttccaaaagaaatgagatggaggatactagagtttttaaaaatatttccttagactctacgatgagctgagccttgtgctagtttctttcacacacattacctaatttaattcttataaaaactttgcaagacaggtagtaaaaaactcgctgtagacaagttcaaaatcaagctcattttgagaagctaaataacatgctcaactcacacagctagtaagttcacctctccttttgcaatctctccctaagtgatttcctccagatttaaaacccatccataaactgctcagattcggatctacagctctgtgttccagactccacaaaagcacctcctcacatctccacttagagggctgatccacccagatgacttcacatgtccaaaacataagccttgatttttccctcctcactgaaataggtccttccttttcccgatatttcccacccagttagtgacatcatcattgcttgggccaaaaacctacaagtcatccttgatttgcctctttcctccttcatgcacacttagtctgtttggcaaggcttttgggctctatttccaaagcgggcctttcgtccaaatacctctctccatctccacagctgaaaccctaaaccaagcccgtgctgtctctgagctagttgattccagtggtctttcaaccctgcctgcctccactcctgccacccaccttcccgctccatagcacatcctcctcacagcagtgtgagtgatcctttgacagcagaggttaggtcatgtcgtgctcctgcttaaagccctccatgatgtcccatcatcacggcctccaaggcctgctgaatttcctgcctcttctgcaccactccctcctctgccttccaacccctggcaactgctgatctttttgaaagctgatcaatcagatcaatttgccttttccagaatgtcatagagttgaaatcatgcagtatgtagccttttcagattagcttcttttacgtagtaatatgcatttaagtgtcctccctgtcctttcatggcttaatagcaagttcctagggatatatcactttattccaccctttgcagccagtctgaccccaggcaagataagctaaggtgagtggtgggcaaaaagcaggggtctgaggtctgctatagttctccacagtcagtcccacctcgaatgatccatgcttccatggcagggtggatattgtggcatggatccaaacccccgatttcaccctgctatagatgctactgtctgccttttcaacaggtattcccttcttcctaaggggccaaagtttatccaaggataaaatttatctcccctcctcagcttgccatgtcctttggggagggcacatccccaatcccaaaggccaatacgagtctaagccaatcatagtggtcctattccccttgcctgtgactgatttaggcatgaccatggcttgcatctctggccaaggacacatcatgggaaatctgtgaggcttctgtgaaagatcccttcacttgcccagaaaaaagacacaaggaaagacagtttctcttcttctgcagaaatagtgtgtctttgtgtccgggtgtgacacatggaactaaggcagtcatcttgacctaagaataaagctcacttgaggaagagagcagagcagaagaatgaaaagaaactggagccttgctggcttactaggacactgagttagctaatccctgaagccctacctcaaggcttttttttttttaatgtgagaaaatacactgtttcttgtccaaaccactctgagctaaagtttctgttcttgcagccaaaagcagcctcagggagacatgacctgttgaagcttcatcaatccacttcttggcttagcttcagccttttattagtcaatctcaaaaggtactccaagtcaaattgttgctgcctttagcaacaaggtgatctgcatttggatttccttggtcttgaactattctcactacatggaatccttccagatagagaaaggccatgtgcgatgaataacaattttgacatatctattgcactttgcattttatagaattttcaatctttccttcaataaacacttcttaagcacctactgtccgccaagcacaggtaagaatgatgcagtaacgaacaaaacagacaaggtcactgtctttatgaagcttatcaagaaacaagtacaagattgcggtgaatgacaggaaggaaataaatagaacaaagaaagagtaaataaggaactggggtggggtgaattctttaaattaggtggccagggaaagcctctctgagatggtaatttgtatttttctgctataattaaactttctttattgttgcaaagtatacataacataaaatgtatcactataaccatttttaagcgtacagttcagtggcattaagtaccttcacattattgagcaaccatcgccaccattcatttccagaactttttcatcatcccaaaccgaaaatcaataactgtaaatcaataaacattaactccccatttccccttccttccagaccctgaaaccacaattttactctttttctctatgaatttgacttctttaggtatctcatataagtggaattataaagtatttgtctttttgtcactggcttccttcacttagcataacgtcctcaatgttcatccatgttgtagcatgcgtcagaattcccttcctttttaaggcagaataatattccattgtatgtttataccacattttaaaacatccaggtgtctgtcaacggacacttgggtttgaggaagtgacaggtgaaatgcgagtttaaaggatgagaagacccagccacaggaactgctgaagggagtgttgcttggcagatggaacagtggtttcttggcagatggaaagttaaaggcctgggcaactcctaagctttccttaagacccgaagccaatgccagcacattacttttcaaagtattctctccctttcctgagcaatttgtcaatttctgtctatgcttccaagaaactttacctgtatttattccattgcattgttgtctcccctaccaggctatggttgtgtcttagctgttttgtgttgctgtaacagaataccagagactgggtaatttataagcaatagaagttgatttggcttatgattctggaggctgggaagtccaagagcatgtgacagcatcccgtgaggacctttgtgtttcatcatcccatggcagaaggtgaaagggcaagacagtgtgagagcaagggagcaggagggggctgaacttgctcttataataagcccagtctcttgataactaacccactccatcaataacaacattcatccattcatgagggcatagcccttatgacctaatcatctcttattaagccccacctcccaacactgttgtattgaggattaagttcccaacacatgaacattgggagatacattcaaaccatagcaagttccatcacccctccccaacaaacctttttctagcaggtgcaaacaaattacaaaactggtgaattagagctgccaacaaactgcaaaaatgatggatttgagtttctccttacccttagttccataaggcagaagagataaggaacaaggtgaaataccaaatgcaggcagcaaaggaaaataagtgaagagccttcatcatctgctagttaagccctgaatttagaaccatagcttccaggagctggaagggatattaagggatattggagatcacctaatacaatgcatttgcttggtcctgggatgaaatgttttatgcaaacctctggaatggacatgattggttggaagcagagaaggttctcagcagtcctgagaggtgcttaaagtgagttttcaaatgcccatttatatcctcccaatgacccccaatagctggacccccttatattactccaagattggacggcaggctgatgggaaaaaggggtccttgcagagccccacagctcataccagcaagtgctacaaacagtccctgggagacgtgatttactctgggcctttgctgggagggagggaggagaacagctgtaaatgccactgtcccagagatgatggatcccagaaagtgggacagagttggtctttctccaaaggacacctctctgtaagcagaaatgggctgagagagggtagctggtggtgccaaggcctctggtgcattctggtggtaggtgggtggacagaccattctggaaatggcttgtcatagcccgctcttgactcatccaaatgggcctgaaattgccagggctgtgactgtgctttgcatgagcttgccctctgcagcccaaaatatccttctctgattctgtgccatgagttgattaacagtctctcttggaataattcccaggctgcctcaatccttttcagaatctattttctcactttacatggggcaccttttaaatgtggacagggtaatataaaatagtgccaatgctggattctcagaaaacagctaggtattagatctgtacttattaagccctcacatagaaataggaagacatttgcctttaatttatacttcatcaatccaaaaattatccagaacctagcatgtgctcagaactaagcattttggaggagaaagtataacatgtatagcatgacacgatcctggcccttcacagatttattaacttccttgaaatgactaatatatgtgaaacaatgaggaaaaaaaaatcaatgctctggtatgtggactctttgtgcataacttatgggctgccatccacccctgagagggacttcctttctatgggatagggctcccctggaatatttttgcaggttaactaggcactgttcttccaaacatggcattccttccaaatgctctaacatattcttatgtgaataaatttcatccgcaagtgacactccataatccttagtgcaaacaccaagtatggacactgtatataaactctgaggactgggagaacatctcagtgacagcttataacttggccctggaaagtcaagatgccagtgcccccaccagttgccagcttgggccactttccctctttccttcaagacttcccagtgtgctggctctgggcctctccaaacaaccgtgtgttgtggcttcagcaggcatgattgccacttgttttcctggagctggatcttgcaaacttcacacccttgtcctctgtgttacagagaatggcctttgtgtttgtctatctgagctgtcatctctttgcaatggccacatgccattttcctcttcctctctttttgcttgaatcacaagttttaggggaaaaaaattagaagcaattcatctctgagaaattctacacttggctagtttctgccccatgtgatgggatcaagccaagtcaccatgtttgtccaaaatattacaagtgcaaaggaacccaaaggagggagaagtcagtgtggaatgaaatgggctgagagggaggcatggaggaggcatgaatgctaagggaaggaaggaggaccccagcagggtgaggaactgacgcagacctacgcaggctaggtggggccagctgagggtgacacactgggccagaggggatggggtgatgagaggaggtgaataaagtccattcagcagctaagagtgatagaagggttaattttatgtgtcaacttgactggcctaaggaatgcccagagagatgatagacattatttctaggtctttcttggagagtttagcatttgaaccagtgggccctgtaaaggagattgccctcaccaatgtgaatgggtaccatctcatccattgagggcctgaatagagcaaatagtggaggaagggcaaattgtgtctccctgtccttaagctgggacatccaccttctcctgccaccagacatcagagctcctggttctggggcatttggactccaggatttatgccagcaaccccatccacaccccttcccttccctggttctcaggcctttggcctcagactgaattacaccaccggttttcctgggccttcagtttgcaaatggcatttgacttccataatcatgtgagccaattcccataatgtgtccactcttatagatagctatacatatcctattggctgtgtttctctggagagctctggctaatatgagtgagcacctactatgtgcaggcactgagctggggcctgagaacacagcaaaagacaagatggacaaacctctctgtccactataccaaaatataatggagcatacattctggcgggcagagaaatgtaacaaataaaataataagtaaactgtacatttttcagaacctgataagtgctatggaagagaaaaaaagcaaggaagatgaaagggcaacctggagaggatgaaaagtaccaaaatgtaaatatgatggttatatgtatagaaatatttatggttacatgagaaatataatggttatatttctcaggctaactgagaaagtggcatttgagcaaaggtttgaaggagttgatagattgtgctatctgaagacccgaaggaggaatgatccaggcagatgaactagcaagggcaaaggccctgaggtaggagctaaatctgcatatcttcaggagcactggagtgaaacaagcaagaagagcctggttgaccaagttgatgaggtaatggggagacattgtatatggcctgataggccattgaaaggactttctggctgggtgctgtggctcacacctataatctcagcactttgggaggctgaggggggcagctcacataaggtcagaagttcaagaccagtctggccagttggtgaaaccctgtctctaataaaaatccaaaaattggccgggcgtggtggctcaggcctgtaatcccagctacttgggaggctgaggcagaagaatcacttgtacctgggaggcagaggttgcagggagccaagatcacaccactgcactccagcccgggtgacagaatgagactccatctcaaataataataataataataaaataaaaagagaggacttttttttactctgagtgacatgaagagagctttagcagcctctctctggctactgggctgccactagggaggcagcaggaagccaggtcaggagagaatctaagtacccaggtaaatgaacatgatggcaggaccagcagggtggctatgaaggtgaaaagtaggggaggctgagcatatttttaaggtggtctgaacaggttgacagttgcctaggatacaggctgggatgtaagagaaagaaagcactcaaggaagactccagcatttttggcctgaatagctggaagaaaggaggttgtattaagggaggtggttagattgtggggtacggggaggacttggcaaggaaagtggggtttcaagtataaagactggattttgccctgtaggcaacgggaaggatttagactcctgagcagatgaattcgtgtttgtgattgcattagtgttgtagaaaggcaaatctggcctttatacaagagggactgcagcagagaaagacaatagacagaaagacaggcttggaaactgtcttaatctagacatgaagtggtagttacgggaatggaaactggagaaatctaaatctaatgcaaacgtgcagtggagtcacatttgggatttagtaaaaatacattcaaccctcctatatcccccaggaagacctatggcctccctgcattgtcatctctatgattgcaaaggcttatgcttgcacagccatttctcatgctgtttgtttgaactcatgctgtcactctgtcgcacttcttgtttgtttgtttgtgatagagtctcattctgtcacccaggctggagtgcagtggcacaatcttggttcactgcaacctccacctcctgggttcaagtgattctcctacctcagcctcccaagtagctgggatcacaggtgcacaccaccacactcagctaagtttttttgtattttttggtagagacggggtttcatcatgttgcccaggctgctctcaaacttctgacctcaagtgatctgcccaccttggcttcccaaagtgctgggattacaggcgtgagccaccgcacctggcctgtctcatttctgggagctggtttcttctctctgactcaagtggaacatatccagaagttgccttggccacttccgcatgtctaccactggctagaaccggggcaaaagttcatctttagttgcaaacgggactaggatttgctatctttcttctgggaagtcctgtgccctgtcaaatttaggaatttcttttccttttttttttttttttaatagaggaataagggaagtggctactggggaacaaggccccttcctttcagctgtctgacctctcaggactttcactccccagcctactccagccatacccggagggccttgttttccaaccagaaacaccctttttttaaaaaaaaaaaaaataataataattttaattaatgtatttattttatttatttattttttctgcttcttgtggagcagggttaccctataggcagtgtgcccagagtagcccagacatacccttaaatttaacttctaaacaatactgttctctccctgagaagagttctatgccagcctcttaaagtaatgctttttcttccaacccacagaagaatgaccgtttgaaggaaggacattttaatgacaggactttgtgatgatgaagagagaaaatttagatttctgtctttgggagctggaaaaattggagctgcactattagaaataatgtaattaggaaggaagaaagagtgtaaataaaaatagatggcaggggccgggcgcagtggctcaggcttgtaatcccagcactttgggaggcagagatgggaggatcacttgatgccaggagttcaaggccagcttgatcaacagagtgagatcccatctctattttatatagagatatacacataaaatgcatatcacaaaatgtatataaaatgtatagatagatagatagatagatagatagacagacagatagatagatagatagacagacagatagatggtgaggaggtgggacagggatgggaagataatgtattttaggatgaaatgattatgtgaggtttggacatgatacattagaggtaagggtgggcatattaaggtaaaaatgtactctacgcccttgaaaacatagaaaaaatgtcaggttataaagtcaggctgaagaatggacatcatctctgtgggtctcagtttactcatctgtaaagttggggtagtaatagaattttaaaaaattaattaattaaaaaaaatttttttagagacaaggtcttgctctgtcgcccaggctggagttcagtggtgctatcatggctcactgcagcctcaaactcctgggctcaagggatcctcctacctcagcctccccaaaagctgggactacaggtgtaggccaccactcctggcctaatagaacctattaaacgacacagagcatgtgttaatgatgtagacacacagaatagaaacagcatattagaaacatattagaaaccgcagcagcgaagaccatgggggataaagaaagacatgcatgggtacaaagtgaaggcaagggcaggattggaccctaaatggccaccaaaacacaggggctaggttggagggaaccacagagagacaaggctgggaatctgctcaggtctgtgggagaggtgaaccaacccaggtaggaccctggggctcccgccacggcgacctcgtctctaagggcagcaaggcccaagagaaggttagatgtgctgagcacaggcccagctcacaaacaagtcctctctatacctctaaccttgttgattctatgagcaggataattttgagggctggcctgctaatctcagagaggcaggtgctcttgtgggcgttttggtgcccttttcgtgtaaatgtgccacagggaagtacattcagaattgattggtgctttctgcctatgttggtatccccagctcattcccttcacaattttctcatcacgtagggacttaagggatacggtgaagcaacctggccaaacagccatattatttgttttcctctctttggtattttagaggtgatgaaaaagaatctgtcatattatttacagtaaaatgccacacatacaatccctttgacattcaaatctggacttaaataccgtgaaacatgcatgccttccttaaaggattgcttctctaatgcacataattcattgttatctctacatgaccaggtgtaatttgagggaccagaagattcattttcctatttaaaacaatgaagggggttgagatcctgatttgtatggtagctgctttaggctgccagctctagatattttcatctttgatctaggctggtgtctgtttcagagcaaaagcagccaggagcaatcggaaagataagcacacaccaagcgggaacttttgccaagagggaaaatcttatctaacccaactggcacaaagatgtgcttgtcccctagcgcaaattgagaagagtcttgaggtcaaggaggaaggtggaaatggcctggaggtcacacagcccttgcctctgtcataacgatgggtcttcctatcaaagaattgttcgggactgtgttagtccaggtcctctgggaagcagatggcaagagatttactgggggaaatgtcagaaggataaagaggaaaaagcaggagaagggaggaaaggcttcagactgtgatgctggcctgggccctgtggaggagagagagaaggcaggatgattgattgggctggaagagttgcagtagtgctgttccaagaaagatttgacgaggcccatgagggatctcccaaatcaaagtggctcctcaaaggaggcccccgtcctgcaggaatggatctgctttagcacctccaccttgctcagtcattgactgggaccagcctgggggatgcctggcctcggtgccagtacagcgatgggcgcatctgcagcaccagtcagcctcgctccatgcagtggaagacccaagtggcacattctcatggctaccccaaggacgatttgcaagaagtcatgtctaaaaagcctgataaagatccttgtgaaaatgtccatgactcagttaccaatagcaatgaattctactcaaactgaccactgctcatttaaatggttctgaaagtcaagggacaaaagtggggatccctacatgtggggattgagcagagactgaatctggctgtaggttttgagctgtgtcctaccctatgaactgtttttacgacacccctcctgacaccaaatggttgggattttaccaactaattctgtaactctccagacactaactgggtgtcctacatttcaattcaattctgactctaaccacctggagttagcgcagaccccataggttctagggctcagtcccacaagaccgcccttcaacttcagacagtcacaagtcctgggcctcccatactcttgacaagctggctataaagttgggggttcccatgactccccctcaggtccaataatttgctaaaatggctcacaaaactcagggaaacattttatttacattataaaggatgtaactcaggaacagccaactggaggagatgtgtagggcaagagatggggataggggtgcattgtgcttccatgcccactctggtgctccactctcccagcacctcagtatgtttaccaacctggaagctctcgtagccctatcatttaggggtttttaatggaggtttcatcacataggcatgatggatgaaatcactggccattgatgataagctcaatctcccaacccaccccttcccaggaggctggggttgtggctgagagttcccaccctctaacaatggcttggtctttctggtgacgagcccccagcctgaagctatcaagggacccaaaaacagcggtctcattagaacaaaaaagacactgttatcatgcagaaaatcccaagggatttaagagctctggtgccaggaaccagagacaaagaacaaagtcatatttttttttattatatcacgcacatactgtcagtgtgtcactgagtttattgtagtaataatagtaataataaccactacaacctctacaaaggacagaactaggttctcatgcttgctaagagtgatgcctaccataaaaagccacagcagaattttcttactctcatgtataatttccaaacccttccaaatgaggataacagcctgtgcccaaggcatcctttaataagagagggacagggcagccagtcaggggggaatgaaggctcaccagccagagaggcacacgggagaagctgacgcagtgtgcaaaaccagcaactgacaaccgagggactcaagggcctccataacttgcccactcttctgtcccacacgctctggggatggcttcctccaagatttcagccaggcagcctccctccactctcttcccacccctcccctactgcctcagacctgccctggctttctttctgaaggagcctctggtagggagaggacaacttaaggtttgcaggtttaccatatattaatttgaccaattaattgctatttagccttttgtatctgccaggatccttttaaacacaaactggttaattcttacatccctttggtttttcctctgggcctaggctcatgctatgaacatattagatgctcaatgcatacttattgaccagtttgtttattctgtgaataaatactatccaaagtgtgttaagagcccttgcagcacagtgattgcatcacagaacccagcgctggttacagattgcctttatctagaaggcttcggttatgaaaatactgtcttccaactggactagaaggaacttaagggcaggaagaagtacagattgatccaccatcttctttcctgcaactctagaaaccaaaaagttctgagaatgaacgtggctttgttcaaagtttgaggtgaactcccttggcggtaaaacatgacctgaactgatataagactatagtcttcgtttatcctcatagaatgaatattcatacattccactgcaaatattaatgtgttgctcgcctagtgctggcccagaccccacttgcggcattacgtaatgtatagtggggagctgaattaccttttgctatggtctgaatgtcccccaagattcatgtgttgaaacttaattgccagtgtgacagtatgaagaggtggggcttttaggaggtgattaagtgatgcgggcagagccctgattaaaaaaactcgggagaactagcaagcccctttgcccttcaggcttccgccaagtgaagatgcagcaacaaggcaccattatggaagcagagacccctcattaggcacccaacctgcctgcgtctttctcttggacgtcccagcctccagaactgtgagaaataaattcctaatctttataaatgacccaggctgtggtgtttgttatggcagcaggaacaaactaagatacctttctaaatgtgaaaaattctgacttagaaacatacctgactctagagattttgcataaaaggttgtagtcctgaattctgcatcaatcaatatagttgcagaagcaagtaactgatagtcccacacaaattggcttaaataataaaaagaatgtattgactcacacaactaaaagtctataaattgcgtggctttcaggcatggtttaatcgagaggttcgaagttattaaagccctacgtcctctgtctccaatattcttgcctttacactcctttgtcttttggctttatcctagattgtctttacacattgtagcaaaaatgattgcagtagttccaggccttgcaggggcaccccacgtggctcagaggaagaaagaacatctttgtcctggtactccaagaaaaaagtcccatggccacacctgaatggccacactagatgtgtttgggtggggtgggaggtaaattgggctgattagttttgcctaggacaagcatgctacctctagggctagggcaaaattagttgacctgaagccacatggatctccaaacaaaaaccaggaatgatagggaagtggaaggaaaaatgaatactgtggaggtaacaaccacctcattgccttttactctgtagtcaacacactcctgagcgtattaaaaacacttaacatatactggcctgtgttcaactcaaacctgatccccaatggtcaacaaggattctgttttctttatgttattagcttgctctttctttctttctttctttctttctttctttctttctttctttctttctctttttctttctctcttctttctttctttcttttctctttttctttctttctctctttctttctttctttctttctttctttctttctttctttctttctttctttctttctttctttctttctttctttctttttccttctttcaacagtcttgctctgtcatcatccaggctggagtgtaatgccacgatcatagctcactgcagcctccaactcctgggctcaagtaatcctcctgcttcagcccctcaaagtgttggaattacaggcatgagccactgtgtctggcctctttatatcattagctttctaccctcctttatgatcctatgcagcttcccatgtgcttatcttaaagtatttattctatgcattatattctaccttgtatcagtcatttgtgtaaatatcatctaccttattgaactctaagctcctttaggtgggatctagatttaggtggggttctagcttggttctgtgcttagtatatatcttgcaatgaaaaacattcaatgagtgttggtggatccaagtctattccccacctcagatcaaggtattagcaatggaaagaactcaggaaagcagggagggtggagtagagatggatggagagagaatgatgctctctttacatgtttttcactgggaacctacctaaaagctccacacatatcacactaaggtaaagtgatttggggagcaagaaacagaaaacccagactgaactgccttgaataataaagttgacgtattagttcacaaactggaaacttttgagccagggcaagctttggacccagcagctcaagactgtgaacataaacccagttagtttcctttctccaggactaacttcctcatggttgccaaatagctgcaagcagttccaggcatctcatttacacaccacactgtctagaacgcatgcacagcttgaatgaaaaagtggccaggggaaggggaagacagacaagactcacctttggaaacagagatgggtcagcttttccctaagaattgcatggtgtgttcgtttgctagtgctgtcttaacgtagtaccgcaacctgggtggcttaaacaacagaaattgatcgcctcgtacttctggaggcttgaagttcaaaatcaaggtttccacagcattggttccttctgaggactgtgagggaaggatctgctccagacccctctctctctggcttttagatggtcatcttctccctgtgtctcttcacagtgtcttttttctatgcatgactgtcactgtgtccaaattttcccttctataaggacatcagtcatattggattggggtcccaccctactccagtatagcctcattgtaacttaattaattacatataccatgaccttatttccaaatacggtatagaggtaccgaggttaggtcttcatcacacaaatgtgttgggagtgaaggagaacatttcaacctctaacatgtgggagggaggagtggatgggatagctaaatgaaaatcaggattctgttagggagaagaaacaaggaaatgggttctgggtcagcagtggtaaaggtctcatagtgatctctttctacaacaaaaaaagtgcagatgaggctttcagggacagcgattgtggaaaatcattttccctctctctagcacatggtagatgatggatgagatgacagtaagccctaagagatggtttcctccctcccactgtcttccacctctgtggtttcactggatagtctctctccagcaatcatgtgctatttagccctgagatgctctgagatgcttttgaacattacccagttaatcctcatgatgcctgctgggatttctcttagagaagagactctcaaggagatttatggcagaaatgcccagaaatgagaatcctgaagccaccccacagtcccaagcatttctattggcccagaatattcagcattaaagagtgaagaccacgttttcagctttggtagtgtctggacgccctgatggggagagatagcctcactggtggtgtccgcgggaatgtggaagtgaagatgcccctctgtagagcgcagacactttatctcatctcagacagggctctatggaggaatgggctggaaaagaatgaaggtcacagggtgacctgggctatgcagaggtgcctggaacactcaaaggaatcccttcaacctgggaaacagaaaacgctaccacttggagcccaagttatgtagagcatcttgttcagaaaaactcagttgagatcaagtatgacacagccttactactttctattaaagaggccaacatcaactctaaggggaagttatatgggatacatggttcttttatattgttttggtttctaagagcttctttgggatatgattgatatactataaattgcatgcatttgaagtgtacaatttgataatttgtgatgtatgtatacaactgtgacagcatcaccattatcaagataatgaaaatatccatcaccacaaagagcctcctcccactccttctctcccaccatgctccatccctttccttaggcaaccaccactctcctttctgttgctgtagattagtttgctttttcgagacttctatataaatgggatcatacagtatgtacccttgttttggtacatactacaatgctgtgtgcatcaatgtttattccttttcatttttgaggagcagtccatgatctgcatgttcattgaccacaatttgtttatccagtcacatgttgatggatatttggattgttttccatttctggctattttataaataaagctgctgtgaacattcatgggaaagtctttggacctgaggcacgctgttcagtggtggcatatcagcttagtggggctggttttactttctgcatgtgggtatgtgcaagtagttctagcaagatccccaagctgtgctcagcagaggctggcctgctgcgactgccgtctcaggccatctttagggtcctcgtcctcttcctcagggcatcatccctggcttttgctttgctctccttcgttcctcagcccctactgctgccataattagtgactagactggaacttagggaaaatagacatctggggaagaagtacctttaagaggatctaggatttactttcttaaaatcaactctaaatcctccattatcacccaggaaaccagctggcatatgcaaaaccacacttagacctaggcaacagcagccacttctctggaccctgtaactggagtttctccttttgccctcctctaatcacacccacttcacagcacaaagaggccacctgatatggttttgctgcatccccactcaaatctcatcttgaattgtagttcccataatccccacatgttgttgggggggacccagtgggaggtaattgaatcatgggggtggttacccccatgctactgttctgtgatggtaagtgagttctcacaagtcctgatggttttataaggggcttttcctccttttgcttggcacttccccttcctgccgtcatgtgaagaaggacgtgtttgcttcccgttccaccatgatcataagtttcctgaggcctccccagccatgtggaactgtgagtcaattaaacctccttcctttataaattacccagtctcaggccatcctttataggaatgagaatggcctaacgtaccacccaaagtctgcaccatcatcaccccaccctgtccacactctccatgccagggacccagaatcacttgcccaggtgactccagcccacttgtaggatgtccatgtggtgctctccagctctgagctgcctgaaaggtaggtagctgtgggcagagggtatggatggagcttgcacatgtctgtgagtgcatcctcatgggtgtgcacactcacgtgtgggtacactagcacacatggccctttgaagtgtgtgttggagtaaggagtgaaagagatggggagggaccatggccagggcctgggggccaggagccagctcttcccatgctcccagcacagaacaagaagaagttcaagaattttaaatgtaagcctggcctacagaatgttgggaaagtctatttgtcaagggggaggctacaccatatttcccttcacagtgctttggcttgattcagaaattttatgtctttagacatttgatgcatgggcctccacttgtactcttgtacttgtattcttgccttgccccccattagggatgggccgaggtccactgccctcctcctgcatcacataactctcatgttatatgtggcttttactgctttcttttcccctcctgagttatccttcatgtttacttcaatcttttttcaatttcataaatattgaaagtgtgaattgggtgggggaaagggggaaacacatttagtgtgatctgccccaagcctgcacacctggaggccaggttctgctgcaacttcagagtaaggagttgatgtttcttgtcaagattatggaaatcagggtagagtctttgctttgaggtcaggcagcttgttttcctgctaaaaagctactttgaccaccattgtggaagagcaattgcaaaaatggctctaattatccacttctccaccctttcattgcaatatgactttgtggcttctctcctcctattaagagatgggatgtatccccctcttacctcagacctaggctgtctgtgtgactcactgtgatgaatagaacgtggcagaagggacactgtgccagccccacgcgcgggcctccaggggtgtttctgcacttttactgtctctcagacccccacttctgctatgaaaataaggctgagccagactgctccatgacaggccacatgaggcagccaggaccatcccggccaaggccaccagcagcccatccaatgactgcccagagatgcatggatgagctcagctgaaatgaactaagcttgacccaggtcagcagaaccagccatccaacacatactcaggaatgtcagaaagtcaacaaacccagattttatcggttacgtggtctttcatgaaactccactaacctgcaaagtgttgtgtaaaataagaaatgttttcatataagttcagaaaattctaagttaacctggtttaaaaaagttaaacctgttttttcccttcaagacttctcagaacttttaatacagatctaatcagtatgcctaaccaatgcaggcacaagaaactccatcagatctatgtgcaaaatcatggcaaaaaaaaaaaagtcaagtcactaattaggccctaatatgtgcatttcctgaaacgtggattaaactgcatgataattcaattcttcctcaaccttgtcctattgggatggacaagttatcaaaatgaatcaatggcactaaaagcacaggcaacaaaagtaaaaatagataaattagattacatcaaaagttaaaactgtgcatcaaaggacacaaccaacaaaatgaaaaggcaacctacagaatgataggcagtatttgcaatacatatttgaaaagggagctaatatccagaatatatgaagaattcctacaacgtaacaacaaaaaaacccaaataacccaatttaaaaatggacaaaggacttgaatagacatttctccaaaggagatactcaaatggccacaaagcacatgtaaaaatgctcaacatcactaatcattagggaaatgcaaatcaaagtcacaacgagatttcacctcacacctgttaggatggctaacaaggaaggaaagaaggaagggaggagggagggaggaagggaaggcaggaggggaaggaataaaggtagagaaagaaaggaaaagaaaagaaaagacagaaaggaaggaaggaaggaaggagaaagaaagaaagaaaaagaaagaaagaaagacagaaagaaagaaagaaaaaaggaaggaaggaagcaagtgagggacagagggagagaaagaaggaaggaaggaaggaaggaaagaaggaaggagaaactagcaagtgttggcaaggacgtagagaaattggaactcttgtgcactattggtggaaatataagaaggtgtagccactgtggaaaacaatatggtgtttgctaaaaaattttaaaaaaaactattatataatccagcaattccacttctgggtatataacaaaatgtattgaaatcagggactcaaagagatatttgtatacccatgttcaaagccgcatttttcacaatggccaaaagtgaaaggaaaccaagtgtccatcaactgataagtggataaacataatatggtacatacatacaatggaacattattcagccctaaaaaggaagggactctggcaatgctacaacatggatgaatcttgaggacattatgttaagtgaaataagatacaaaaaaaattttatgattccatttatatacgatatctaaagcagtcaaaattatagaggcagcagaagggtgattgccagggactgggggtaggtgaaaatagggagttgttgtttaatgggtatagagtttcagtttgggaagacaaaaaagttctggagattggttgcaccacaatgtgaatgtacttaacaacacagaattgtaaaattaaaaattgttaaaatggtaaattttatgttctgtatatttaatcacaattaagaagaaaacaagaaaaaaactcatgatgccaagcaaaatatgtcagcatgttatctcaaaacatccaccttaaccaggaaaaaaaataattttctaagtatcttcaagtgcaaaataagaaacaagtaactttaaaagatcagttagttatcaaatctaactcaaggagctacctgtaaagtcatgcattagtaattaaaagccaaattatctcatattatttcataatggctcatttgacccacatgcctgaattgtctgccctgcatttgggaccaatgaggcaaggaaaatagaaaaggggcccctttaaataatgtgattagtaagtgcatcatggcatttcaggtggcaaattaatgaatcaaaatgtttctgttgcaggttgatatatctacaaatattagtaattgggctcaataattgcattggctaaaaatccctgaagaaaaaggcttgaaagaaacttatttgttttgcaaaggagtaccaaagcaaaccacaggtgatgaaatattcaaagtgataaatggaagcactgaaacaaatattatcagaaccctgcataaatctgtgcccagatgatatagctacaatgacagggagtggtcaaggttgtacatcaagagttcattctgggaggagccaagatggccgcataggaacagctctggtctacagctcccagtgtgagtgatgcagaagacgggtgaattctgcatttccatctgaggtactgggttcatctcactagggagtgccagacagtgggcgcaggtcagtgagtgcgcgcaccgtgcacgagccgaagcagggcgaggcattgcctcactcgggaagcacaaggggtcagggagttccctttcctagtcaaagaaagtggtgacagatggcacctggaaaatcgggtcactcccacccgaatactgcgcttttccgacaggcttaaaaaatggcacaccaggagattatatcccgcacatggctcggagggtcctacgcccatggagtctcgctgattgctagcacagcagtctgagatcaaactgcaaggcggcagcgaggctgggggaggggtgcccgacatttcccaggcttgcctaggtaaaaaaagcagcctggaagctcgaactgggtggagcccaccacagctcaaggaggcctgcctgcctctgtaggctccacctctgggggcagggcacggacaaacaaaaagacagcagtaacctctgcagacttaaatgtccctgtctgacagctttgaagcgagcagtggttctcccagcatgcagctggagatctgagaatgggcagactgcctcctcaagtgggtccctgacccctcaacccccgagcagcctaactgggaggcacaccccagcaggggcagactgacacttcacacggccggctactcccacagacctgcagctgagggtcctgtctgttagaaggaaaactaacaaacagaaaggacatccacaccaaaaacctatttgtacatcaccatcatcaaagaccaaaagtaaataaaaccacaaagatggggaaaaaacagaacagaaaaactgaaaactctaaaaagcagagcgcctctcctcctccaaaggaacgcagttcctcaccagcaatggaagaaagctggacggagaatgactttgaccagctgagagaagaaggtttcagaccatcaaattactccaagctgtgggaggacattcaaaccaaaggcaaagaagttgaaaactttgaaaaaaatttagaagaatgtataactagaataaccaatacagagaagtgcttaaaggagctgatggagctgaaaaccaaggctcaaaaactatgtgaagaatgcagaagcctgaggagccaatgcgatcaactggaagaaagggtatcagcgttggaagatgaaatgaatgaaatgaagcaagaagggaagtttagagaaaaaagaataaaaagaaacaagcacagcctccaagaatatgggactatgtgaaaagaccaaatctacgtctgattggtgtacctgaaagtgacggggagaatggaaccaagttggaaaacactctgcaggatataatccaggagaacttccccaatctagcaaggcaggccaacgttcagattcaggaaatacagagaacgccacaaagatactcctcgagaagagcaactccaaggcacataactgacagattcaccaaagttgaaatgaaggaaaaaatgttaagggcagccacagagaaaggttgggttaccctcaaagggaagcccatcagactaacagcagatctctcggcagaaactctacaagccagaacagagtgggggccgatattcaacattcttaaagaaaagaattttcaacccagaatttcatatccagccaaattaagcttcataagtgaaggagaaataaaatactttacagacaagcaaatgctgagagattttgtcaccaccaggcctgccctaaaagagctcctgaaggaagcaccaaacatggaaaggaacaaccggtaccagccactgcaaaatcatgccaaaatgtaaagaccatcgagaccaggaagaaactgcatcaactaacgagcaaaataaccagctaacatcatcatgacaggatcaaattcacacataacaatattaactttaaatgtaaatggactaaatgctccaattaaaagacacagactggcaaattggataaagagtcaagacccatcagtgtgctgtattcagcaaacccatctcacatgcagagacacacataggctcaaaataaaaggatggaggaagatctaccaagcaaatggaaaacaaaaaaaggcaggggttgcaatcctagtgtctgataaaacagactttaaaccaacaaagatcaaaagagacaaagaaggccattacttaatggtaaagggatcaattcaacaagaagagctaactatcctaaatatatatgcacccaatacaggagcacccagattcataaaacaagtcccgagtgacctacaaacagacttagactcccacacattaataatgggagactttgacaccccactgtcaacattagacagatcaacgagacagaaagtcaacaaggatacccaggaattgaactcagctctgcaccaagctgacctaatagacatctacagaactctccaccccaaatcaacagaatttacattttttttcagcaccacaccacacctattccaaaactgaccacatagttggaagtaaagctctcctcagcaaatgtaaaagaacagaaattataacaaactatctctcagaccacagtgcaatcaaactagaactcaggattaagaaactcactcaaaaccactcaactacatggaaactgaacaacctgctcctgaatgactactgggtacataatgaaatgaaggcagaaataaagatgttctttgaaaccaatgagaagaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggacatagagacacaaaaaacccttcaaaaaattaacgaatccaggagctggttttttgaaaggatcaacaaaattgatagaccgctagcaagactaataaagaaaaaaagagagaagaatcaaatagacacaataaaaaatgataaaggggaatatcaccaccaatcccatagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggagctgaaattgtggcaataatcaatagcttaccaaccaaaaagagtccaggaccagatggattcacagctgaattctaccagaggtacaaggaggaactggtaccattccttctgaaactattccaatcgatagaaaaagagggaatcctccctaactcattttatgaggccaccatcatcctgataccaaagccaggcagagacacaaccaaaaaagagaattttagaccaatgtccttgatgaacattgatgcaaaaatcttcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacgcttcatgctaaaaactctcaataaattaggtattgatgggacatatctcaaaagaataagagctatctatgacaaacccacagccaatatcatactgaatgggtaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagtaacttcagcaaagtctcaggatacaaaatcaatgtacaaaaatcacaagcattcttatacactaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatagtgctgggaaaactggctagccatatgtagaaagctgaaactggatcccttccttacactttatacaaaaattaattcaagatggattaaagacttaaacgttagacctaaaaccatcaaaaccctagaagaaaacctaggcattaccattcaggacacaggcatgggcaaaaacttcatgctaaaacaccaaaagcaatggcaaaaaaagccaaaattgacaaatgggatctaattaaactaaagagcttctgcacagcaaaagaaactaccatcagagtgaacaggcaacccacaaaatgggagaaaatttttgcaacttactcatctgacaaagggctaatatcaagaatctacaatgaactccaaaaaatttacaagaaaaaaacaaacaaccccatcaaaaagcgggcaaaggacatgaacagacacttctcagaagaagacatttatgcagccaaaaaacacatgaaaaaatgctcaccatcactggccatcagagaaatgcaaatcaaaaccacaatgagatatcatcccacaccagtcagaatgacaatcataaaaaagtcaggaaacaacaggtactggagaggatgtggagaaataggaacacttttacactgttggtgggactgtaaactagtttgaccattgtggaagtcagtgtggcaattcctcagggatgtagaactagaaataccatttgacccagccatcccattactgggtatatacccaaaggactataaatcatgctgctatgaagacacatgcacacgtatgtttattgtggcattattcacaatagcaaagacttggaaccaacccaaatgcccaataatgatagactggattaagaaaatgtggcacatatacaccatggaatactatgcagccataaaaaatgatgagttcacgtcctttgtagggacatggatgaaattggaaatcatcattctcagtaaactatcacaagaacaaaaaaccaaacaccacatattctcactcataggtgggaattgaacaatgagaacacatggacacaggaaggggaacatcacactctggggactgttgtggggtggggggcggggggagggatagcattgggagatatacttaatgctagatgatgagttagtgggtgcagtgcaccagcatggcacatgtatacatgtgtaactaacctgcacattgtgcacatgtaccctaaaacttaaagtataataataataaataaaaaaaagaaaaaaaaaagagttcattctgaaaaccatgagatgcaaataatacattgttttattcacagggaagccctcatatgaacaagtttgcctatagatctgaatttcacgtgaatgatactataaaaatggtgagtctaatgaaatccaagctgcatagtcccatcagttttcagctttatctaaataaatggtatcataacatccatttctgatatttcacaatgaagtgcattggctggccagagaaagtattgtgtcagtaatctatgaacaaaaggaagaattgaaaattgttttataaatcattcacaccatgcagatagactaaagaacagttaatgacttttctaaatggtttaactgacaattttgagcatctgattgaaattaattaaaaattaccagaactgcgtgaaaacatataaatgtgtttgacaaagtttatgcattcaggacaaaaatttaacttaggaaaactgaggttaatatgatttaccagtaatattaatcaggactaacatatcaactctaaaaatgactagagaccaatagagaaacatatgtgcaggcttagggaaaatttcatcattatttagaaatactcaatatgatcaagtttgattgtattctaaatccattaatattatcatgacattatatttgtcaataaaacaaaaggcagagcttctagttttaaagagttatcttacccttaaaatacaacttaaagagatcaaattatctaaattcctactaatgatgagagagaagtttccgccagttgaagaataagagatattattgtgccatttgctatcatgtatgtgtgcaaataaactttatttccagtgctgactattaagatcttggttaagatttatatgcattcatttcaaacataaaacctgatattaaaaagtaaagtctgtgaaagcaagctcaagtttattaactttttcaaatgcaatatatgtaaatataaatcccctcctgtttactccagtgagtcacagaaataaagtatcatcagtttccatgtgtgcagggatgcaaaaaatgctgggaaacagtgttttaatatattatgtgcaccgtgcatattcaaaagggtactacagtatgtagcttttcccaaacttgctcagtcgtagaacttttcttgcatgtaacaatggttaatgtcttgtgttgcactggtgttccgtggaacacagtttgggaaaaccgatgcaatctcaacttataattacacagctttccagacagggaaagtgtattgcccaaggtcatggggtaacacatatctctgctttcaaaccattgctgtcttatacgacttccccaaggaggccatctaagtaggatatggagaaacccatcaacaagtccttattgtttttttttcttaatgatgaactttcatcattttaactgtagctccatagcaactagagttgcatttatcctgtggtttcctgccatttgttttggaagcctgttctccttttgtattattaagtttattattaagtcccatggctggtttagattgtatacttccttgtttgttcagtcatctggctaatttggctcaccagagatagtatttttcaaaggctttcctcttcttaaattcatccagaaattggaaatctgaacagccgttacagagttcctcagccctaagattacacaatccctaggtgtgaggtggggatcaggcatcagaattttcaggcttcaaatcttcaatcctgatctttaactcttttcttcttatgctttacataagattttaaagagaaggacgtattccatcccttggcccttgtgacatgtgtctgggagatggagtggcaacaggaagtctattgagctgtgctccctaaaaggaaggtgaagacagcagggctgggttggggaggatctgggctgagatggagatacaaccaaggcttcaacataccccatagggagctccaaagatgggactgcctttgtacgggtccccaagcctttgtacctttgcatcttccagtcactgaatgctggctggtcacaggaaggggcatgaacttgggtgaggcagctttcttctgctgagggtatatataggtgagggctataaaccagccgctgctgggggaatcaagccttcattcttgctggggacatgtggatttggcagtcccacacagtatccaccatcactggagaatttctcttgaccttagtccaacaacccatctcctaatcaaacaattactagcaaatatttggacccccatgctacagcttgagaaacctaaggcctaccttcctccctaagtgaaggaaagtaacactagctgatgatgttcagtgtagtcaaaattcagaagacctggaaaacctggatgctttgcatggcataacccatgtttagttggctggtgccacttactgagtcagttcccttgtcccttgcaatgtgcccccatgtatttctaggagatacagggttatctcatttgggcttaggtatctcctccagccttttcctctgggaactgctgcattcaccaggcacagctgttgccacctccagagtactacagccctcagggtatcaaagcagctggctatgagccctggataccacttcacaaagcatgctgcactctctccctcttcgggttcatcatctaagtactaaagctgtgctgacctgtgcctcagagtctatgtgatatttcatgaaacaactttcagcctttacttcagctctccctgcatgctccctactctcccagctccaccactggactcagatttcagtccttgggacttggctaggagacaggtccaagtgacagttgctgtgctgtgcttcagagtaatgcagtctttgggtttggagcccagcgctgctacttactgggtgttcttagtcaagttactgcaactctctgagtctcagttttcttatctgttaaatggaaacttgatactttctacctcagagtgttggtgggagaattttttaaattaacatatgtaaagcgcttagaacagtgtgcagcacagagtaagcattcagtaacagcacttcttttgagaattggcctcccctccaagcaccaggccacccttgtctaactggctcccctggagctcctgagttccgtcagcagatttctgactggccagcctgactgtcttgctgtactggccccagagatgaaaacagtgcagtcccaacagggaccctgcacctcatggcacttgcgaatggacttctttcagtctttttaggcggtgggaccctccagagctgggcctctggccacccatccacccccaccacacaggcctctgtagctttaattctgcccaagttgaccccttgggagagctcagcagacctcagcagcacctctgaccttgtgacatgggagctccaccccagctctgtggcctcccagacaaatgagaaggcacccggagccccaggtgacttgcatctgtttctctctcccaaggccacaggacagcaacaccacatctctcttctcaatcccccttccctttgcctcatcattgcttgtgcagtgcagtgcatgtctctggagacagagcagagagcaggtttcccactgccccggtaccttctccactggagcccttggttaggagcacctgctttgagaacctgccaagacatgcaatccccctcacacacaaagaggcctctgtgggctattctcaactgcctgtcctctgaccaaatttcagcccagattctgttcctggctgaccttggccaagtcattttacttctctggacctggctgggttacttatccctgaaatatgggaggcgagtaagatgatctcattggctccctccagctctaacagtcatgaatccgtcactgagggagagcagcgagtggaggtatactcatcagaagcatgagttccagtcctgactttgccactccctctccatgtggtttttagcaatccctttaagccttagtttcctcatctttgaaaaacaaacgaaggtcccagcctaacaacaataatgccagtccttattgagacatgtgctgagtgctttacatacaatatccaaatcatcctccaacaatcctatggtacaggtattactatccccactgtaccaataggtagtctgagctgtcaaagttaagcaaattgtgcaaggttgcagagttagaaagtgtgtcaagtcaaagtgcatcaggaatccaatctaggaccatctgcccgtgctctgaatcactatacactgtagcccccatgaggtctgacaaaggcatcaacatcaaagtattttgtacaccatagctcattatttgtctctctttgcattcacccaaaaaggatcctgaacttaagcaacaattcttattgttgagcataatagtgtgtgtgtttatatacacacatacatgcatacacacatgacttgcatagaatgaagtgtgcagattttaggggtacaacttggtgaatttttatgtatgccagctgtgttactaccactctgaccataatgcagaacatttttagcttcccagaaggctccctcacatccctcagagtcaatatcctacaaagggtaactactattttgacctcttattactataggttattgctatcgttttgcctggttttgaacctcatataagtggaatcatcagcaaactttcacttaacactgttaagcagtaagttgtttcttacccattttattgttgatggacattcggattgtttcaggtctttgtctattatgaataacatagttatgagcattcccattcatttagctattatgaataaagcagctataagcattctttttttaactttcattttaggttcaggggtacgcgtgcaggtttgttacacaggtaaactcgtgtcatgggggtttgttgtacagattatttcatcacctggtattaaccttagtacccaattttctctgctcctctccctcctcccactctccacactcaagtagtccccagtgtctgttgttcccttctttgtgttcatgaattctcatcatttaactcccacttataggtgacaacatgtggtatttggatttctgctcctgcattagtttactaaggataatggcctctacctccatccatgttccagcaaaagacaagatctctttcttttttatggctgcagagtagtccatggtgtatacggaccacattttctttatccaatctctcattggtgggcatttaggtcgattccatgtctttgctattgtgaatagtgctgcagtgaacattcacaagcatgtgtctttatagtagaatgatttatattcctttgggcatatactcattaatgggattgctgggtcgaatggtattaggttggtgcaaaagtaattgaggcttttgcaccaacctaacagttttgcttttagctctttgaggaattgccatgctgctttccacaatggttgaaccaatttacactcccaccaacagtgtataagtgttgcctttactccacaaccttaccagcatctattatgttttgaccttttagtagtagcccttctgactgctgtgagatggtatctcattgtggttttgatttgcattcttaatggacatgaacactcatttttactggttgtacacctacgaatgaaattgctggatggtacattacatctatgtttagttttaatgatgactgtcaatagttttccaaaggggttgtaataatttacattctcacatatgagagttctagttgctccacatccttactaatcatattttcagtcctcctaattttagccgttctggtgggtgtagtggtatctattgtggtgttaatttgtctttccatgatgagtacttgtgtcgaatccatttccatatgctactgaccattggatatcctgtgttatgaagtacctgttcaagtcttttgcctacccttttatgaagttaagttgaattatctactttgtattttgatttatagagtttctttaactattctgtatgtgagttcttaggtatctattcagtgaataccatctcccaggctatgacttgcattttcactctgctaatggtatgttttggagaatacaagttcctaccatcaatcttctttttgtggctgctgcattttttgtcctgtttgtctaccccaagattatgaaaatattctatgttgttcttctagagactgtattgtttttaccatttgtatttatatctacaatatgcctgaaattacttttggaggtaacgggtcaaggttctttttctttttcttttttttttttggatgtggatatctaattgacccagcaccacttatgtaaaagacagcccttgcccccatagaattgcagtggcacccttgactcagatcaggtgactacatatgtgtaggcctatctcctaattctctattctgttcctttggtctatttggctatctttgccactaccacataagaaattttggtagctactagtataaatattccagctttgctctttttctctaagatttaccttagctagtctagatccttttagtttccatatgacttctaggatcagtatgtaaattccccccaaataaatctgctaagatattttttgcccttattcttagggtatggtccttacttctaagtgtgacctttccaggggctctattgaaagcccggggtatttacaaaggccctccaccttggcagaacttgaactccaatctttgtgtccctagcaccacccaagagctgaacactctacttcagcttgttctcttcctggtggttatttttgttggcgttccctgagccactgcatgcagtttagaagtcagcaacgacttgaggggattggtgtgcagatctcgggggctccctccttgcagtttcctcttccccaggtttttcactctccaatcccaatcactttggaaacgctaacctccatctccttagctcagcaagatatcactctgctggggctctaatctcaatagaaagagccaagatgggccaggggtggtggcttatgtctgtaattccaacattttgggaagccaaggtgggaggatcactacaggccaggagtttgagaacagcccgtgaaacaaagcaagacacccatctctaccaaaaacaacaacaacaaaacaaaacgaacaaaaaaatgttttttttaaattagggtggtgcatgcctgtagtctcagctactctggaggctgggacaggaggatcacttgagcctaggagtttgagactcaatcatacctcactgcaaactcccagaagtttgaggctacagtgagctatgattgtgccactgcactccagcctaggtgacagagtgagaatctgtctcaaaatgaaagaaaagagaaaaagaaaagaaaacagaagagaaatgaaaaggaagaaaacgaaaagaaaagaaaagaaaaagacaagagccagggagaatgtgaagcttgccttctctcaaagatcatggcagctcaagtcttgcctgccctggtttctctcaaatgcctttaatcagttaggtattttgtccagcttttacagttgtttgagcaggtaggagttagtctgatacaagctactctgtcatgactagaaccacaatggtagttttagttgctggtttcaatcaaatgtttggccatctggaaggtgtctgagttgtgacatcatggtgcagtttggcacttgaacctctaagcaaatgtttgcctctcaggctttttctcagctctcattccatcaccaacaatcaaatgcttacagggaaaatgagagtgagcctttgtctcggttgatgacccatacgtggccgggctcaccaggacacacctgtaaagtggtcagattgcactttcttgtggaagccagtgctaacactcactgtgttcccccacataaccactcctctcacttatcagcgtcctctccattaggatccactctgcctggtgcacacattgactcttggttacctttgattcctcccagttccctcccatctcatcagctgtctgggcctgagaggttttctaccagtgtttcctctcccttgtttcagctttactgtggctcatcagtgcaactgtaacaccgaagacccagcagacccctgcttcctccctctcctgcacatgaaagccccagatgtcagcctcaacacgcatccctcattaaatcctccaatccttctctgttgctgcctgaataaagtgcaggttccttggcctggtgttcaaggcctccttcccaaggcaccccagcttgcctttcttacctatttcccacgtccctccgacccagccttacagtcgattgccccacctaaaacaaaccattccctgttttcttaacacgccttacactttctcaccctttgcctctgcccatgctgtgcccaccttctggaaatccctgaccccgtctcttccctgtccttcaatgtggcttttcccacaaatctcttactcagctcatttaaatgtggtgttgttattcacccatcattaagccactgtaacactgaatatctatctttctaatgccagtctaccttgcattaaaatcattatcatagggtgggaacaatgtcatcccccacaccccataacctatgccaacccaacacagggccttatgcatagcagcttcacaatgaacattagaagaccggattggtagaatagaaacaatggcttaagcataccccctcatctctgcagtcctggcaacatgcacacatttaaggatggaccctagagtccatggaggggtgtattttattgggaggttgtaataggtgggagacttggcagaatttaacttgggaaaccagaattcacatcttagcagatctaagtagaatagaatgattcaggcccttgacccttccaactggccaccaccactacacggtacagaattccagatggttccttaaagggttttcagtggcccttgtccatattacccatgtgtccctcatgtctgcccctcctttgtgggaagagtccaggaggccctgggagacaggtccacctccacttacccacacttagtttctggctctgcaaaacagacaggcacaacccctccctgtacccagttccacacgcccacctgttgtcctgtcgcatgttaataaaaccatgtcttttttaataccccagccatcacttccagactcagctctaattattttaaccaccacaaaaccctcttcaacaaaagagcaaaccaattaattttcccttatctgaggtgaggtcattatggattcctccaggaaagacaagctctgggtattgggaaagaaaagggattttaggactccattgtcatgtctaatcctcctgctcaaatgaagcttgttttcttgtccaacaaacaggtatttacttggaacttaaagtcatttgagcacagggtcctccggcagaattgcaatggtgataattattcaactgcacttctgtgtaatttactgctctgtgcagcgcgtgcatgcaggcaggcccagaatgcaaatgatatgattgctttcattaaatcatctttttatgactgtataatttcagtaattaaaacctttactaatatattctatgaagcaggcagaatgttacactaatgtatggcccttattaatttttgaaaaacaggggtgaaatttgaataatctgcttcctcacacttaagagctccggaaagaaaaaaaatacaattttgattaatgtaaactaattagcattcattgttttttattccctcttccttacctgaaaagtcactgcagagggtattagcattgcctattgcatatttcaaatcttatcttatttctggcatacctttgggttttttgccaaaaaagaacgagggagtttgtaggtctttaatcactgcagttacagagtgagaaattgaacatcatctgctactctcatggtacaaagggctcggcaagttctctagtgtggctcagcagacatgactataggcctcagaaagttctaggagctcttgttttcccccagcaaaaccttcctatctcctaaggaatgttggctgtgcttgattttttaacatacctgtgggcacaggatcacgtgcatgcctgtgcacacacaggctcaaccaaacacagagcttctccttggttgctgttactgaaagattagtaggaactaaaatttggaatacaaatagttccaattagatctcaaagcaagcttcatgccctgtgttcatcttccccatagccaggtcaaatgttcatgctttatagtagcagcttcaaaaagcacactgggatgtacaatggctgaatttaatttaagtcttagtttaagaaatagctcctctatctgtaatgcatgtactagtgtcccttctgaaaaaggataatttccaatatggaactcaaatttcattacaagaaactccaaaggggatagtcttctgtttgcaacaaacatttaagtaagcaagtaattagctagtttgcacatccaggtattagtcagaaataggtatttttgacatccagattttgttatactggtgtgtgctgcaattcagtacctatcatcgctaatatcagcgtttttcaacaattttttttgaatttcaaatatggccaaactccacgctgagctcaggattcatagccatccatggctccccattgtcttacaaaataaagtccactattcctttttttttttttttttttgagacggagtctcgctctgttgcccaggctggagtgcagtgacatgatctcggctcactgcaagctctgcttcctgggttcacgccattctcctgcctcagcctcccgagtagctgggactacaggcacccgccaccacactcggctaatttttttgtatttttactacagacagggtttcaccatgttagccaggatggtctcgatctcctgaccttgtgatccgcctgccttggcctcccaaagtgctgggattacaggcgtgagccaccgggcctggcaaagtccattattctaagacctctatgatctggctgcaaacctacctgtcttggcattatcttcgctgctcgccagcatttgctcttgggtctgcttgctgcttctgatacacacgttgtacttaaccacctctgctgctcttggcgctctctcctcctattaaaaggccttgttccctggtctctgcatgtctaaatcatctcctccttaagacccagcacaaatgtcttctcctctttgaggccttaccattgttatctatgtatttatgtctgtgtctcacaggtactgggtgcatgggaaataaaagttgtcttattatgcaaattttgactgaggaactgacccctaataaaattagtcccacttgaccctggttaacaccagcactcgccctactcagcctctgctgatcagtttttccctgatggacggctgccacagacagctacagtataatgcacaatacaatgcaaattgattgcatagttcaatgatggatcttgggaaagataaggaatttcatgaagtcaataaaagtgacgttgatctcatgataagtcactgacacataatagttgaagaagagattatcaaagaggatgataactctgagttttagaaaacagtgaattgaataccaaacaattaggagaggctcttgaaaaatgaataaagccttcaagtatttttggggaaaagacagcccttttgatcaatctgtgaaagtcaaaagtgaggtgaagaaggttgtcttatgcgaaacttacacagttttgactgacagttatgaaaaaaaatctctaatcaaccctggattcagttttcattcattctaaaaatgggtgaaaatgtgtaattataacttaatttgtgttaaatcaaaaatagaataatcttattcatagtttttactttatcaagacaaagtcccaatcaaagtgttgtcatgccatttgctagtaaatgccaccattttcatgagcttttcttatcaccaattatccttggataacaaggacctctgatgacatctcttctctctctgagtaacctttcatctttatctgcacctctcatctatgcacttatatcagtgatttatgaaccagtatcatctcctcaccaggctgaggcaagacctgtgctttattaattggaagctaagaggggcctttggtgtcaggctgcctacaatgaagactcagctccacctccttcaggctgtgtgaccttggacaagttccttgccctttctgttcctcatttataaaatggggacaatacaaatatataccttatgaggttcttttaaagactaaattatataatagacataaaagtgcttgaaaaatgtctagcatatgttactttctcaataaataccaactatctttaattttattatttccatcccctgaaatgcctggagggaaacaacttttaccaattcctaaaggtttctctcacatggaaacgtaagactcctatcattgtcttctgccctgcaatttgcttaaccgtaggcaggaaatgtgattttatttgattagtgatttggggaagaacaaactgtgcatacttgcctgggcccagctccttcctttttcctcctgggagtcaggggctcactgatacatcactggctttgcttttgggagggggcctggggacacccagcaccttctgcaactaggtatgtttgataagcccatttgctcttgctacaagatacatctttcaaccaagatttgatcagtaataatggtcatattttggtctccatcagccttgccattgttcatcttatttttcaattagttcagaactggaatgcagaaaaaaatgttgtttatggtggggcagagtctctctaagattcgtggctggtatttcagttactgtttgccggataaatgaataaatacaggcatacattctagattccagttttgcttctcaaaacattatttttctgataagaaggactacaagatagcaagcaaaacttttattgtgtttaggtccaataagtcctattaaaggattagtagaacatctatcaaacatgcttctgtgtgcaactgaggatcacccaaagggaaaaataataatattgaaaatacagtagctggttcctaagtctcttttccaattgtcatttcaactcaaagacctagagatgccagctccccatctgttgcctcaaggatgccagctctgagcatacaatatgcttcagatctgacattttctggccaaaaatctgcttcatgaataaagagaccagtgaaacggtcagcccctgcttgtggtttgatcattattgacattttatgtttataaaacttctttctctcattggaactagctctgtttctctctcagacactgcattattccttctacatgatcctcacccagcctggtgctcctcattgcccactgtcccccataccaggctcctgacaccctaaagccaaggccagaaagagcccccagcctccactcctggtgctgctctgagcacctgtccttctggttgttggcaggctgtggcgggggtgccacctctccaggttgcctttctcagattccttctggtctgctggccccttccaggctgacttctgacagcaccctttacaaaccagcccagcccacatctgagctctgtgcctggcctgcctggcccactgctgaccctggtcaccagactcctaatgcctcagccagtcctgtctgtcttctctggctatgcattgccagagacgcctggccctggggcttattgtcctcttgtcctgcctagtgccccttactccccagggacacccatgcccaccaatagcctcctatacagcaagctctctccctagtgagatggtcttccgggtccagtggtgcctcatggaaggatcattttgtccctctgatcatcctaccaccagccttctccagctcatccttaggtgtgtaagagaatgatctgtttcagcctcgctttgtccctggcctgtgctcagctgcactgcccccgtcaggagcccaccctgagcaggtcagggagtgttaacaacctcatccccccatgatcagtgggctccagcatccgtcttgttctccaggctccagttctgagctgtgagtgcttcctgagtcaggcctccccgtccctacttcccatgtgggcctcgtctagggattacaggtaagtgctctatcttatgccaacccctatctgctggtagtggctgcctagactgtaatgttcagactgttcctgggatgatcaggaaagaatgaaatgatcaattagtgatgtctactgtggcagcagcagtggagagggtctatatgtggagtgtttgtcatccatttgacatagcttctacctcagtttccctaagtagctcatatcctcttctgattcttaaagtccagcctgatctctagctcacctcactggagccccagtcccttccatctgtcctggggaagtgacctaagtgcctgtccctcccacccctggctaggcccctgccctcaggggactgatcttggaaccatgtcacagtcactgtgtgcccaccctcaagtattctggcatgttcctcccccctaccaccatgtcccactgcaaaacttgacactgattcaaaaccatatctggataccactttataccattcagagggtgagaatcaaaaagtcagataataacctacgttgtcggggatgtggagaaatcagaactttcatgctcttctggtgaaatatacaaaggtgcagctgctttgggaaagattctggcagtttctccaatgactaaacatggagttgtcatatgacctggccatgcccctcctaggcatgtacccaagagaagtgaaaacatatgtctacacaaagacttgtacacaaaggtttgtagcagcattgttgagaaccaaatgatagcgacaacccaaatgcccaacaatggacaaatggatgaaaaagaatttgctatatccataagaataaaatacgacatacgctgcagcttagatgaaccttgaaaacattatgctaagtgacacaaaccagtcataaaagaccacatattgtatgattccatgtatacaaaagtccagaatttggaaatctatagagacagaatgtagattagtaactgcccagggctggagaaggaatgaaggggcagggtggggaagtgttgttgatagccaaagaataccagatttctctttctggtgatgaaaatgatctaaaatagactggtgatggctgcacacatctgtgaatatacaaaaagccattgacttgtacactacaaatgggtgaattatgttgtacatgaattatatcccaagaaagttgttttaaaaaagaaataaacaggccctggtgctaacatctgcataacccaagtctggggtactggtgggaccctgtctgccctggactgggttgcatctcctactttatgcctgagggacttttgcactcaacaccatccaactctaacctcagttctcaggagtgcaaatacagacacaatcataaaacacagccacatagagctgagaatggattccatgaccttgggaacaatgaggactatcagagctgatgttcctctcctgttggaaatgctcttgcaactgcttccaatgaaggccttggctaagcccagtggcttcactccctccccaaccccagtctcctcgagaggatccacccagagcccctccctggtcctgcccattggctcccaccttgtttgtctagtgctggtcaccctgaggggtctctgctgtctcagagacccctcagccaagccattcccagcagcccctcttcctccccagcccttcaacatggccaccagccaaggatgtctgtcttcatttgagtagactggaagttacagagaaaaagaagtggggaggtgaagacattccaaagatttagagctgtgtttcccatacttatttttcatcatcactcccctaggaactatttcagacatttttatctggctgtcaaggtcccagcctcccataaagtttcaataccacagatgtactacatatctgtttagggaccataaccctttggagggccacaaaacattggctctttttgacccccaagaactgattttgtcccctaaggaacaatatccccactgttaagaatgtaagatattgtagaggggtctcctgggactcaaggccacaggggtcgtaggcctgaggaagaggccataagaagaagaaaacgcacttctgcttctctcctcccaccctaccttatctgtttacctgcccaattcttctctccgtttctgcaaagtcactttctttgcaatgcagacacatggaggaaaccttgctcgtttctccccagtatttacattcactctgttcaaggatccatcccaaacagaagctggaatcctttagccttgatcccatatgctcatggaaggaattcccctagccaaggtcagagactgtgtccactcctgagacaatcaatagggccagtgggcagggtcattttgtgcaaaaacatctgctagcaatctgtcactgctaccaagtggacagagaaaagcaagtcctaaaggagggacatgatgctgccttagaacccagttcctcctgacactggtcttttcatagaccccttcaaaacctcacttgggttttggcttcgtttcctccacccactcaggcctgggcctctcccagacaccctcaagtcaattcacaatcaacaggggcctggagggctgttggctctgacacaagcagggcctggtccacggctgagcttggccaactgcctgtctttcctctctgctaatggtcagtggcatcatgtggatttcatcttctctctccagccccagctctgaatctctgatgtaagccatttccttctggcagattcctaaagaccagtcctgacctctcccaacccactctgcacaggtcccttacagccaactgtctttcatgcccagatgttgggcttgtcttttacctgcatgtaacctttgtgctgcccaccaacccgcagctgtccttgccttcaaaaatacaacctgaaagcaactaccctttcctaaaagtttccccatatccaccctccatatcagtaacacctttgacgcatacatatcactcattatctcctgaggtgaacactctcaccttctctcctctgcttgactgtccctcccgaggggtgtcccatgctcaggtggctccacacgcctggcacccactgccctgtggtgctctccttttgtcctgattctttcaggtcaccatgctttccaaggggccacagctgcaggtagtttgcagagaatttgagcaaaatgtcctccaagccagaaactggtgagacggtaagaaatgccaggaagtacatgaacaactcagttctttcatcccagagaggtggtagctgtgcacttcatcatattctgagctctcaaaaccttgataccccaacttgaatgggaaaagtgggcccttcccagcaggggtgccgatgctcacttgtctcttagttttttatattcagtttgtaggagccagtggaagctaagcagcagtgggaggtggaaacagatgcagtcacctttagaattaagttttagcaaagtagcccttgcctgcatagccaggcaaaaatggtcatgatcagataacagcaaatccttccttccaccccagcttcacaagtgctgtcagattcacaggcagctacgtcttctcatgaggggagcaataaatggaacatgtgcaaaatgattttatcaagagcctctcagatgatggccacagaggacgggactccaagatgtgagttgaagcccacccttaaactttcaatgtgagggcaaccccttccttgtcctcccagtctctgccgcatctcctgcctctgtttctctcccttctgcctctgcacaccgccttcgtctgctctgtcttcatcttggtaacccccctaggtacctctcaatgtggctacctggccctcaaaatgcccccttctctgggaagacacctaaaactcaaggtgagcccccaggaattatttctgcccatgtgatcttgcccctggttggaactgattgtcccaagggtagacacctgacccaagttgagccagccggtttctcatgcaaatttgaactcagaaagggaagacacaatgaatagtttagaacgttagtggcagcccaggagatcctactgctctgtgtctcaagctgtctcagttcctttctttcctgggtcagctggaattatttaaccttactaaacgtttgcttaacagttagagtctgtcaaccagagacaaaagcactatgaagctaacagaaccattttctccatgtctgtattccagattcccccacaagagaattggattggctcaacctcacctctggaatggtttctcctgggccagtgtccaccccaaggccaatctgctgtggctgggtgagggtggggtgcagagccccttagaaacttggctacagcagcctatccttaggagttattgggggcagctcagtgctgaggaaggaagacaccttttcagtgagctgggaaagtctccccatgaaggatctcccacggtgagattaggcagggggccccagcacagatgagattggtagagaatctgacctgcctgaggcaagagctcatgatgaagattagtgagagtccagcctccattgagtcatggaaagctttcctgctgcagatggaaaggtttcctagaattctgtctccaatcaactgcaaatcttctaacgtgggagcattggtaccttatggccgcagagacgtgcgattaaggcagaggatggctgtgctggctagcatgtttccataagagataacttattggttattcagaggtccgtccaaagctgtgagtctaattagctctaatatcctctttgcagcaaaacctaatgtgaaaacacatttggttaattagccttgtgaaaataacgctccccacttctgccccagcctccaggtctcttcactaggcagccagagccacggcgtcctggggagagccaaggccctgactctctaataacacaagtggactcctgggagcccttgctccacccctggactccagagaattgagctgtttcttctcatcctctcctcctctcctcctggctgagacttgcagagatggatagcagcacagtgtctgacctagaagggccactgcgaagcacctcttcatttgattttatctatctatccattgattgatccatctatccattatctatttttcttgtggtacaacatacaatttaccctcttttttggagacagggtctcattctgtcatccaggctggagtgcagtggtgtgatcatagcttgctgaagcctgaactttctgggatcaagagatcctcccacctcagcctccctagtagctggggttacagatgcccaccactatgcccagctaattttttattattattattttttgtagagacaaggtctccttatgttgcccaggctgatcttgaactcctgggctcaaactatcttcctgcctccacctgccaaagtgctgggattgcaggcatgagccaccacacctggccaaatttacccttttaaccatttgtaagtatacaattcagtggtattaagtacattcacattattgaccaaccatcaccacaatcccacccagaaattttttttcatccctaacagaaactctgtatccattaaatactaactgctgtgtaataaatgtagaattaaatataaattccatgttatccactcctgatatcctagcccctgataaccactattctactttctgattctaagaatttgcctattctaggcatttcatataagtggaatcatataatctttgtccttttgtgactggtttatttcacttagaaaaatgtcttcaagttcatctgtgtggtagcatgtgtcagaatatccttccttttcaaggctgtgtgtatataccacagtttgtttatccaggcatctgtggatggatatttagattatttccatttttgctgtttgtaaataatgccactgtgaatcttggtctacaggtttattaattttaatgttttattacacaggtagcccatgcttattgtagaaaaattagaaaatgcagataattagaaaagaaaagcaaagtcatccttaacctcatcgtggagaggtaacactatgaacattcagtgtttgtccttccaaatgttctctcatactccttcaggctcttcctacatctagatattcatatagatgtagctatatttgtaaaccagatagaagttcactaaacatatcagtttttgaaaactactttttaaacttattttatcatgcatgacatctccatgtctccctcttcctctctgataggtaggccaacctgaatagatacagacagtgctacctaagctaaaagactgcattttaatctattgtgcgggtgtaccattatgtgaagtaccagcatgtaatttgctagttttgcagggttgttggacaccgattattttcaatgttttgcaattacaagcaacgccattgtgcatccctgtagctgagtcattgtgtatagcctttagctattctcttaggataaattcctaagcaaaaataattgagaacatcctcattttacaaatatggaaaagagtattgatgtaaagtgacttgcccaaacttccatgagcataatttcatcattatgcagtttatgtcataaatgcaatgtatgtttgcagatctccttttggggtctatcaggagccaaaatcttcatatttactgatcagagccccctaccatgctgaccctcctgagcccatcctccccagggtcactccctggatccttccactgctcccccttgggagctcagtgtgtgccagggtttacctgatccaccagtttacactgtggtgaggtgtccatggttactgggggtaccccttcagcagagacagcattgactaaagattcttggagggtgcatatatttaaggcaaggataagcaaacccagggatttggtttctggaatttcgggcatgcttttattgcactgaagtgtgtgctcaataaatacttgttaaaataaaaaggaaggaagaaaaaaagagggaaagaaggaagggaagcagggagggaggaaacctggaccctaattccgccccttcctagtcttgtgcccccatacttcaccccactgttgccccacctttcccccaagttgagttaaaatgggttttcctaatgaagagactgccagggaagggagacagagaatcagctccgtctctttccgaagctccacattcattaagccatgagcttggaagtgcagagtgatttattggactctgagcagccatcagttagagcagcatgatgaattaagttggtaatgcattgaaggcaaagccctaatgcactatgaggttctagcttggagaatttatggagataaaattgtaactatagaaggaaagtgggaaaattggcctgaatgtgggagaaaccggggagggaagactgactcttgaggtagtccctacacccaaacaacttccccacaggccttttgctgatttaaacgatccatgcccaactggcatctgtgagtttgtaccacacagattctaaatgacccctgcctcccagcagaagcctggggtcacataactgcagtgtctgatgagcctggcacccctttcatgtggcctccaccacgaaaggcaccatgatgactcattagactcctcagcagactgtaaacccctggggggcagacaccgtttctcccacaatgggacacaatctttgttccctctgtgtttgttgaagaaacgagtaattcacacttcattcatttactcgataaatgcaaatttgagtcacttacaaagtacctataacccaaagctgaatgtgacgatcccacaggaaggtgcaaagagctgtgcaggttcagaggataaagtaaagatcacaccggggatccatgaaacctacatggagaaggtggcattgagtgggggtcttaaaggatgggtgagatttcattcagtggatgtgaggctggaggacattctagatcaggaatgtcatccccttgagtctaggctatttcagtagaattgttggagaaatgaaaggaaggtagcctggatccagaatgtgctctgggacatcctgtatatgatgggacagaatgtttgaagttgctacaatctatcctaattatgtatgaattcacataggtacagctgtgctttacagagatgcagatttatatagatatgtattacatatgcgcgtgtatcatagtttacaaagagctcccaaacagctctagagaatagttaaatttaattatatccatgtcacagatggggaagttgaggccaagcaagctaaagtgacttgcacaagaagaataagcagccccaaacttctttaagcccattgtcctgcacaccttagcacacaatgcctagcaaagatgactgaaatgagcgcaggggacaagctaaagggtgtgtgtcattgtccatgtgtataagccagccaacaaatataggtgcaacatcagttccaactcaaatgtcattggtgcctgtccccacttactcaaccaggtcctctctgtcccgttacacccaggagcccccatggttgtgcaccagcgcagctacactctggcctgtctgttctctccaacactagccctgctatcagcatcctggcttccaactctgtcccagcactttgtcatcctggggaccccgggagcctgctttatgccctgagcctcagaggctctccctctccccacagtcccttccccacagctggcagaagttcttgggccctgggtccaaagcacaatgtccacagcagttaccacacccctctccctcccatggttcttctcttcattaccctattccccttccttcaggccccttacccacaaatgaatcagcatcacagagagcctcctccctgtctctcatcaagcacacctgacagtgacttccaggactgggcacgacttaggcataaaccaggacttcttgggggtgtgtgtgttattaatggatgtttacacacacattacaatcccaaattaaaagtttttttttaagttggctgttgttactcaggatacaacttccccaagaacagttctaataattagtagtcaggccttcagaaattcatttaatctataatgctgaactatagttaaatattgacttagtattattagtatggatttagtgctgactcctgggatcaaggaggcagcaagagaaaaggagaaaaaggaaaaggaggcagcaaaggaagaagaggaggagagggaggaggaagaggtagaagacaataaggaggagaaggcagaaaaggaggagaaggaggaagatggggagaagggaaaagaggaaaaggaagagaagaggagaaggaggaggggagaaagggttgggggacccttcctgcacccctctccagctataccttgtgcccctcaggctctcacagcaaaccttggaagtattgtctgtagacattatttctactttctcgattcctgtctcttctcagctgactccagtgagcgtgtcatccccagcactctgctggaactaactgccccgtcaaggtctccaatggtggccgtctggcccacgttcctgtcctcatcttacctgacctcttggaggcatttgacattactggccaagccttccttctggaaacaatttcctctctgcctcacttggtacatgccctgacagctgctgttcttcacccctccctgcaggcacacctttcaccaagtgactttgcagctcctcttatcaaagaggggcgtctatttcccactccccttaactttggtttcgcagtatgacttgctctgatcaatggagggctagccagtgtgctgtgactaaagacttgaaaagtctctgctgtctcgcacctctgccatcaccatgagaagaatccactggtcccgggagaaaaatgagagatgtgcacggcagaacggagccagcatggatgagccaaggcccaactaaaccagactggtaagtgaagtaaacgctcatcctcacacatcatggaggtttgggggttgttttttacacaccaagagttgacaattactgcttccacagaaccactctcaacttctacctcattgccagccattctgagctttctttttgaccccctacctgccaccccaggcctctacatcttgagaaaccccggagctctgtcctcagcctgttcctcttctttatccacagtctcctcccaagtgagctcatgcagggtcgtggctttaaactctgtgctaatgactctccaatttatagcctggcattctcctgaactccacatcagcatggccagctgtcttaatgtaaaaatctcaggggaggaacagccaagagcaggctggaggatgtgcagccttctcagatgccttctctcatacccaagatggccaaaatctaatagctggtcctccacctaacccctccttccaccaaactcactctccacacaacatgtcctgatctcagtaaatgacaccatttagtggctcacatgaaaaacttgttttcaagttttccttcctttttgtcttccctcacacccatactgaattcattgttagtcatatagtctgtacctctagagcctttcgcaagtctgaccacttctcatgatcatcagcgctgctacatcccaatacaagccaccatcaccactcctggtctctcaacctcgacccttgcctgctgataatccatatttcatgcagcataatcacatctctccctttcagttttcattaggattgaatatgccctgccctccttcctggggcctgccagccctcctcgctgtccgtcctagtcttgcctcctgctccccccggccctccctcgctccctccctctgtccctcagctccttcacaccctccagcctgctcctggctgttcctccccctagatttttacatggtggcttgttcctcctcacccacacctccacctaaatgctcccgctacgagtggtgctccctgactaaagtggctccccatcccccacctcattgacctgtattctgtccctgcagcatctgccagtgcccatggtacccatggactttactcgcctgttgcctgccttccttcatagagtgtaggaatccctggagggctgccctaaaaatgggccctggagtatcatttttgattgataggaggaggaaggagcggaggggaaggagaagaaggaaagagaagagaaaagagcgatggagttggaggagtaggagaaagtgcggggaggaggacaagggaggggaagaggaggttctcctccttcctgggcacgaggctatggcttccagcctcctcttctgtccctccctgccacttactagaagaaatctgcccaggccccggagtgacccaaggtcaccacgttccccgcagtggccccagtcagtccttcatctcccgcaggtgctcgtgcattccccaagcgctccctcacctgcccatgctcagccccaatactctccatactctctggtggaggtgaggaggtagcgggggtgaggaggtgagagggtgaggaggtgggggggtgaggaggtgagagggtgaggaggtgagagggtgaggaggtgggggggtgaggaggttgggggtgaggaggttgggggtgaggaggttgggaggtgaggaggttggggggtgaggaggtgagagggtgaggaggtgggggggtgaggaggttgggggtgaggaggttgggaggtgaggaggttggggggtgagggggcgagaaggtgagaaggtgaggaggtaggagggtgaggaggtgggggggagggggttaggaggttgggggggtgagagagtgaggaggtaagagggtgaggaggtgagggaatgagggagcgaggaggtgtgggggtaaggaagtgaggaggtgagagggtggggaggtgagagggtgagggagtgaggaggtgagggagtgagggagagcacaagctgagaaaaccaactgcctaggtcctgcccagggcgacctctctggcagagtcgccaggcaaggaggacaaaataaggcaatgcaacacttaaatgaatagtcaaacttgccccaaatcacaatgcagaccttccggagccaggcgggatgcagagaggactcctttctcctcaacaagggagggctggggaaactcaagtcaagcagatcaaagagtaatttgcctgctttcccaaacccagacatcagctgctgccgttcctatgtgaggaagggtttaccccacagccgtgggaagaagggagcagcaacacttgtcccatgttttgggggtgagagggtaatgacagggagacagagggcctggggctgaaccctccacactcccagcctcagagaggggccggagggcggtgcccacaccctgcaccctcacccgctcactctttacccttgtcgtgccccctacttccctccagctttaacataagaatcagaccaagcaggcagcccttctcctcttcgagagtgaagtgacatgggagaggaggcaggagccaagagatgccttgctcacctggctgtgggccagggaaggtctccttagcgtgaggcagccctgctggaactctgttctggtgagtggctctcagctcacctgcttgtcgcagctctttcctcttgtccgtttctgagcctgcatggtccctaaaagcttagtcttttcaccacgtctctctggatagcagcagcagcctccagacagcctgcagactgcgtgtgtgtggtgtgttgtggggtgtggggtgtgtgtggtgtgtgtagtgtgtcgggtgtatgtgtgtgtctggtatgtgcgttgcatgcatgtggtgtataggaatgtgtggtctgggctctgtgtggtgcatgtgtgtgagggtaattttgtggtgtggggtatgtgtgcactatgtgtataaaattgtgtgttggtggagggtgtgggttggggctgtgggatgatcatcactggaaggtgaaccgcagctccatgataaccttttgtgcatacacgtcatttgtaattagccaggtctggagagttcgaaactgggagaagagaaagaagagaagagagaaaaggaaaattaatgaaacaagtaacctgccttatatggatatttgatttgcttgtttgcacattgtttagtccttacaagctctgaaaataaaacacaagcacagtatcaggctcaattaggtgcttaagaaataccttttgatgatgacaaatggcagggatgttaatgacactgcttccctccagctcctgctgcacagagcgcccttggctcttcagacttacagctctttgcctgagctgctgtgagcaagcctctgctgcccacaggagatggccctgtgggcagggcctccctgtgtcttttcaccttttgagacaaccccatccacctctttgggcagcagctcatagcaggtgctccctgaacatgtctgcctttgacttgaaggggtcgggacgccgcttgaggatgctaaagggaggcagctcattgtaatgccttcacctccaccacttccaggaactcctcctctccttgtggatctcagggctcatacggtttgcccagagcccaacagctacaagtgcactcaaacagaacattcctccgtgcgtttgctcttgcaaaatgtgtgttgggggcgggggcggtggctcatgcctgtaatcccagcactttgggaggctgaggagggtggatcacctgatattaggagtttgagaccagcccggccaacatggtgaaaccccgtctctactaaaaatacaaaaatcagtccagcgtggtagcaggtgcctataatcccagctacctggaggctgaggcatgagaatcgcttgaaaccgggaggcagaggttgcagtgagctgagatcgtgccactgcactccagcctgggccacagggtgagactccgtctcaaaaaaaaaaaaaaaatgtgtgttggatcccatggttcccctgctgcccaacacaccgagaaccaaacgcacacttgcacgctcgccgtggggcctcagtcacctcctgactcccaaacacacagctctcactgctgcctcccgtgctcccccaggccagcgctggctctctcagtgctagtatctttttataaggataccagtcgtgctgcattagagcccaccctactccagcatgacctcatcctaacttaactaattacatctgcagtgacccaatttccaaataagttcacattctgaattactgggggaatagaatttcaacatatgaattttgaggggacacagttcaacccattactgcagctatccacagaagaaagtccaaattccttatgtggcattcaaggccctctgtaatccaatgagatccacgtttccagctgtttctcttcttcttctcccctaggtgcacacatgtgatactgttttgtatcaaggcaggattctgagattaagtgaagaaaggggaacagttaggagagtagcatctgctgaatgtttactaaatgccaccgtcaatgacaagtgtgttttatctacgtcactctacttttttttttttttttttgaaacagaatctcactctattgcccatgccggagagcagtggtgcgatcacagctcactgcagcctcaaactcctgggctcaatcaatcctcccaatgcagccactgtggaaaatggtataactttctcaaaaattaaaaatagaattatcaaatgatccagcacttccacttctgagtatatacccaaaagaattctaagcagagattcaaacagatatctgcacactcatatttatagcagcattattcacaatagccaagaggtgcaaacaaccaaagtgtccatcaagagctgaatggataaacaaaatgtggtctatccatacaatggaatattactcaggcttgaaaaggaagaagattctgatacatgctacaacatgaatgaaccttgaggacattatgctaaatgaaataagccagtttcaaaaggataaaaactatatgattctacttacatgaggtacatagaacagtgaaattcacagagacagaaagttgaatggtggtttccaggggcaaaaaaaaaaacaagggaagattcacactcccttgcaggtttctctccacagacctcaccaggtgtcaaaaaaagagttctccaggggattccaatgtctgccaagctgtaaagccatcggccttttgggtagttatcttcatttcttctttggggagaagcttgattttctgtaagctgcagaagatagctcaaaccagcagctcagccagttaaggggacggaggctgctggtctgcatccttccaatggtctttcgtctccctttttctcctaacttaaagctttcatgatggagaagtcttccctgttgtctgcaattttccttctctcaaaacaaccttctgaatcctcttttggggtggggtttcagatgttgtgaaaccatcacatgcttatgaactagcagacatacagcaccggaagttgagagggtggactgctattagactgcctgggctgagtcctgagggcacctcttgcttgcttgaatgacttcgggcaagttacttcacctctccaagatgtcatcggggctcatcaaagtacccgccccatgaggtctccttgtgagaacaacatgagaaaagcctgtgcaaaatgcttgcctgccacgtagaaaaaaagcttccataaatgttggttcatattgtgagctttcaaatcaaccaagtgtgaataatttctacttcattccattggctatggcaggggaatacaaagatttgtcagagccatttccagcctacaggagtttacagctatctgactttacagctacgagtgccgtgagagagctacaaacccaatgctgcaggtgttcaaagtcagagatttaataaccacggagccgggaattagggaaagcctaatggtgaatggatttaagctgaccccggtggaatatgaagtacaaagctgacttccctgcaactctgtctggtgacatccttttctttttccaaagagatactcaagactcagagagattcaaaaccacccaagggtcacaggtggtttatcaaaacccccaccccaccccccaaatacacaccaaaaagctaggtttaataatccatgactcagaacctggaaggctctctgcagggctgaggggcctcgccggctgtctatgactgctgcccgcctagcaggcactgacccaggccccaggctccaggacagtgtgctgtcagccagaggcagctgtcagccagactgctcccctcctctcagcctggcaggggtactcagggtagttctctctgttggggaccctaagcatgaaacagtattggaggaggctgtgctgagaaacccactgagggaggaaggctgacggtctgtgttcttctagtggtctctcttcaccctttgttctcctagcataaagctttcacgatggagatgccttccccatcatctgcagtttttcttcgctcaaaacaagcttctgagacatctttccggggagctttggtcattagagcttgggagagggaggcccttctcttccggtgtcctcacagggtctctgtcatttagattcttgttgaacaactgggctttggagggggttggaggagacagtgagtgatggtgctggggcccagggccattccaagcagaagaaaggcactagcaggggcatgaggcaggacagcccagggcatgtgtggacatctgggaagagtctgtctatattctgactaggaagtgtacatgtgaaggagtgagaggttagacttgaaagatgagggtaggtgtgggccagactgcagagggttgtccttactgcagtggatcacggggaaccatggaagcttccagaacaagaagtgagctgagacaacaactgtgacatatagtttgttgagtgaatgaatgaatgaatgtctgaggaagacacgacagtggcaggaggggagagtcccctacaacaagccccacagccctgctgcatatgcttaggtaaccagtgtgaactgctctgcaaattcagacctcaagtaaagtcatatctattctattttttacaaatgaaaaataaagccagctcagacctacatgccagaggaatgagaagtccaaaatctctctcctggtactccctgtatccctccctgctttttgctgtcagctgccgttgacgctggtcctctgagtctaagacagtgctgactgctgcccaggtacaggcttccttgatctccaagggaggagtgtgcccacatagtgctccgtggctccctcagttctcagggctctggtactcacctccttcaggcccacacccaggcatccccctaaggacagcagtcctaggagcctccacggagtctctcaggcctccacctctgtgccttcatgtcctgccttccctaaacacccatcacacaggaagtggggcaactttcctcttccagccttgggacacagaggacaacagctttcctggaaatgtggtcaccctaagtattgccaggggtccaacagcctccgaatgcaaagggtctaaagacacctttttctccaaagatgaagtcactctccctcttcaacacagagatccagatcctctcctgggaacccaacacccccatcccttttcaggtgtgaaagaggctccgtttagtgcctcaaaaaggacttactccactaagaaaaaccaaggaaatgccaagatctctttttgggagcagaaaaagaagaaaaagggagaagggaggaatattgaggatctcccactatgtttatattgtaacatttttcatcctatattataatttctgctattttacttggaattttccttaaaattagatatcctttatatagtaaaatctctagcatatagcatttgtttattagttactgaggaggaaggagaggaaacaaagaagctagaagatggaaactgagatttcatcttttgcatggcaggtgccctaagcctccaacagccttataaggaaagtattgttattattatgatttcactgatttaaaaaattgaagacataaatgagacgagtaagtgaataaatggcaatgccatttctgtcttcctttccaccatgcaaacatggcttactttcctgaatcataaaacatttttcaagacgtcagagagccaaaaaaagtatattaaaaacagattaaagcagtatggtttctgaaccattcagtaaaggatgaaaatagctttgttatccagagactgtcttcataaagtcattattatcatgagttagaacctgtattaactcagaaattaaaatagtgctgtgtgcggcaaattctgaagacacactccatgattttcagagcacctattattattctcctgaactttagctggatctgaatgatttaccataagaggatcctgtttaaatgttctacttcacaaagaaaaagtaataaaattggatgattctgaaaaccttatttttatattaattaggaatgaagtacaaactctagaataatcagtccaatgctggcatttagaaagaaaaagaagtcctcacacgtactccccaggtttcccaggggacagttctgggacctcaagcagacttggaacagtccctgtggaagaaagtcatttacaggcttgattctaattgatcccaacagcagcagctgtaaccatatacttttaatcaaatctaaaggcaaacttaggacaaaatatgtgttcttctactaaaacacacagtgcatttttctgaactatatgattacattttctggaaaggacttggggaattattcttgttctaacctccgagagatattgccctctgtatttggcagtctctgtgtctgtttctgatcttctgttctggggcacctcactctgacgggtccctttagggctggagtttgccacatggtcacaatcttcagccgtggggtggagactctttgacaggtgatcccttgtctgctgagctctgcccagccctgtgaggagaaaggcagctagcctgcacagcctggtgctccaaagatggatcctctcagaacaaaggggagcaggtgtagggacagatgccacctgtagcaacagctttcatccagaaggggtccccaagctaatccagtgcttggtacatttgcattctcccattaatatcacaggcacaatactttaggtgagaaagagaagaccacaaatgaacagagatccttccatatttgcttcacggaagccctcccctgagctacctgagggtaggtataataccttatctctcactcacaacacctgcaataacaggtacatgacagatgatgaaaggggctgtattagtctattttcacactgctataaagaactgccaaagactgggtaatttataaaggaaagaggtttaattgactcagtgccacatggctggggaggtctcaggaaacttacaatcatggcagaaggcaaaggggaagcaaggcaccttcttcacaaggtggcaggaagaagtgccgagcagagggagaagagccccttataaaaccatcagatctagggagaactcactatcatgagaacagcatgggggaaacaactgccctcgtgattcacttactcctcctggtcccacccttcacatgtgggttttatggggattacaattcaagatgagatttgggtggggacacaaagccaaaccatatcattgatgaataaaggaaggaaaggagggagggaagaaaggagagagggagggagagacagagggaaggaaaggaatcccaagaatgaaaagttcaagttatgagaaagggcttctttaaaaccagagatcaaatacaaccctaggggagcaatgaatggagctatttccattctcaatgaactctcattcagggaggagcccacacatgctaaaatatcatccgccagggtaagagttcgcattttcataaaggatcatgtaattaagttgattcactggtggtttgtaaaaaccctcatccttgccacccctcactctctacacacgcaccaaaaatctaggtttaataatccatgtctctggtcctggaaggctctctgtggggctgaggggcctggctagctgcctgtggctccagcccacctagcaggcaccttcccaggccccaggctccaggagagtgtgctgtcagccagagacatctgtcacagtcagaccgctcccttcctcccagcctgggggaccacacagggtagttctctctgttggggaccttaagcatgaaacagaattggaagagactgtcctgggaaaccacagggcgggggaggctgatggtctgtgttcttcaccctttgttctcccagcataaagctttcacgatggagacgccttccccgtggtctgcagttttcctcctctcaaaacaagcttctgaaacatcttttgggggaactttggtaatagagcttgggaaagagaggctcttctcttccagttgtcctcacagtgtctgtgttatttaggtttctattgaacaaatgggcttcaggagtgtttggaggagggcacttagcaatttgaagtggcccaggaatgtcaagcatccagatgcacctggaatattaggagtttaaatcaagtactggcaaattgcagcttgccggccaatccagcccttggcctgtttttgtatgagcagcaagctaagatggtttttatattttcaaaggattccaaaacaaagaagaaggtacaacggagatacacgtggcgtgcatatcctaaaatcgttactctggcccttcatagaataagcttgcaagcccctggtaaatagaaatgcgatagatcaaaaaatgtgcaccatgcacaagaaaaggtaaagccccagaaggatccctgagggccgacattcatgcccagttgagaatgatgccacctcagcaggctctggagcatgtggttggttaaggcaatgagagcagaagcctcccaggactgaaatgaattgagattttacaatgtggaaggtgtgatggttaatgttttgcatcaccttggcggccctcacatagttggccgaacacatctgcatgttgtcaggaaggcatttttaggtgagatcagtaggctttgagcaaagcagattggcctctgggtgggtctcattcaatccaatgaagcccttaagagaacaaagattgacctctcccggggaagaataaataccaccagcacattgtcttatggctgcaacatcaattcttccctgggtctccagcctgcagacccacgctgcaaattttggacttaccagctgcctctactatcacggaagccattccttaaagcaaatcacctgagatggggagtttgagaccagcctgaccaacatggagaaaccccgtttctactaaaaatacaaaattagccaggtgtggtggcacatgcccgtaatcccagctactcggggggctgaggcaggagaatcgcttgaacccaggaggcagcggttgtggtgagccaagatcacaccattctactccaacctggtcaacaagagcaaaactccatctcaaaaaaaaaaaaaaacaaaaaaacaaaacaaaacagtaaatctcccctcctatcaacatcttattgactctgtttctccagagaactctaactactacaaagggctgaacaataaacaaatctttgcaaaacttgctctctggctagaagtaaggcctactatggcttgttcctgcaatgccaccggacatctgggtaaataaaaagccaacatgtctgcatattagactagactctgctgtctctattttttcacaagccgcccatggggcggaggacacacagcaaacaggctcctggtaactgcagcactctctctccaggggcttcttccattttttgtacacatctccaaggctttgaaagagtgctcagggcatggctcaaatctaagtgttctgaggttggcagcagggtcctggctctgttcactgtctctcctcctatgtaggaagcatgcagtgatgtaaagcccacaggctgggagctgcctggctcaggctcctgggaagcgggctctgagatagagcttagcgggcagggaggttattgggcagtgttgttggaccatcttcgttgggtgagtgagtctggctattccaggaagggaacatggtctggctgggactctctttggctgagggcaattcccagaaaggactcagctgcgagccagcaggaggcaacattcccagtgactgggagatgagatcctcagtccagggtggggcatctgaagggtgctccccaacattcactacagtgggcttcggcaaatcacttcccaagcagggcgccagcttccttgtctgcagcccccattcccccaggcttcatccgcctatggagacgaacaaggtccctccaacagaaatggcctgagtttgcaacaaatccttcccaaaacgaatgtaactcacatgtgggcaggcttcacactggtgtctatcaatgtcatatctgtagcactgaccaatatcactatttgatcagcagagattccagtgttttctcgggaggtgtagagtcgagtcattgcctctagaagacccaggcagggtgggcaggggagtagaagggctcacagataagaaagctgctgcctctgtcttctgtccaaaactcctatactcagatgcccatgggagtctaaccaggcctatgtgtgcccagtgaccaggcagtttcagactgcctccagtctgccaacctcaccacctcctgccccacctctggcctgcagacaagttctgtccccttctcatgaccagctccttcagaaggagtattggttaaggagggacagctctcaccttgatgccccagcccttggcctcctggctccaggcaccatgggagggcgcagtaaggatagccaggccagcctcccaccgtacctggaatgtgggccacagttccctccagcaccacgccttgctgcctagactgctccactcatcagatctttgcctcactcactgccacctccccacaggagtcatatgtgttctttccaaaccatctgacttggggaaacccaggccatcatctgtgcctaaaccccagttgggagctggctttaattatttcctactagactcctgggctgccatcaaaccaaagaataatgcgtgtggacatcatctcaccgctcagcccctgccaggagagttgagaaactcccctcgctccatgactattttggaggctgcccgctcagagacgatctaagagaactatgagagcctggctccaatgacatcaaagaaactgggggcttttcatgtgagtttgacaaaggggtcaaagaaatgctttttaaaagcacatgttaaagtctccccacctccacttgtaaatggccacagtgccactggtcacaccctcaatatacccaggattgagactgctgctatttggctcagaagagctgggttcctcctctggctcttccctttttgcaggatgtactcatcctaacggggcctaaactttcccatttgcaaaatggagataggccagccttgactatctgagtgtaaacttggacatcaagtgaagggacatctgtgaaaagaatgggtcaactataaatgacaaaaatgtggggtctccttttcccacatcctggtctatcagccagggccatgctgtgatgtcattagtgcaggctgcttattctctgttcctcagcctaggcctgtgcctcttggccagaggcaaagatgtgtatcagaatcacctggaagctttttcacagcacacgctcccccgagtgaaggctctgagataccctggtaggggatagggggaggatgtgggtttttaaaaagttccctaaacagttccatcatgaaacctccacctctatgcccagctttctcaagctcaactgcccaaggaacccaacgagaaacaacagcccccaaatttccaacacctttagctaattcaaagtctacacccagcaaaatttcatcaaaccttcctggagagtaaatgtcaccaggcatgacatccttctctctctcttttctggatgtagcatctctattacacagcacacttgctccccttccgaggctgattgtcccgtctggagccagttcctgctggagaggcctgtggtgcggcaaatggtttctaaaggtcccttccagctctgaatttttttttttttttagatggagttttgctcttgttgcccaggctggagtgcaatggtgtgatcctaactcattgccacctctacctcctgggttcaagcgattctcctgcctcagcctcctgagtagctgggattacaggcatgtgccaccacgcccggctaattttgtatttttagtagacagagggtttctccatgttggtcaggctggtctcaaactcccgacctcaggtgatccacccgcctcggcctcacagagtgctgggattacaggcgtgagccactgcgactggccccagctctgaaatttaatgaaacccatcttttctaaagccattctacaaagtgacagtggcttcctgtgggaggtaaagagactccctggaagtcattaacatttctgaatcttatggggtgctaggaaagcagtttggaagggggccaaaccaaatttggagcccagggaggctcgctttggggcgatcctggcaagcccacattccgagaaagtgtacctcagcgatgaggccaccgctggctctcagcctggagctcctggcctggggcagggagagagaaggggcctaagagtggctggcacttactgagcatgtcttatgccccaggccaagcctgtccgtgatccggttcatctattcttcacaacaacctatgcagtaggtcctttgtgaaaccacttgcaggtaaggaagttactaaagctctgagacagtaagtgactgggctgacggccagaaagagtcaggacgaggatgcacccctagctgtcaaactcctatcttctgcaaccagacagaggtggggcaagattctaggagaaaaaccgagcagaaggaggggttgtcaggagttgtcgttcaatgggtatgaagttataattatacaagacgagtaagttccaggggtctgctgtacagtatagcacctatagttaacagtaaggtagagtatctccccttatttgtggggaatatgttctgagacactcagtgggtccctgaaattgcaaatagtactgaaccctatatatatattatgttttctgctatacatctgtatgtattacaaagtttagtttgtaagttaggcacagtaagagattaacaaaaataataacaaaatagaacaagtataacaatatgccagcatcactactcttgcactttggggactttatgaagtaaaatgagggttgtttgaacacaagcactgtgataccaagacaggcgatctcacaaccgagacagctactaagtgactaaagggtggatggtgtagacagcgtacaaagcaatgatttgtgtcccaggtgggacggagcagatgataagagacatcatcatgctactcagaaggatgatgaaagggtgcacaatttaaaatgtatgaactgtttatctctggaattttccatttaatattttcagactacagttgaccgtgggtaactgaaaccacagaaagcaatatggcagataaggagggactgccgtattttgcacctaaaaatgcattacaaaaggggatctcgggctgggtgtggtggctcacacctataatcccagcactttgggaggccgaggcaggcggatcatgaggtcaggagatcgagaccatcctggctaacacggtgaaaccctgtctctactaaaaatacaaaaaaattagcagggcgtggtggcgggcgcctgtagtcccagctactcgggaggctgaggcaggagaatggcatgaacccaggaggcggagcttgcagtgagccaagattgcaccactgcactccagcctgggcgacagagcaagactccatctcaaaaaaaaaaaaaaaacaacaacaacaacaacagaaaaggggatctcatgacaagggctcttagcacacactgaaaaaaaaggaacccagggaaacttctggaggtaatagctatgtttattatcttgattgtggcatgggtagcataagtgtgtacatatacactccccaaattgtatacattaattatgtgtagtttttttgtatatccattgtacctccataaagctaaggggtgactaaatggcctgccagacatggagctctcagcaggcccttcctttagctcagcgcgtagggagttagggacgtatatgtgcattgaggaggagaggagtaaagatctcttcctggagggcgatgcttcacatcgttggatttccagatagggtctcatgctgccacccaggctggagtgcaatggtgccatcatagctgtctgaagcctccaactcttggactcaagcaatcctcctgcctcagcctcctaagtgggactacaggcgtgcacccattatgcctgactaattcttgtattttttgtagagatgaggtctcgccatgttgctcaggttggtctcgaactcctgggcacaagtgatctttctgcctcggcctcccaaagtgctgagcacctggccaatacttcccatcttaccagactttggattgcatggtgtagtctcaggaggctgcccgagtgtgaccctgtctccttctcctggaccttctctctttatctctttctcagcgtgtgtgcagcctgaagcgccacaccatttagagctcagcagagctgtcttctctggtcttggtgttctatccgtcctacttttctaggattccaggcagataacatcctcatttgaactgaaaacaccctgggcactggggctcttcaagagccttgcaggcctgagtcttggcgctatggcccaaaataagaaggcgtgagaaagcctgaacctctacccttcttccacacactggcctgctcagggaaagcagaatatttccatttatttttccttttcttgtttttttaaacacttatgtcttataatagctggtattcttcaatgttgactctcatcattataaagcccttattccctaaatgtttgctcaacattttttgtagagcaaaggacggggagctacaggcctctgcaaacagacgcttctcaaaggcaagggaggaatgtgctcaaggaaatctaaatccagagggtcgtggtcccagagcccttggctgagccctgcaagtttctccgggcagccagagggctgcagctcattgcggaggctgcaacattgctgccttcagaacccactaattgacaagccactggggcctgcaaagcccatggaggctattagagaaaaggtcatcccacctcccacccagaagtaccacatgggacgtgcctgcaagcagcaataacagtaggatggttccagtgatccatatcccagtgaggcctctgtgctcaggcctcagcacgccggaaggttctttggggagctctgagaccagggctggctcaggtgtatctcagatggtgccccaagccagggatctccagcgacttcttggctgtcggaactgtggcctctcctgtgaccacttctctttgcattaactccctatattcatgaactccttgtggttttcaagacgctctcactcacatattttatttgatcctcacatttccctgggggaaggcagatatgggtgccattttgcaggtgagtaaactgaggcactgaaagcttaatggctcacctaaggccatttggcttctaaagagaaaccggggactagaagctaggccttggcgctgcgtcccagtgtcttccccgctgcactgagtgcctccctgccaccccaggatttatggcctttgtccctttcagtgaatggccccatttaccagcccccaagccagaaaactgggggtcaccaccactcctccctcctcacccattctaccctaaatgtctctgcagtccaccccctgcactctgtccctacagccactgcctaaattcaggtccttatttctcacgtaaagtaatgcagcaccctcctcaccatcctccacctgacagtcagaacacagacttgggtaggtttcttcctgagcaatccttcagtgattccccacagccctcaggagaaagcctacatccagaatagccttcgaggcctcccatgagcggcctgcttctttctcctccatcacccagccatgcaactgttgatcctatccattccctgtgctcaacaggcacccacccactacccaccctgccctcaaaatctcactggacagctcctggtcagccttcaatatgggccttggcctcacctcctctgggaagccatcccagactcctccagcctcaggtaggggctcccactgccccaggggtctcctcccgtgatgaggctgcttgtgctgtgatatcactgtggatggtcattcctgtctctcctactggaccgtgagttccactgtgggggctctaacctctgtatcacctgggcctggcttaggacatgcgtttagaggcactaagtaggtccaaggacttccattggattactgagatgcggactctgtttagtgttaggatgttagaatccttccccaaatcttcattctgtctgggtctgacttggcttcctcgaaaaagtgctgatgctggccgggcgcggtggctcacgcctgtaatcccagcactttgggaggccgaggcaggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatgacgtgaacctgggaggcggagcttgcagtgagccgagatcgcgccactgcactccagcctgggcgacagagcgagactcggtctcaaaaaaaaaaaaaaaaaaaaaaagtgctgatgctgaagtcagccaggcttcccggcccccagcagcctcgccctcacccacaccccacccacctaccaggaatggacaaaaacaatgctccagggaccaggtgccaccctgagaacagccctgaagatacaccccaggcaatggctagtaaaagaacactcagctgcttggggacggggctagagataaggaatgacaatgtcagcccaagctgaccacccaggaccaaggaagtgataaaggagttacaaagaaattattgaggcaggtagtgagggtaaggaagtcctcagtaaggtttttcttttaatgaaaagcagcccccaaatcattttcttttctaacaaagagcagccagtataatcgagctgcagacacagacaagcaagttagaagcttgcacccatgaatgccggcagttgtgccagtaggaaaggggctacctgaggctagctccatcgtcccttctctttgccagccacatgtacaatgaggagcagacaacatggcgccagccaagtggaaagaccatttgcataataagattagggtggggtggccagcttcaccacaggatatgtaaagtcacacctggtccaaccaatctgtgggccccatgtaaatcagacactgcttcctcaagcctgtctataaaatccggtgcactcttctgccagccagaagtcccattcctgcgcccctctctcttgcaagagacgacgtctcttggcatgagaagacaaacctcagatattgccccagacaatgatgctgcttcagaagtggggccaagttgggaggccaaaatgaagccaagttgagagctatggaccatctgtttgaggatctccctccactctgcagggttgaggctgcctggctggggtccacatttccaagtcccctttgcgtctcagagaaagcagtgaccgggttctgaactatggaatgaaggtagaagtggtgttcctcacttccttgtttggcccttagagcttcctgcacagtcctccacgctctaatttgcctcacctgccagctggatattaatacccagggcttccatgggggtgtgctgggaggagggcagacccctgactgtaggacaccacctcctcccctaccgctaattggactttcatgtgaacaaaaaagaaactcgtattgtgttaggccctggggatttgcgggtttatccgctactaatgcagtgcaaaaagctggagccaggcaagacagaaggactcccagaatcagccacagctccttgaatgaagcctcctgtctctagcagtgtaggagctggtgactggggtgagcctggggtaagactggggtaagctggtgactggggtgagacagggagggtcaggatcccgcctctaacatttacagaaagtatgtcctagggccaggtacttgccctccctgggcctcagtcttcctctataatgcggagatagtattagatcatatctcagaagaatgttctaaaagatgccagtgaaggcccaccaagacaccctttctcagtctgggctgctaacagccctcagctgcacccttctctggaaaattgcctttgcccccttaagccgactcacctagggattcctaagaagctaaacccccagccctacaccctgcccacccaccccaccctcccacccactgactgataagaggaaccaaagcccttgcctcaaggcagggcaaccccgaggtatcacccaggctgcaggttgcccggtcgggtggggctgaggcgagactccagacggggctcctctgtgcctggcctcctcacgagttctttctggcttccctcactttcatgtcaatttctcctgttagcattcactcactcactcactcactcactcactcactcactcactcactcactcactcactcagcaggccacctgcatgagaatcttcatctcaaatctgcttctaaaaaagccaacctaagacaattgtgaagattagatgcaattacatgggtcaaccagtgcctggcatatggaaggtgcttagtaaaagtgagctagtacggttatcattcctccaagaggcaaggctgaatggagaccctagtggcctcaggctgtaacggtattaactacaccacccctgggagagttcactctcaacattcatttgtaatgaatgaatgtaaaccctcagcaaggaggaaagaaaaatgtgaaacctgggtgtccatggacacaactggtctcatgaataagccatcaagtatgagtggtttaagggactccaaagctcacaactttctaaagtcacagcttgccccaagccccctgctctcttctgacaaggttcctgaaatgcctttagtgttgttaagactggggtaagccggtaactgggatgagacaggcagggtcaggatcctgcctctaccacttacagaaagtatgtccgagggccagccacttgttctccctgggcctcatgttgaaatgatagaggtggggcctcatgggaggtgcttggactcttcgttctatgtcttggtgccctcttctcaataatgagtgagttatcactctattagtttaggcaagagctagttgtttaaagagcctggcacctcctccctgctcttgctccctctctcaccatatgccacacctgctccccctttgtcttcaccatgagtaaaagctttctgaggcttcaccagaagccaagcagatgctgaagccatgcctgtgcagcctgcagaactgtgagccaaataaaactatcttgtttaaaaattacccagccttaggtattcctttatagcaacacaaacagactaatacaacccctactcaagattggttctttggagttttggacatggctttagaatgaaatgaacctgggttccactctgggctctgccatccacaagagaagtgtcaaaatcaagctcacatcttaagcagaacagggcttggtaccaaggagtctccaggtagtacgggtggtctgtaccctgacccaggctcacactgtgcttaagtacttttgcaccattaaaagaagtagccacaaattcatagtgacagaaagtaccacagtggttgccaggggctggagggaggggaaacagggaattggggtttaatgggtttcactttagtaaaaatgaaaaagttctggaaatgaagggaggtcatgattggacaacaatgtgaatataatcagtacaagtgaactgtacgcttaaaaatggttaagatggtcaattttgtgttatgtgtattttactatgattaaagagagggaaaaaaaaaaaagaacataatctgccaaagacaaggtggctgtgatgtgtgactgtacagtggcccaaaagggcatggctcaaggagccctcaagagtagcatctgaagcagccactgggaccaggcttgccaccctttcagaggggtgtgaggtgcagggcaaagggtctgtaaaggctggcagggaagtgggaagcagtggagagccaggaccagccctgggcacccagaggggttagggaccctgccacccctcccaggtttccaaacaaggcctgtgcctgcctgggctctgacagtcagccaacaaacaggcatttccaggtctgcaccaggccccggggatacaaagaggagtgagagttcctgccctccctggatcctgcggggaaggctgacagatacaccaatcctgtgtcacgggaactggggattggggggaatgatgggcagggggcatcagggttatctgagaaagcttcccagaggaggcggtccctggctgaattgaagaaattgctgggagcttctcaacaagagcattagaagggagttgggggcacgaagtgggtgctcatgtcaggagaaaaatccacaaaggcctctcatatgcactctgcgccctcctctcatttttccagggtcctgctcccagctgtgcaagctgcaaggaagaacgagccccctcctccaaggcctcgacggtccactcagtcacccacttaagaattcaccaaataagtaatgactaagtctgactgggagaaaatgaaagctctcttggaggggaaaacaagttactcatgcaaccaagagcatatccttggcaccctccatgagtggagccacggcaggaggggcagacaggaacaaacggtggccatgaatcatgctgtgtgcgagctcctttgtttctaaggcatgtggtttccagagaaaccagggaacactgccttcaggtaaacacgcccaccacccatgcttcttggaacaggctctgtcctccaggagccccattaaagaggcctagctgcttacatttgtcagttgtacttccacaggggggatttcaagtgctagctggccaagtcatccaacgggtggcaatggaccttctgttggccgggagcatcctaccccgtgccaggtccctggtcccactctgcccaccaccctctcacccccagaagaagactcctctggttgatgagtttggcagaagagtcttggtttggtcagttcagcccttctgctcatgctgactctccctcctcctcctctccctcctccgcttcctcctcccccttctcctccttcccctcctccccctcctccttttcctttccctcctccctctcctcctcctcctttccctcctactcctccttctcctcctcctcttccttcatcttgccctttccgattcactgtcatcaagcttgacttccccagtagagagttttacagccatgataacacagtccatcttctggagcttaaggcacttttacatattatctcatttgtcttggcagcatctctgtaaggtgaagacttgatgcaaatagtaaaatggtgagggcaggctgaggggcaagagctataaagagactttagtggggttcagtgccaaagtagggaaggactggggggtcatgggactgatgctcccagaggacctacttagccgggacacggagctccatgaccccttccaatgagcctagaaatgggctgctttaaaaacaggaaacgtggccagacgcggtggctcacgcctgtaatcccagcattttgggaggccgaggcgggtggatgaccagagatcagaagtccaagacaagtctggccaacatggcgaaaccccgtctctgctaaaaatacaaaaattagctaggcatggtggtgcgtgcctataatcccagctactagtgggggctgagacaggaggatggcttgaacctgggagatggaggttgcagtgagccaagatcgtgccactgtactccagcctgggcaacagactgagactccatctcaaaaaaaaaaaaaaaaaaaaaaaccaaaaatgtgctgtggaatcaatgtgaaggagggaattaactctgcctggggcatgcgctctgaaatgacaatgtgacatttttgcttcacctcaaaagattagtagtatgtttctagaaagacaggaatgtgctggacagagaggcgccaatgtgcctgcttttttgggcacctggtgcttgatgggggccgtggccagtgagaggcctggcagtcagaagacgtgcttgaatgtcagtctgcaggagagaggagctgagggaggatttgaaaagcagggaggtgggaccgcaggtgtgctttctgctaagtgatgtgccaggagccagcgctgccctggcccagggaagagacaaagagggcctgcattaggtcaggctcctgggaatgaagatgagattcttcacagttcgatgctgtgagcatatcacagggtttaggacatggccctgcccacaaggagcttgtaacctggggaaatatgagctgtagaccgtgacccgttcaaaggcaatcaacttagagggggtatccctgagtccaactgaaataaaatttcagagaaaggaaagatcaagtatgggtaagataagtctaagaagtcacatgagggagagaggtgagtgttaaccaaggggggaaggaaggcatttctttctttctttattttattgaaggatgccaagttgaaaggaaagcatttaggcggacgaaaaggaggaagggctttcaggggaatggggaaggggctggagtgaaggcccagagttgggatcaagtgagatctcttctgtcagcatcacatgtgtccacagatggcccctttttcctatcagcctgccctctatcaccccatcttaacccacacacctccctctgttgatatttggtagaaaataatgaaagccattttgtgtgtatgtgtgtgtaatatatacatattttagagacaggatcttgctctgtcacccaggctatagtgtagtggcactatcaaggctcgctgcagccttaacctcccaggctcaagcaatcatcctgattcagcctcccaagtaactgagactacaggcatatgccaccatgcccagctaattttgttctttttttttttccttagaaacaaagtctcactttgccacccgggctagtcttgaactcctggtctcaagtgatcctcctgcctccacctctgaaagtgctgggattgcaggtgtaattaagcactgtgcctggcctgaaagtcattataccactcatttttattaaaaaaagtctactgtggttcctttctcggtgaaggaatatgtgactcattgggcatagagggggcccaggtccctcaggaggaagatggaaattttgaaagcccccaaacacaaacttctacctgcctagttctttctatcagcaaatttaagccccagccttatttctcatgcctggaactgcttgagagacaccagctggcccagggcacctcagagagcttgcaacatattagtcctcaacaattagttgttgaaagaatgaatgaatgaatgaatgaatgaatgaatgaatgaatcagagccctttctctcccttcccctgcccatcacaggcaactcgcggtggttctgcctcccagctggagggtggggtagggtgcataatatttttatagataacaaaatgggctgggtgtggtggctcacgcctgtaatcccagcacttcggaaagccaaggtggacagattccttgagctcaggagtttgacaccagcctgggcaacatgacaaaaacccatctctacaaaaaatacaaacattagcctcgtgtggtggtgcacgcctatagtcccagctactcaggaggctaaggtgggaggatcgcttgagccctggaggcagaggttgcagtgagctgagattgtgccactgcacgccagcctgggtgacagagcaagaccttgtcccaaaaaaacaaaaacaaaccaaaaaaccccccacaaagtgatgctggtaatagccaccctcaactcagactaaatggaaatgactctgtgtctcgggccatggtttccttattgataaagtggaggtaattatgtctacatactacttgggttaatgtaaaagtcaaatgtgaaaatagataagaaaatgacttataaattaaagggcacaccccacattagagggatttccatcttggtctatgcctggtacaaggccctattcatctgcagaattaaaaagtatctgcggatgcagtataaaccatcctttgcttcacagaacatgcttcaggtgatagatacagttactgccctgtctccagagaccttgtcttacttctgtgtccccaagattttaaacaagcagttaatgaatgcacctgaacgaatgaaaataatgaaagccattctatctactcagctttggccaaatgctcttctaggtgccttacttacatcatatctcacttcctcaacagccctgtgcgtaggggtgtccatgttttacagctgaggaaatggaagttctgagaggttgttaataatattgacaataataatatccatgattgctaactttcactgaccattgattatgtgccaggcactgtctaaacagtgcaacacatcatcccatttaaccaccacaacaaccctctgaggtcgtgctaacagaattcccattttaaagatgaggaaactaagacacagtcaagtaatgcatcaagttcacacagcaagtaagtgactgaaggagaggatgaatgggcactaagaaagcatgtgtgatcagcagaaataggaagtcctttcaatccccatcttgcacagtccgatccctgaagcagaggtctgtggccctgagtgggcctgggccccagtgccttctccaactcatctggaggaggaaatcactgtgattgctcatgcgtcatgtcctcccactgtgggcacaacccccaatgcagagctgtagccctttagatgacgaagggctctgggaacggctccaggggaggagagttaattagttcacagcaaatagagcaggagcctgattactcccactgcaggaagttgatgactagtgataaaggctgagcaagccccagaaagttctgtccttctgcacctgcacaggtaggaggctagggtctctcattcccccaggggccagaaccaccacccagacagggcttaaaggagcctcccttgaagttgctcctgaaccaccccacccaccattcactggattacatggcgaccatcagccatcttcatatgggttcctacctcaccctcaggagtcggtagaggacagaaggctgagttggccctcaaggccctgggcttcttgtcttcaatccttttttttttttttttctctaaatagagacagggtctcactcttttgcccaggctggagtgccatggcgcaataacagctcactgcagcctcgaactcctgggctcaagggaccccctgcccccgccaccctgcctcagcctcccaagtagctaggactacaggtatgcagtatcatgccaggctattttttgtttgtttgtttttaatttttgtagagacagggtctcgctgttttgcacaggttggtctcaaattcctggcctcaagtgatcttcccacctcagcctcccaaagcactggggttataggtgtgagccaccacacccactctccatgattcattgacttgatactatgagagacctatttgccctttctaaggtctcaggacaccccatctatggaaggcaccagggagggcctaggtttggaggaagacagtctaggctcaaatcttggcttttcatttactagctgtgtgaggttggccagatttcttaacctctgagcacaggttaagttttcttatttaaaaaaaaaaaaaaaaagggccaggcgcagtggctcacacctgtaatcccagcactttcaaaggccaaggcaggtggatcatgaggttaggaagtagagaccatcctggccaacatggtgaaacctcgtcactaataaaaatacaaaaaattagctgggtgtggtggtgcgtgcctgtaatcccagctactcaggaggctgaggcgcaagaatcgcttgaactcaggaggttgagttagcagtaagccgagaccacgccactgcactccagcctgtcgttgcagtaagccgagactgcaccactgcactccagcctgtcgacagagcaagactccgtctcaaaaaaaaaaaaaaatagaagagtaaaactaatgttgaaagaactcagtaagacagtatatataaaacaactatccaacacaatattactcaaaaaaatttttcccttctctatttataaaataggattaatcttgcctgcctcttcctacctcccagggcctgggtgccagtgaacagaggtatgtatccagtatgaaagtgctctgtgacccattatttatagggagtacagcttccctgccatgcttcagggaaggtacaaggtggacctctcagcgctggctggcctctcgcgtgtgtgaatgactgagggccctgtgtgatgatttcactagtcagctccaaagcagggaagacagtgagatctccagccttacactcccgtctctccctgactgtcagggaggcacctccagctcttggcaaacctcaagagaggtgagagtcctgcccctgtgccgttgcagggaagaacctggccccgggaaggcagcccagaagaccaggatgtcagcccctagagatgataagctaggctggagcagagaggggaagcctctctgaagaccagtcacgtaagccagagatggtcagagactgggaggctctgggcctgtgggaagaggctgcaagccagcccaggactcttggcaggtttcctggcaggtaagagaccatgcaggggccagctcacctgggctcctgggatccccacctgctgcagtaccaggggacctggggggcagggacaagtccctgggaggctggggaacacaaggcaggctccaggctcagcggtggtggtacagtccgagacggcaccgtcccaagacagggtcccaagtgtgaagacagagctgtgctgggaagaagatggaggatggggatcgatgggttggaaggaggcttgtcatggagttccaagcaggcaccaaaaaccagagggctcgaggccagagcaggaccaaggtcagacaactgcctgtgtcctgctcctctctctttctgacaagccggactacaaccttgggcaaaggcactcacccttccctctcagcaccatttcctcattacagggcccgagaaaatagtaattatctgcttcagtttcagaaagtctttaaataattaacatttgtggaacggctttgaactcctcggatatgagctgctgtgaaaatattattattgtttaaaaaaataatacgtctcaaatcatgagccgttgctaaagggtctgttatccttgggggtagctgtttgcaaactgattaattagaactcaatttttcagactttttaatttagatgttaataaattcaataattttatccatttattgtactagataagatcctttgggaataacttctcatttacaatagtgacctgggcgagaagactcagaaactgttatataaatgcctgagataggaaatgatggagattgcactatgaataagcaatcttgcagggctccaaattatcagacccactacccgacccaaataccaccactaacttgaattaatattcctacaagaaacataatgcttgcatagtctgattttctgtttaatttctcgacccaaccatactgacttttgcatttcattgactttgcctcaatctttatccaaaggaagaaatgtacagaagcagagggaaaatgatttcagttgtgtctgtctccccttcccctttgtctctgtctcctgctcccaggctgagaagcacgccatctggaaggagagacagcccccagccaccaggggccttgggtaccggcacaggaggcagggaagagaccagcctactgccatgtgaaggagggcaccctttctctgcatggagatgtctggagatggtgcctgggagctagggatggtcagagatttggggaaagagagggcttctgccacatccaggagggttagctcacagcccactttaaactccagcccagaaactctctggagttgtctccgtcttaggcccagccagcaacacagatctgcatgggggattttatcatggggtgtcatctttctcaaagagctcaactccagggccttctgggtttctaggactatttagagaggaccccttccctcctctgaacgtgtttgtccagcctcaaaacctccgcatggagctaaaggctggggcttccattcagggttccccacccctctcctctgctccagccctctcctccctcctgtcacctggcctctgctttcattcccttcctcagcccattctaatctgcaggctctcctaagccaagtttggtttctcattccaagtataccctaactccctaagcaacagtaaagatatgcccatctgctctcagttacctgtgccgagatgggaggcagtagtcaggactcacaccaaaaccataggccttgctctctggaatgtgttggcaatggttttataatctccattcacagctgcctttgttaggtcactattaaaatgaacttcattctgcgagcacggccctggtatgaggtaggtgttttgtggggatacatgggggccaagtggcacaccctcgaactgagtaccctgtcacacgtgggtcatggagccagctctacccagctgtgttcttcctcaggtctagttttcctggggaggaacaaatagcaccaacagacccaggatccagttggatgcagaaattgtctcttgaaagtgagcagtatactcagaccatctgctgagaagagaggtgagaaaataaatccccttggacttagacacaagaaagagcagcgaacatgtttggagcagacggctcgggatctcagtcacatggcagcttccctcagctgagtgcacagagcctgctaactcgtgtcatagaatgaacccagtagtatctgcaccctgggtcaccccctacctcgggcccccacctgtcacatctgggtctccgccccagcctctctgctccctgtctcaccttcaattcagtctctgttccactctcacggtgagcattccaaaaggcagatcccacctttccagggtacctttctaaggctctagtttcttccagataagatataaactctccagtcatctggtgccagggcccctcaggcattccctccagccattctgaagaaagttcatccccccaaacactcatccctgtccacactgctccttccctgccccctgcctggctaattccttctcaccctttcagattccccaggcaaccttccctccccgctcttgagtttaggctcacttccacccctcaggactcactgaaagccccacgagggccacttcatagctctcacactctcttcatctgcctctccctctgcagggtgagctccatgagggcaggggctgtgtcctgttctcagctgatctccagaatccgagtccccagaatccagtgtaggaactcctgggaaaagctcaatagttcatttgctttcttatcctcatcaccaaagcacgcagaagactcactgggccaaagtaaccatagcagcccatgggagagttggtacagcaagtgcttaagctgtggggctctagaccctgggcttgaagcctgaccctgctgcccttcagccacgtgactgtggccaagttacttaagccaatattagtacctactacaatgggttggtaatgcatggattaagtgaattaatgtatgtaaattgctgagaacagggtctgacacacaggaagtgccatgcacgtgtttgctaatattgttagcaggatgctaaccctttgagggcagggactgtgctcttcattcccagatgtacacacagttcctagcatatagtagcaaaattgtctactggaaagcttgggagggaaacaaaattggattcatatcctggctgtgtgctattgggtaggctacgtgttaacagtgaagctgtctcattatctgaaaagcgtgcaggttgatgtgaggttgatatggtttaaatatttgtcccctccaaatttcatgttgaaatgtaatccttaatgttagatggggcctggggggaggtatcatggcctttgggtcatgggggcagatcccccatgagtggctccatgctgtccccatgataatgagtgagttcttggtctgagttcacatgagatctagttgtattagtccgttttcacactgctctaaagatactacctgagactggataatttataaggaaaagaggtttaattgactcacagttccacatggctgggaaggcctcaggaaacttacaatcatggcagaaggggaaggagaaacaagcaccttcttcacaaggcggcggggggtggaatgccaaacactttaaaacgatcagatctcctgagaactcactcactatcacaagaacggcatgggggaaattgcccccatgatccaatcacctcccgtcaggtccctccctcaacacatgggggtaacaattcagattacagttcgagatgagatttgggtggggacacagccaaaccatgtcactggttgtttaaaagtgtgtgtgtggcatgttgcccccacttcttgcaccctctctcaccatgtgatgtgccttctcccacttcctcttctgctatgagtaaaagctccctgaggcctcaccagaagctgagcagatgctggcaccatgctccctgtacagcctgcagaaccatgagccaattaaatttcttttctttataaattactcagcctcaggtattcctttatagcgacacaaaatggactaatgtagaggtttagaatgctgtttgtaaagccctaattagcacagtgcctggcccctagtgaacactggataaatggtggctgtaatcttcattagtattgcagaatgaatgaggtgacagtgagcagcagacctctggggctggatttactgattacatgagtaaatcttcaggaaaactgcactcccatgggcaggtccaactacataaaatttggagactggtacaaaatgaaaatgtgggaccctgttgtctaaaaactattcagaatcccaagtcagcaacaccagagcattaaaccaagcccagagcttcctctgttcacaggtcatgaactcatgaggtcagcctgcccgtgggaccttcccagcaatagtttcagtgggataggctgaggccctctcattttgcaggccagagtcccagcccagagcattcaggtgtctcacatcacttttcttctggctcactcagcagggtgaggctaggaactcttggtgccaagtctagtgtcccagtgtccccagtgactatcagtccccagtggcagccccagcactccctcctgcttggctgagaacccagatcacagaaaggggatgatttatctttaagtttggatttaaaattttaaatggtactgaagtcaatcgaatgactggccccaaatctgtactcccctcttacagtattagccatccatgcttggcatggctttagggtgagcagggtgcaccttaccacatcttgcctcttggcttgcctgtgttacttacttaggccaatgggagtggttgggcttgccatcttgtatgcctgtctttcaccatggaaagaacatgccctgggtgtccaccaccacaaagaggatgagagatgcatggacttgtacccaacccacagtctacactcaagcccagctaaactggagcagccgaacccagccaacctgcagacagaggagtcagaaataaatgctttattgttttaggttgctaagttttcagtagtttgttaagcaaaattactatggcaatagctggctgataagtgtcttataacccaaaggatctatgactcactgggtgcagtggctcacacctgtaatctcagcactttgggaggctgaggcaggaggatcgcgtgaactcagaagttcgcgaccagcctgggcaacatggtgagatcccatctctacaaaaaataaaaaagccaagtgtgatgatgcgcactggtatcccaggtactcaggtggctgaggcaggaggattgcttgagcccaggaggtcaaggccgtggtgagccatgattgcaccactgctctctagcctgggggaaagagaaaggccctgtctcaaaaaccaacaacaacaaactatgactcaattgactccctctgaagctaaggagactttttgtctcatatgcattttcatggcttttctggagacaccctaaagctggaggtctcatgccatcagatcccttgatgtaaatgaaagcatatccattggatttattcttcactctttccccagcctcttaggcatcagcaattactccagctccctgcagctgagatctgtttgcccctccaggggacccccttggacaggacctaagatgaaaccacactgaccttctctcacacagagcccaaggttccacatcatttgacctggcggacccctggagtacaggccgatcccggtgcagcaaaaacttgtgcttcaaggagactcagaccctggtcaaatgtgtcccccaaactgcagggaaaccatattgaactttccggatgatctgtttcaaatttttccatcttgacttgaggagaagaaggatgtacttcccatgccttatcatataggaaaatagaacccacttgttttgtttaatttttagacacagagtctatctctgtcacccaggctgaagtgcagtggcacaatcatggctcactacagcctcgaattcctgggctcatctctgcctccctagtagctgggactacaggcacacacccagcttgtcactttaatttataaagatgaaacagtagaactttctcaggttggcaatactccatggatattgtcatgcatcgatgccagaagactaatgcatcctgaccttgggaagaggagaacagaagctctgcatttggaatatttctggattcttctgttgatcaattttaatctgtatccttttcctgtaataaatcataactgggtgtctaacagctttccatgagttctgtggggacttctagaaaataatttcaggagtttttggaacctcctgaatttgcgattggtgtcagagtgagggcagtcaggcaggctgtcccctctaactttgcaattgggagtcaaaaaacttcagaaactgctgctgatgtttacagctgctcagcagccctgaggcaaaagagtggctgggaaaaaaatacactggaagaactcatgctggccagagttaatacacctgccactatgctggaagaggaagaatggctcagcctccactccggcttcctaatctagcttcaaggcacttgttggcagaattaaaccatactcaacactctgcaaacaagggaatccgggaacaggcttctgaacaggagagaggcggaggaggtgaaccaatcccccacggggctcaccaggactctctctgaaaatccacttcctaattttcaactccaaagcctttgaggtcctcactaaggatgaggggtttgagatgtatgtgatgggattgtggagagctccatggtaaattctgcaaaaaatctccctcttcctttgaatgatgtattatccaggagtttcagccacaagcaccattttatcatctcattacaccaatcacagctaaggctacaataaacacttggaataataaggtgcagacacaattacatgctttacccttctctggtctttgagaataataaacatggtcacagagcctggtattcagatgaggctttcctgaggacccttatttccaaaatctgaaattaccagaagggtaaattaaagaatgaatactcatttggtaaaaaggataccttgtttacaaaataattttactttaatggtagggatttccagctatttaccacttgtcaaaccagaagaaagaaactccaaagtgttaggagctattgttaaagatcaattaagactgtagaaaccacatctcagaaacatttatgaaattaattgagaattataatttgtatcacacactgtttctatgaatgcatctcttttctaaaataagacccagctgtaaattatggggacaacatgggttggtaaatgctcttcagatgcctgatgggtgcatttcctgtctcccctgggtgttaatctcctgcgtgggaagactctgttttctgtgtgtatcacctaggatgcttttggctgcgagtacagaatatttcaactgaaatggcttaaacaataaggacatttattatctcacaggtcgagctgtctggaaacaggaagttctaggcttggttaattctgtgtgatgaagttgtcaggcacctgctgcctcccctctttgcactctgccatcctcagtgtcatctggtcccctcaaggtagctggatggccgctgaccactggttctcacacaagcccatcagaaggaagggaggacagcctctcttttacatttcttttgttgccagagagaaaatcctccctagtagttctctagaaggcttcccttgctggttccttagtcaacgttgggtttgacatgcactccacagctttgagaaagcctggaaagtgaaatggcatttgcagctgcttctatcttgagagtgacgttctcagccacaaaggaagaaggagatttagaaacactgttggttcagaaaccaaacatatctgccacaacacccagaccctgccctcttctaaagccataggccaaggctctggcacagcaggtgctcagcaaacacaagctaagaaataaaacatccaagagccagtgcaaaccagtgctcactcaatcaatctcaatttcctaatgggtatttccaattttgatatagaagcctcctacacaggcaccaagagccagtccccctttgcccacctcttgtccaggaggtggctggtcaggcaaacccataccacaagtaagggagccttttccaggttttgttgttatcttgttctcaagtcattcaagagactgactttcctggcagtggaaacctgaagacccttgcaggagaagagccactgccaggagcaaagctgtccccacacagatgagagcctttgctagtcttgacctcggatctggaaatagaagggtcttgttcatgttcccaaggaaattgaggagaacactcttgagttaaaacaggtgcttcacacagggccctttagaggagctaaaaccaaatggctttcaagagaagagaacagtagttcagagacaaactttatcagacgtttggatagccccatccccagcagggacctgtgggccaggacactcccttttcctcaagatgtagctggggactcactgaaatgtcacagcctcttcaacttgcagttgtgacaaaaactcactgatctcagtggccccgtggcctcttaccagcattctgtctgtacactcagcttcttccaggaaaccagagaaaaggtaaaggcttcactagagatcacatcaagcacggaaatcagaaaggggctttgccacagataattttgaggtgaatgccgggtgcctcccaggaagccacatgccactggagccggaagaaatacaaaagatactcatttaatacctgaggaaactgaagccccagagggagacacacaggtattttggctcattggagaagctaatgagcccactctccactcctaattagttgtatcatattggacaagttgataaccactttgaatattggtttcttcatctgtaaaatggagttaataacgttggctgcacagggctgctgtgagcatcagacaagatgaggcgtgcaggggtggtgcatcttggaacgggaagtctctgcccagcttccctcccccgccacctccccacactgcctcggggctcctgggggctgcagctggctgggcatcctcactgtgtggacactatcctctctctccacccaactcagaggctgtcagctcaggcagaccaggcaggcaggggaccccctcccgggattccccacacgggagtgtggccaccctggccagtggggctgagccctctgaggatgcacagctcctccctctcctgcttgctcagagccatctgttctttgtccccatagagaggccaagtcccagagccacggggaagatggcaactgctgctgtaagggctggggctcatgcctcctaccacttccttccaatcccaccctggcctgccctcatgggggcccctgggcctgttcccaggctcaaccacgtgtcaggagcaaagctggccctcaaggaccagggacaccctccctacctccctcatgcctactcctgggaggggctggacaggacccattgttgtctgggttctgggtagtcagtgagtatctaaatgagaacaatagccccatagaccattctggaagaatgtcttcaggaaaatcattgttcatagggaccagccgttctgccccacagctctcctggactctgggcacaggtggggagggccttggggtgtcctaagcactatgccctgaccaaacaccagctacctgacttctgggcccttccattccctgcaaatccctcatttgaattggaaatgactcctgcagagaaagcttccagcacaaatagagatacccagagcctgtgggcagccctggggtggcaacccacattcctacttgcaacttctggtgggacgtaagcacgaagcattatgcctcaggatgctctaaagcttgatgtggagacatggcctgcctgacaagggattggtaaggaataactgaatagcaattgtatttttaaagcactttgcaaagtgccacataaataactcctcgtgtaagtgattgtcacatatataaaatgctatcgatggcagaaaaaattatctctggcggcagagacacacatatctatgccaggaaagcaggtctctggtagggaggcacctgtggtgtactgagaaataaatgtcagcagagacctgtccctgttcttgatctccccattgccacatgcagaccacaggagatgtgtttatgtgtgtgtgttttttttttttttttttgagacggagttttgctcagtcacctaggctggagtgcagtggcgtgatctctgctcactgaaagctccgcctcccgggttcacgccattctccttcctcagcctcccaagtagctgggactacaggcacccgccaccatgcccagctaattttttgtatttttagtagagatggagtttcactgtgttagccagggtggtctcgatctcctgagctcgtgatctgcccgcctcggcctcccaaagtgctgggattacaggcatgagccaccacgcccggccatttatgtgttttttaaatcaccagcaatgaaatccacttaaaatattgcaacagccctgatgtggggaacttatggtgacatagatcgcactgattactgcctttgattctttgaagagtgtgagagactaaagcagaactattatttttcaatcttatctgtgtttgctagttttcttactcactccacatctatagaggcttctaaaggggagtaatccttccactaatagcatggcatttgtattcattagacaatttatttaacacaaggcagcttttaaaggccaaacaaggccaagcaccttggctcacacctgtaatcccagcactttgggaggccaaagcaggtggatcactggagctcaggagtttgagacctaaagactcctccagaaagctcctagaactgataaaagaattcagcaaagtttctggatgcaagattaatgtacacaaatcagtagctcttctacacaccaacggcgaccaagcggagaatcaaatcaagaattcaatcctttacaatagctgtgaaaataaaataaaataaaatacttaggaatatacctaaccaaggagtcaaaagacctctacaagaaaaactacaaaacactgctgaaagaaatcatagatgacacaaacaaatggaaatatatcccgtgctcatggatgggtagaatcaatattgtgaaaatgaccatactgccaaaagcaatctacaaattcaatgcaattcccatcaaaataccaccattgttcttcacagaattagaaaatacaattctaaaattcacatagaaccaaaaaagatcctgcttagccaaagcaagactaagcaaaaagaacaaatctggaggtatcacactacctgttttcaaactatcttataaggccatagtcaccaaaacagcatggtactggtataaaaataggtgcgtagaccaatggaacagaatagagaatccagaaataaacccaaatacttatagccaactgatctttgacaaagcaaacaaaaacacaaagtggggaaaggacacccttttcaacaaatggggctggcataattggctagccacgtgtaggagactgaaactggatcctcatatctcaccttacacaaaaatcaactcaaaatggattaaggacttaagcccaagacctgaaactataaaaattctagaagataacattggaaaacccttccagacattgacttaggcaaggatttcatgaccaagaactcaaaagcaaatgcaataaaaacaaagataaacagctgggacctaattaaactaaagagcttttgcaaggcaaaaggaacagtcagcagagtaaatagacaacccacagagtgggagaaaatctttataatctatacatctgacaaaggaataatatccagaatctacaacgaactcaaataaatcagtaagaaaaaaacaaacaatcccatcaaaaagtgggctaaggacatgaatagacaattatcaaaagaagatatacaaatggccaacaaacatatgaaaaatgctcaacatcactaatgatcggggaaatgcaaatcaaaaccaccatgaaataccaccttactcctgcaagaatggccataaaaaaaaatcaaaaaacagtagatgttggcatggaattcgagtcctgcctgggcaacatggtgaaaccccatctctacaaaaaacaaaccaaaaaaattagctgggcatggtggtgcatgcccaagtagttccagctacttgggaggctgaggtgggaggaccaactgagcccagggaggttgaggttgcagtgaaccatgattgcaccactgcaccctaacctgggtgacagagtgagtcaccgtctcaaaaaaaaaaaaaggtagtggattgaacacatggatctaatattcttccttcactaaacccaactaaaactacagtagaggattttttccaaattaaaaaaaaaaaaaaaaaggaagctggaaaaaagatggacaggtggtaactaccttctaagcagtcgtaaggaaaacgaatctggccatcctcaggccatatctcatagggacccaaaaacagttatttcccatcctgctaccctagacactgtccctttggatgaccactgcccaagagtcacttgagggcagcttctccctgtggatgtggctcactctgtccggtgtctcccatgagaaagccgggagaccctttactctactctttccaggtgctcccaaagccatgacaactcaagaggtcaacaactcaagacgacaccccgttcctttccatcctcattgagccatctctgggagagagaaggccctccacttcttggcatcacactcccagtgcctttgccacactgtccctcctaagggcaactctctgtttccaccactgggccaaggaaggggacaagtgcgaggccagcaccttctttcccagaaccaacatccagcctgacaccctgaagtccccttcctccatgtgtacctttagaagaaggaacttgtgcaaaagcctgctgtgaagcacccccacctcccagaagaccagagctcaggcccaggctccccttcactgagcactattggccccaatatgagcccctactccttatgcaagctgtattttttttttctttttggagatagggcctcactctgtcacaaggttgactgtagtggtgctatcatagctcactgtagcctcaacctcctggaaccaagcaattctcttaccccagcctcccaagaagctgggactacagacatgtgccaccacacccagctacgttttaaatttttatggagatgggatcttactatgttgcccagcctggtctcaaattcctagcctcaagcgatcttcctgcctcagcctcccgagtctctaggattacagacacgagtcaccatgcccatcataagtcatatttttaaaatcttctacaggtgttagggaattgaggaatagattgtgtctagcttgtttgcatttacaatgattatatttggtgaattagatgtaaaagagcccctccttacacaatattttttaaatgtaatagaattcactttaagatgttttaaattttcatttctagtggagctctaggcaattgaattcttcagcagtctaccatctcttagtttttatcaggttctgagaaaaatgaaaaaaaaaatcagagtagaagatgtcatcaacattaccatgacaaagaaagttttatttttctggactaagtgccttctaatgtcaaaaagagaaagaaaatgttatttttaaagaacaaaaacatttctaggctgagcgcagtggctcatgcctgtaatcccaacactttgggaggctgaggggggcggatcacgaggtcaagagactgagaccttcctggccaaaatggtgaaaccccatctctactaaaaatacaaaaattagctgggcgtggtggcacatgcctgtagtcccagctactcgggaggctgagggaggagaatcacttgaacccgggaggcagaggttgcagtgagctgagattgtgccactgcactccagcctggtgacagagccagactccgtctcaaaaaaaaaaaaaaaaaaagaaaaagaaatctaaattttttgtatgtgatgtttgcttttaatactaaaaccaagaagaactgatgcttatggagtgtgtgcccagtgcttgtccctgaactcagtgctggatgtgcattaattcattcaaatctcacagtaacttaggccagcaggagccactactaactaccccattttacagatgaagaaactgagggttgatgagattaagtaactcatccaaggtcccatggctagtaaatgggtatccaaaatttgtctgactcatagcctgagttttagccactacacatcctgacctctttctttttcatttttgttcgagacaaggtctggctctgttgctcaggctggagtgcagtggcgctatctcagctcactgcaagctctgcctcctgggctcaagtaatcctcccatttcagcctcccgagtagctgggactacatgcacataccaccacatccagttcatttttgtggggttttttggttgttgttgttttgttttgttttgtttttttgtagagacggggtttcaccatgttgcccaggatagtctcgaactcctgtgctcaagagatccacccaccttggcctcccaaagttcctggattacaggcatgagccaccatgctcagtcgtatcctgacttttctggaattttgtctacaatttctctatttatgctgcctctaatacttcattttttccaggcttaaggaaactgaacttccgcccagacaaagaaagacttttctgtcctttcagatactcctttatttcttgagtcaaagtgcaaacttccagaaatcggtttctctgccaaggtatgtcagagtcctaagcacccgagccttgttgctgaatggcatcaggatcaaaggcctgtgacagtctaactatccttgttgtgctttctcgagaggcctattctaacacctttttgtttgtccaacagtgagactgagaagcactttctaaactttaattaggctgctctcctgggattctgtgctcagagagtccttccctggcctacagcagacaggctgcccctctgggcttagttggtgccctgggtcccccagaacacccttttctcatcctttctgggcacacagaaacctcccagatcatccatgcccagtagttaccaaatggggccctagcggacccccctactttgagccccccacccttttaagtactccacgtaccgcagatgaagctgccacagttgccagcacgtcagcacaggaaccgccgcagtctgtcccccttccccacacatcccactttgactctccatgtcgccagctcccgttaaactgggctcttcacatcactcctgggttctgccttttccatctgactacgtggtgaccatctattcagctcaggccctggccccctcagactccgtttccactgtttgctcattgtctcccctgcaccccggcctcacagggtacccccacagctgtgcagccatccacaggcccttcccatctagagagggaagccgacaatggaatcccattggggagagccagaaggagcatccataaagtgctagacacttggcaattgtcacttaatcctcacaacaacttgtaatttatttatcctccactttattccagaaatgggttaagaagccttatgagactacataaaagaccaacttagcatgaattaaaagcagaagcaaaagaagaaagagaaataacagggcacataaaccaaaattaaagagcaaaatgtgctacataaattcttcgctgtgtgtggctgtaactttgtctctgatatccccttgcagccaagaagggaaggggagcctgagcggtgccggaaggcaggtattaccatttctgctttacaggtgaagaagtaggccagaggttgaggggtttgcccagggtcgcacagctgagaggtggcagatgagacttaaatctaggcctacccagacagaaggcactgttttttgggttttgtttgtttgttttggtagaggcagatcttgctatgttgtccaggctggtctcgagctcctggcttcaagcaatcctccctcctcagcctcctaaagtgctaggattccaggcatgcaccactgcacccagtctccaaaggcaccttctaagtcttgtattcatatttaggctctcctgagatctgtcccaggggcgcatctccagtgttcttctaggaccagaactttctcctgaatgagaggtatccatcagctgccatggctcttctccagccactgtggcatcacctggacaatgcaatgggcttgtctctcctgggattgtggacagtggcagtggctgtgagggaagtgggctgttatggcggctctgtcctagtcagagcagaaaccaatcaacctttggttaaggcagggccaagggagggagagataaaggggaggtccttcaagacatccacacttctgtgtaacggccctgctccctgctccatccaaaggcagcatacaactaatagacttgtcatctcgggcgataacattagcctcatcattaccattttactaaataagtcatttcaaattaattaccttgcactctttcaaattagctctggttgactcctccattcctactgattatcacattggcagaattcattagtcctgtagataaactgaagtggttgtgtgtgcactgggtatatagatgagctcttcctccctgacacatgtgccagggagcccaagtgcatccaggaggctccagtctgcagttgggcagcatggccgtgggcccattggtgacatctcccaagtctgggacccgtcaactctagtcattaccctcgaaggttgcagcatcctatgaacagccttgtcactagttggctttgtcctttgcctccctcttgggttccatgagaaaatcatgtgaatgaacatatcaattgctttcttctctatttgagggtctcaaagaagagccggagatctgagggaaggggataaggggaggcacgcatcttgagcacctcactttaacctctctaagcctcaacttcctcagcggtcagtgggaatgatggtatctacctcataggattattgtgaggactaccatttgcagtgttgatagctaattaaaagaaaaaaaaaaaaaaacagagatagggtctcactatgttgcccagacttgtcttaactcctgggctcacacttgagttgagcccagcgacctgctcattttagcctcccaaagtgctgggattacaggcatgatccaccatgcctgaccagtagctacattttaatggcatatttaccatattctggacactgttctgaacacatagaccaatttacttaatcttgactataactctgtgaggtaggtacaataattattcccatcttcatatgagaaaacttagggacaggaaggtcaaaaatagccagttggcccatggccacacagccagtgagtggcagagatagactctgaagctagaaggtcacctttacaaccctgctcctagcagttaagctttgtggattaaatgagataatgcataaaacatttagtagacattctggcacttaggaaaactcaataatcgttagctattattgtggttaattatgcataataaaaatagtaggatggagacaaaggccaaacaggggtaaaaacacaaaagtttttgattggaagagaccttgatgatgcagggcaggtgagcctcatttttgggcttagcccaggagggctcttggcttctctcaggaaagcattcaagagcaagccggcagtagaagacagcaggttgactggagaagcagcagtgtatagtggctgctccctgtggagtggggttaacccatagggagtgcacttagagtagcagcacatggactgttggctggcaatgtttaaagttacttcttgattacatgctaaatatgtggtgaactattcatgagttttccaggaaaggggtggaaagttttccagagtcctcccccttttagaccatgtgcaataacttccagaagttgccatggcatttgtaaacggtcctagtgctggtgggagtttcctccagcatgctaatgcattataattagcatataatgagcagtgaggagaaccagaggtcgctttcatcaccgtcttgattctggatagtctcagctgccttcttcactgcattctgttttatcagcaggggtctttgtgacctgagccttgagaaacaagttctgccaaatccctatctcattacaccctaggctcctagctttacgggcttcccacttttgcccaagacatccctgttgaaagaggtcatagtcttgaatcccatttcagaaggtgctcccttcatagacactagtaattttcccaaacacagattattagttttggagagctagaaaggatgctgaatgaccatctaacccaactcccctcacattacagatgaggaaactgaggcctggaaaagtcactgagcaagtgagaagagagcccggcagggagcctgagttccctgacagttcagagttttttctccacagcatgctagaaatcctacactcttatttgcatgttgctttccataaatttgcatgttggtctccaaagactcagtatgtgaaacaaaataaaagaatgtgggcactgaatttaaacttaataatcaacactcttgaaatgcagaacagagccccgggcttcaaggaagggaagacaggagttgggatgcagcctctctcggtgcacaggtaggcaggtctttatgatggagggagccaatcacctcggtggccagcatgacccaggagctgctacaggagccaccagaggaagccctccacaaagcccacccagaactagaacacaggtccatgacacaagttctctgagagcagccttcatgggcactgaggcccagagaggtgaagggacttccctaagttgaacagtcaacttagggaacttagaggtgaagggacttccctaagttgaacagtcaacaacagagcctggaccacgatccacacctcctaactcccagctctacaaattgttgccatcttcaggttgaagctacctcaaggctctactgaagcacactctcctccctagctggacaggaggagcctcaggatagccactaagcctcccgtattggctcaaatctgtttctccttggaaaacccagaggccaggagcagacaatctcaaggacagtaggtgctggggctgtaaggacacatcctgggtggtccccgggagcatgtcgctggggcacataggccctaatcctggtctgcttggtctggcgtgataggaagtgaggcagggggagggagagaagtaaaaatacccactgaagcacaaatggggaaaaaagccaatgaagcagccacagccctggctgggggaagaacagccaggactggggctctgggagtaggcagctctctcctctggggccccagtaggagcagagatgacagaggaacacaaggctgggctgtgcccttccccagctggcaaaagagatccagggaagctgacctcagagatgtgctaaagagaggctggactggggacgtggggacaccaagaactcagtagaggctcttctccttcttgaaaacaaaaactgaggtcacagtcagcctggaagatgcacccttcagtctgcagtggcttggctttgcagatacttggctgaatacaaggaacttactgattaattccatgcaaagccttgcccgttgcagacttcagggaaatggttccttctccagagagggtaagagacaggatagaaaaaccatctttccagaagggactgaagttgtgcctggggtgggcagatgggacttcactggctcaagtccagggccctgcaggcccttcctctctggtccagggccctggtcttctctctcttccagactgggaggctcagactgcacaggacataattggggttttagcatgttggaaagaagtaaagaaactcttccttttcccttctgtagtgggtgtgggaggtataaggaggaaataattttttctctacccttaaaactctgtaacaaaagacagattaacaggaaaaaaacaaacacaagtttattaacatgtgtacctggtagataaccagggaaaacaggaaatctccaagaggtggctttgaattcagatttaaatatcatcttcagctgacacaaagaaagaaggatatggagggggcagtgatgggggggaggtaaccaggaaatcagggtaaacaaggctgaagtatgttatgcagatttaatgtggtaccttctccattgataagagtctctagtgatttaatagaatgtttttctttctgcaacagagagggagacacccttacaaatggagattttctttatagatataaatttttcttacaaaagaataacttttactctgttttcagggcttttcctgtggctgctgaatcttaaaataatcctcgtgccagaggcatattttgggatggcatattctgctctgctacaaaggggatgttggcagtgtgggtagataatttttagaggatgaagaaggaggaaaggagggcacaggttgaagaagtagccccagcaaaggtgtgggcacatgtcttagtccattttgtgctgctataacaaaatactgggtaatttgtgaagaagagagatgtatttcttatggttctggaggctgagaagtccaagatcaagcatctgcatctggttagaaccttcttgccatgttgtgtcataacatggcagaagacatcacatggtgagagagtgtgccagaaagggcaagaggagacttacctcatttttgtaacaaactcactcccaagataatgacaatctgtaagcagatagggagggtcttcagggaccatagaaatccatctagtttgagcaatccacctgctttacagcttcctatcttatagtctgatgttttcaagccctgtgtggaatgtggtctcctagtcagctgaaaccagctcctgacagagaccagcaacttccagatggatcagagtaaactttcttcattgccatactaaattctacacctcaggaggatgtatagcttcattatcataacatatggcctagtgccagcgtgatgactcactgcacctacgccagtgagaccctcctctacatacgatgatgcatcttctcccctgtccattgccccattaaaccctcctgtcactttcccttgggagcactgctttggagaatcctcttcctacctgtgacaaacaattaaattcctattgatcaaaacctgcattctcgtggagagtcatttggtacttgccaggcaaatggaccccagttttttgagtaacaaatccattcatgagggctctgccattaacacctcccattaggatccacctcccaacactgttgcattggggattaagtttccaacacatgaatttggggggacacattcaaaccatagcagcacattggtgacttttgttaataccaagttttaatgctgggagattaaaacatagcaatgaagctgaagaacagtctggaaaaatggcttgggacccattcaagaggggtcttgagcactctcctaaggagtctgatgttcattctgttggcaacaggacaccactgaaggttttgagaagagaagaaatgatgcaccttgaaatgaagctgtaggcagtaacttctaacatgggagacagagaagcaagagtttgaaaagagaaggatttgttaggaggcctctgcacatgagcaggtcaggagagacagagcaacagcctgaattccagtcgtggggaggatagaggaaaccagaacaaaataaaaagagaactgacaagaatcagcgacggattagccatgaagatgaggaagaggaagaattaaaaaaagaatgagttttgtagcccagatagctgtgtgataacattaagtggcatcaaggacctggagagaaaaaagaggtataaaggaagaagagtgagttcagttgggaacatggagaactcagatatcctgaagacaacctcgtggaaatccccagaagacagatggaaactcaagaccaagtcagagatatttgggctcaagaagaggtggggatttgcgagttaacagtatcagggagcctgagaaggagactgagacggaaacccaagggaatgcagagctgatgacagagagcacagacaagtccttgatagctaaagatgatgaagccacccataggtaatcagagtcaaaaagaagaaatctaggagggatgggacaatgagaaagtggagccccagagtatacaaagttgcttcaactcccagggccttgtgggaaataagaatttctatttttgtgagagccataggagtgttgagaaaaacaacatgtgaatattctgagttattcaggaaagatcagatgctcatgcctgtaatcccagcactttgggaggccaaggcaggtggatcacttgaggtcaggagttcgagaccagcttggccaacatggtgaaagcccatcgctacttttaaaaaaatgcaaaaaattagccgggtgaggtgtcacgcacctgtaatcccagctactcgggaggctgaggcacaagaatttcttgaaactgggagacagagtttccagtgcagagagagattgctcctctgcactccagcctgggtgacagagtgaaaccctgtctcaaaaaaaaaaaaaaaaagatgcattcaatgtgatatgactatagactcttctgagttattcagaaagatttatatatctcagattattatgactttgctctcttcagattaatcctctcttaatgaaataaaacaaaatcttttttcatcactttataatcatagatatgtgaaaggaaaataaatcttgggaccccaaaatcactaagccaaagggaaaagtcaagctgggaagggcaaacctgcctctcattctcttctttaaaaagatagctactaagataaaaaagctatatacctacctcacaaggaatttccttgtggacaaaggaaagacggaactcaaaatcatccctctgctcactgaggtaagtgcatatctgattgcctccttttgaaaagctaatcagaaactcaaaagaatgcaactgttcatcttttatctacctatatgacctggaagctcctctactcacttcaagttgttctgcctttctggaccaaaccaatgttcatcttacatatattgattgatgcctcatgtctccctaaaatgtatgaaaccaagctgtgccccgaccaccttgggcacatgtcatcaggatctcctgaggctgtaccatgggcatccatccttaactttggcaaaataaactttctaaattgacttagacctgtatcacatatttggggttcacagatggttgaaatattataaagaaataaaaacttccattaatgtcacttccatccttcattggctccagccaaaaacattgtcatcattgtcaactcctccctctgtttctactgcatatttaacagaagcacagagcttataaactctctttgcaaaatgtgtccagaatccgattcttcctcatgacctctgctgcagccagactggcccatgcctctgtcccctcttacctgtgtgtggccacagcctcctggcagtttcactgctgctcctaaaatcacctctccactcaacagccagaaaggtcctgataaaatgcaggcagggccctgtcactctttagttcaaactgtcagtgacttttgtcttagtctgtttgttctgctataacaaaatacctgagatgctattttataaataatggaaatttacttctcacagttctggaggctgggaaatccaagattaaggccctggacaggtttgttgtcttgtcagggccctcttgctgtgtcctcacatagaagggcagaaaggacacctaagctagttccttccagtcatcttataggcactaatccattcgtgaaggcagagccctcatcacttaattactttccaaaaaggccctatctcttaatactatcacaatggggagtaagtttcaacatgaattttagaggggacaccatcattcaaaccacagcaacttcccatctcactaaagtaaaatccaaagttgttccaatggcctaaaggccggacataacccagcttctgctctctccctccatctctctcccagctatttctaaacttttcatgtctgtgttcctgtgcttcctttccctacctgctctcctcctgaatatccacccagcccattcctccacgtttttcaggtctttactcaaaggccatatcctcagagaggtcttttcagacctttcaatttacaattgaatgcttaccccttctatacacacacacctcctttccttatcctctccccaccctctgctttatttctcttctaataagatgctgtcgatactacataatttacccatttatttgattattttctgtttccctaaactaggatgttacctaaagacaaggatagttgtgttttgttcaccggtgtgttccaaggactagaaaagtgcctgacaccttgtgggtgctcaaacatctatgtggaatgactgactgcagcctacgggatgatgccaccttctatgtgggctgtgatgagttgcccctcattccatgccagggtctgccagtagatggcgcgagcagcagttgaatccactttgcagtttctcctgtgtttgtagaatcagccttctcctcatggcatagcttcgtcctccccaagacaccaactcatcagaggtctgagtttcagctcgacagggtctctttttaaagtcttaataattccaacctcatccctttgttcactcagccccacagacagtggcttcctcctgcagttgctaacgccatgacaccgtgaagtgctttttttttttgagacagagttttgttctgtcacccaggctggagtgtagtggtgcgaccttggctcactacaacctctacctcccgggtttaagtgatcctcctgcctcagcctcctgagacaggcgcatgccaccacatctgactaatttttgtatttttagtagagatggggttcaccatgttggccaggctggtctcgagctcctggcctcaagtgatctgcttgccttggctttccaaagtgctgggattacaagcatgtgccattgcacccagcctgcggtactctttttatccattcagttactagttataatgttatactttcttgacaatttgttgcattaaattctttctgtccaaataactggtgcagttttagtctcccaatgtatggacacggcagatacaagacaccactcaggataaccacctgtgcctacagccttcccgcctggcctcatacctgtaacccaggtgcagagggtgggcaagggctccctggccctcccaatccagcttccattgaaggcaactcctgtttcacactctcctctgttccacagaccctcttctgaaccctgacatgaagctcgtgcttctctgtaccctcaccactccctacaactgtccccaccattgctcctatcatctcattttgaagctgcttgtttttacacttgtccccctctacagactggtgacacacccaaaggcacggccatatattattcatatctgtaaccctactgccttgcatacttcacccttgccccactcatagtagctgctcagtaatatttaatgagcctaataaacatttgacaacccagatatttcttttttttattttattattattatactttaagttttagggtacatgtgcacaatgtgcaggttagttacatatgtatacatgtaccatgctggtgtgctgcacccattaactcatcatttagcattaggtatatctaatgctatccctcccccctccccccaacccacaacagtccccagagtgtgatgttcccattcctgtgtccatgtgttctcattgttcaattcccacctatgagtgagaacatgcggtgtttggttttttgtccttgcgatagtttactgagaatgatgatttccaatttcatccatgtccctacaaaggacatgaactcatcattttttatggctgcatagtattctgtggtgtatatgtgccacattttcttaatccagtctatcattgttggagatttgggacaacccacatatttcaacaggatgtgaaagccactcattttaatgaacagtccaacctgatataaatacaaaaaaaaatccatgtgtcagtaaaaaaaaaaagaaagaaagaaaaaaagaaaaagagagagacagaaagaaactagagtctttgctttaatcactcccatgtaaaaccaaaccttcagataaaaagaaatatggccagtctccagtgagtctctttcctcataatgttgggctttaattatattttcatgaagtctgcatgttattatttatatttctatgtcgatatttgcacagttgtcggagtttttgaggaagccttttctctctgagcccagagatggctgcacatctcttggaagggatgctgaggtcccaagacagccaacctccctcctgagactagaaagcattatcagccaggcttttcttcacaatctcaatctgttcacctctctctctctctctctctctttctctctctttctgtctctcttcttccctctcttcctttcccctctcttcctccctcctctcctttctggtagagcatctaatagaatcatttgtgcaatagataacaatcctgttatagctgctggtgcttcccctgtgtaattaggaagtgcattgttgtgtaattcagaaattaattagtagtaaatgtttcaagaatgcaggtggaagtgggagccgactgtgctccatcagccgtgcatctggattgctttccaactccagggaaacatctccgggctcacccagggacatccaccatagaggacaccacctggcctttgtggttctgagggttggcactcccttcttcaccctcagcggtgaggatatagctacaaaggccacaagccggctgcatatcaaggtgctctgacccactgctaggcagcagccatagaaggtgtctcttgctgcccaaagagctctcagggcctttccagcccagggaatggatggggtagatgttaccatgcaacctgaatcttggggagtccagagatttttctctatctggggagtagcctgaaattatttctctctgatatagaaaggaaaattacacattggtaacatagacaggatcatggaacagaagacaggactaagcaaggaagacgactgcttcctggcccaggctatccttttggggctgcagtgatggcctcaaagacaaggtgaagctcaacctcctccagaagattgtgggcttccccatgcaggctccagtttatcctatcctcttgccttctctcatgctgttccctctgtctggaatacctttccctctcctttaccagggcctcgcacagtacctagactatagctgatgcttaataaatatttactggatgaatgagtgaaattctacctgtcaaatttctactcatcttgcatgaagcctgccttgtttcctgagtcagcattaacctctctctcctcttggctggcttgatttttctgtacatctcctacagcacttacgttatgctgtttcaaattactactacctgtatatgggcctgtctcctccattcaatggcaagcttactggtggcaaggacttgttcatctttgcatctcttctcagcaactccccgtgcaaacactgagcctgacatgtagttggtgcttaagaaatgtttattgactgaattactgagtagaattaaagacagtgactccatcccctgaaagactgcccgctccccttgggatggtgggggttcccatttcaggtagccaggagaagctgaagggccaaacaggagcagtccatgcctgctgggtaaatccactgtgcaaatccactcattagtatccatgaagttctggaacagactccccggcaatcccttccagagcatacacaggataattttgactgcgggatgatttttggcttgaatttcatcaccagatcatgcctctcatctcctaatcctctcttccttgttgaactgaattcaattcaacacgcctaaattgaaggcttataatacacacagaaccgcagaaccttctaaaatcccggcgagtttccatctgctttcctctgtttttactaacagagctattcccttccatggaaactgagaagctgattctctttggcaatgcccttcccctgagcctggcatcctcagaggctcagataggccaggattagcacagccctgcccccactggccaacaggaacacttgataatacaactctgagaatatctctgaacctcaggatcctctatcttatattgaaaattgatcaggaccaaagggaagcccagcagacaaggctcaatagatgctaacaagacctgaactctgcttctaacaataactagaaaagcaataataatcaccgatatttatggcgagtctcctggggaatgggcactttctgcatgcctttgtacagtgtctcactgattctgacaacaatcctataaggtatatatctattactatctcattttaccaataaggaaactgagacacagggaaagtaagatgacagttgaggaaatccgtagacatctttttgaaggggggcggaagcagcaatcaaatgttttaatagtgaatgaatgaatgaaatgaaatttcagcccaggggagccctttcagggagtgtaaactttctcttttcttctcttctctccaccagtgagctgcttctttaatgggcaggataattcactaaggactccagcttccttccctctgcggtcaggtgagcgggtggtcaagctgtgtgctctctggcctcaggggacaactgtgaccaagagaggcagcctgaggagaatgcctttgggatttttcttctctcaaagctgaagctctgggagggagtcaagagtgatcggggaggaaagattcagaggaaggggggattcctaaaggccaggaaaaagaggcccacagcagagactcgttcccacacccaggcagcggctcccagcccagttagtgttggagtccacggggctggagcaggagatgtcacctccaaggacaggcaggcttcgacagcaaccagggtggagtgaaaattagacatccttttcccattttgctgtccctgtaaatcattctgtgtagccctggggagagggaggaagctgggtagaatgggaattccgtgtgagatttaattagactgagaaacaagtaaagcacatttcatattgccagagcccttttttaaaagtacaattatttgttaatcactcaatggcatggagaaagtggaagactgctctagattaaaaggtgcaagctaggggtcttctttgagtcctcatccaaataaaccaactgtaagagtatattttgaagccaatcaaggaaatttgaatatagattggttattagatatgattaaagaattcttgtgaattctgtttggttggagaatggtgctgtggttgtgtcataaaatgtcctttcctagacatccataatggagggtaaaatgtcatggtatctgtgatttacttcagcaaaaaatgacaaaataggtatgataaaatattaaaatctttttttttgagatggagtctcactctgtcctaattcataatgatggggcttcaatatactgttcttttacttttacttatattagatttatgtaatataagtaatatctgggccagatgcagtggctcacacctgtaatcctagcactttgagaagccaaggaaggaggatcacttgaggccaagagttggaaactagcctgggtaacatagcaagaccgtgtctttacaaacaatttcttaaatagtcgggtgtgatggcacatgcctgtagtcagtcccagctacttgggaggctgagatgggaggatcacttgagcccagaaggtctaagctgcagtgagctgagatcgcatcactgcactccagctctgggcaacagagcaagaccttgtctcaaataaataaataatatctaaatacataaataaatatataaatttgtatataatttgataagtacataataaacaaaaaaatttatatagaaataaacatgttaaatataaagacataaatataatagaaatgttttcacaaagaaaaatgtcaacagatggtggttaatgaaaggatcttccctcattcctccagcccctggctctgctccagagcataacgagggagtgagagacgcatcggcagccttcagcagaccttaaggaactcagtggccagaactatgcctctgccttatttccatcccccataaggtcctacacttaactagtgaacccttccaaaattgtgaagagccaacatctgtcttcacagcttgcaaactccaaatgatcaccctgtcccccattagtgagccctcttctccatgcaactgccactagtaagtgactaacgttgtcttttccaaagaccaaaaccaaatggataagctcggacatgaagtgccgcacatcagaccggattacaggcagaggatatccaggatgcttcacttcatccttgttgtcttagtccgttctggctgctgcaacaaaatactgtaaactgggtgccttataaacaacagaaatttatttctcatagtttcgaaggctgagaagtccaagatcaaagcactggcagatctggtgtctgtgagggcccccttcctggttcatagagggccatcttctcactgtgtcctggaagggtagaagggactaggaagctctcctgtgccttctagaagggcactaatcccattcatgaggactccactctcatgacttaatcacctcccaaagaccccccctccagacatcctcacagtgggggttagaatttaatgtatgaattcaggactgggggcacaaatcttcaggccatagcacttattgtaacacacagatggcctccatagtcacaccacttataaccaacgccaggcatggtagctcatacctgtaatctcagcactttgggaggctgaggtgggcagattgcttgagtcccagagttcaagaccagcctgggtaatgtggtgaaaccccatctctaccaaaaatacaaaaaattagctggatgtggtggtgcatggctgtagtcccagctactcaggaggctgaggcaggagaatcgcttgagcccaggaggtagagactgcagtgagctgagatcacaccactgcactacagcctgggtgacaaagcgagagcctgtctcaaaaaaaaaaaaaaagagagagagaaagtgaaaaggtggcagagggttccacctctaagtggattctttctgatgctatcttttctgaagtggagaggtcagtgggcatcttggttatttaccatcaatgatgtcaactctcaaggtcagccaacctcatacataaattgaaggaaagggttaacatatggatggaagacatggttgggagactgagaggagagcagagaagaggtagcctagcttatggtggaactgccacatcccagagccagagctagaagcaatgacaggggttggggctcagagggaatgagaacacccaaggctgcagagatgctggacatcgaagaagctggcaggctgagcctgccccaactcagaataacagctggtatgagagagaagccagccaatgagccagacagagaccacccaggtgggccgggagcctgtctgccagttgtgatgggcccttgtgcataaccccgcagagccgggctgctgagacacggctgttgccaggaccttggccaggaagagcctcctgttgcctgcggatgggctgtctgcctggctctcccagccctgctccaagctgcttctgtgattgtgcataattacaaaaagccctgcctgggcaggtggatgtgaggagaaagctaatccatgactctcggcaggaaactggagctcactgaagatggtcttgttgtggtggaattacctagaatatttaggacgccccaaacacctctcaccaaaatgtcagcttccgtgttccagaaggtctcagatgagtctgggacttgcatggtgtcttgtgtttcttcctatttactagtaaggaaacaaactgtgcctttaagaggtgacacgaattgattctgaaggctagggagggtgggagggcaacagaggaagaggaagacccccgtgactccaggctgacttcaccacacccctactcccactgggggaatcagagatccatggggttctctgcacaaatcaaagaccccatgacatgggaggcaccacggctttctctgctcctggcgttgtcagggtggggagaagactggggagggaccggctcagcaggagaccctgcaggggccacatctcctcctagagctccacagcctttcaacccccagcacctccctgccaacagagacccagctttgatgaatctgcacctcaatggcagtccccactggggcttctgctgccaggggctactgtgtcatctgtgagggaccagtgcaaacacatcctctctgctgggaaagcacagagaggcgcctgctctacagtctacagagcctcctcttctgcaaagggaaagacagagttcacattcattaagcgtctactttgcaccaggcattgttctaggctttgagggaacaaagaaaactccatctctgcatccacagactatccatctggagcggggaagacaagcaagtcaacatgttaatgcaataaagtgtggtgccggctcccagaggggaagtgcagggcgctgtgggagcagtggattccaggagacactgagctctcctgagatgcagccacatctagggggaaggacaaggccatgactaaaagcatcatctcccactgccttcatcttgggggagaaggaagcaaagggcacactctcaggtgtttgagagggaaaatgtagtgctaggatctttaacctgcttcttgggctgtattggtaaggagtcctcagaacagtccttacctcggacccaggaccctgaaagcaaaggatgttttgtaatgagatagtattttatttattaccagactattccctcaagtagttgaaccctgcggggcttcaaaatgaaactacctgtttcaagttgattataacatagcactttctatttagggagaattggttttggtcctctacagtgaatagagtgaagacttgtacctggtcggcatgtcaatgagcatgagaatcacaccagctgggcacaggagcaggctgcatggcctctccaggcagccggagtgtggccgtgcacacacctgctgagtcctgctgacaaagcttctccctcttatcccttactggacgaggaaggaccccttttcttctgggacccgcaggctgctaaaacaactatacctctttctctcccatcagattaacagagccctccctgcagtggtgcgatggcagagcccctccctgagcagtgagagcccagagcttttacgtcctgtcttcagttaagggcctgccccttcctcccgactgggtcttgggagactgaaaggcagcattgaagccaactggtgcttgccgtacttaagagtcatattcctataaggaacattcatctagatctacttccggaaagagaaaattaatccataatcaatcagactgatccagggccaaagcatgtgtgtgtgtgtgtgtgtgtgtgtgtgtgtgtgtgtgtgtgtgtgtgttctccttgatatttcatgtctgcatagaacaaccagctatgcagacatagagtttgctttgaacaaccagccctgtccccattcctcccttagggacaccatggctgtgccatctattttcttactaacaacagagatgccagcattcagctgtgagcaaaactaacctgaactgcctttcccctctagctatttgccaggtaagaattctcctcagtacagtccagcagtctcccatgtctgcaaataaggaagaaagccctgttctcccagcatcccatccctgcccccttcctgggctcctttcctgaaggtggcctccggatgcatctcggtccacagaagacttctcctctgagaaattaacctacactttgtatctttcagcagttttgagttgtgccatttcccgagaacatcttctttcccaaagcataaaaagcccaggatacagcccagatggcatatcacgagagaaaggtggaaaccattctggctcacaactttaattgattgctttccctccactgggcccaccgggtcggcttacatagctcatagctcagtgctgctgaaatagacccagggcaagaaaggtatgaacaaccagtgaatgccactggagcataaatgttcacaaaattgtagagaaggggtgacaagaagcaagcagtggggcagggagtgtcactgatgtccgaaaccccgggtcagaccaacacgcagcacagccactgcaaaggaaagggacaagattgagttcttggcttctcaggggctggtgtgctttcaccattgatgctctcctgcctcacatgggtgcgatctttttatctccattctccagtaagtgccttgctcaaacatgggaagcaaggaaggctttcactatatcactaactcctgaaccagggtactacagaaatgtgactcagaaaaagctctagacccaaagggagctccaaaaataggtatgtgcatgtatattcatacacacacacacacatacatatatacacaatagtgtatactattatatacacacatatatatacactatatatgtgtgtgtgtatatatatccctatagattcctatatatgtgtacatatcttttcctatatatgtatttgtttctatatgtgtatatatatattcctatatgtgcatatttgtgtgtgtatatatgtatattttatgcacccacacaaccacactccattttaggttccacactattgtccaggtatctgtgggaatccacaggtctatttctaggaaggcctttcctgggctacaggaaagaggtcaatagcattcccactttagagaagaaaagaaagtgggtaagcacagacaatggggcacagccagtaataacctggccctctagttccaccgcctcagaatcaagtcaaaggccaatgcctccccctgcctggacccttggagacatctccacacttcctgctgtcccctctggccagtaaaggcctctgtcgtacaggggtgcagtgtccacgggggaagtactctgattttttctgcaaaaacattatgtgacttgtacacagtaaaaacacttgttcattttgcatcttcattctacccactgcaatttcatttttgtttcctacatccttccataggtccatataagacagctggtcctagaagccagacactttatattgtgcccactacccacaactccatccaaattaacaagggcttgcatctccgaaattatctgaaatgtagctgtagctttatctttacgatcataataataataaacaaaaatgtttggaaaactgtataacagttgccttcctccctgctgggtgcctgccacagaacgtgcatggtattcacatggaactaagacagccaacaggaataagcatcacttggcagctacatggtccaagaatttcagagtaccatcagccagcaattcatcaaacctcaggacattcacctcggccagagagagctgaaccatgccatccttgtcttcgtccagaaggctgaatagttctaaaacaccagagaaggaaatgaaattagataaggctgttcctggactttggaacaatcagagagctgcctctgtctaccccatccccacctgcggaactctcctttcccctaccaccccctcccctccagcccccacctaggcccaggggcctcaaaaagctagatccagggcacacaatgagcttttgggggatcagatgcccccctgccgaaacagacaaaccccgttgccagcagagatggtccctttggtatctccatcctcagaagctttatatcagaaacgtgcaattactttatcaaggtcaaacagattgtggttgtcttgcttgtgggtaatccagtcccttagctttgtctctggctaactgaccttgacccactagaacgtaacacctaccaaacctcagtggaaggaaaaatcccttcctaataagatatctaatctcaaggcccaagatggcagaaaaacgcctattgccttcagagggcaccccccatcccttcattggaaggtggcacatgttctcaatatgatccctattgaaaaacaaatataaatagacactaaacaccatctaagaacagttactgtgactcattcatcttggcctagtgactgcacactgtagatgcgcaatagtctggatggcagctttgttaagtctccaaaaaaggcatcctccgtcctggatctggccagcctggacttcctcagccccttcaggtccagctgcccctcgcccccaaggtgccagcattccagaagccctgtctatcattttctgggtccctggcctcctaaaggcaatgtctggttctgccccttggccctgcccctgccccaacttgcaccttgggattaataggatggggctggaggacagagtgactcactgaagagggtctccaggcggatcatacaagccacgaagctgtcaaagttgatgccgagcttgctgcacgcataccgcagggcaatggtctgctgcacctggctgttgagggtgaaacctgagggcagagggagcctgggtcacaggtagagtggaggactcagcactgtctcccataaacactcaaggagctgacatcccaggggcccctctgtggttctgtatcaatctgcaaaccaggcctgactctgccttctccaggggatcccagaaggtgtcctgccatccatccctctccttgtagctactcctcaccaagatcagcctaattccaggtccagcgctagtaccagcaccaactcagccatgggtcacatcagcaagcaaaagcagagaaggtgagggggctgcctgtctggccagttcctgtctgtctccttcatagccccttcctctgtaattgctgtcaccttcccagtaacaggcagagatcttggaaaaattctaaaatattatgctatatggaatcgagcaatattctccccttcctggacagggaaggtactcaacaaagctctgttgttgccttgatatcccatataagaaagctacaaatgatgatcattagcaatcatcatcatgagaataaatatttacaatgtgcacacctggatcccaagaccctgtctacaggatgtgtcctcacctgccttcctgagggctgtcctcatctcgtgggcatcgatggtgcccgagtggttataatcagtttcccaatagatctcctaaagcaggaaagaaatcccaagtagaaaacaaccattcacggcccctgccagaaccatctccctccaccacactgctttctcaaaaggccagggacactttcaaaaggagaccctattgactcctcccaagaaggtttcagagcaagcataagagcttggccagtgctggcccctttgctgtctgaacagcagggctttcagggcagtggttggcatgagagtctctcattgccttcttgttccttcgtgaccaatgtgcccaggactcaatagttttgaccatgattaaggatgtggtcagactacaatggaccaggaatgagtgtaagggaggattagaacagaggagaggatgcccagaaggaaaagagagttaccagatacttctgaatcttcagccagagcgtcttgaattccaccgcccccaaagtgcccgttccattgctctaggcacgttaaagaccaacatgattgagtccaaattctacatgccttacagatttctttctcttgtgagcttgcatgagtgccttaaggccttagtgaaccttccatgtctgtggcaagcagagcagtgggggtgacggtgtgtaacaggttcaaataaagattaaaaagtcaaacgtgcaccaaggctctcctctgaggccaggcacagagctaggaacaaagggcaagtcatgagctggccaatctgcaatatcgtgaataccctaatcatcctggtttatttacagggtggagctgtatgatctgtaaattcgcttctacatttacatttctgtgattgatcattcagctaattagagtttgttggaatgtcaaaatgttatgggaaaagacatcaggagccaggaaccatgggactgggagtctaagccacagaatctgctcataggccactatacaaccaaacaggaggatattatgagggattttctgtgtccaacttacattcactccacaacttttttttttttttttttttttttttgagacggagtctctctgtcgcccaggctggagtacagtggtgtgatctcagctcactacaaccactgcctccagggttcaagcaattctccatgtcagtctcccaagtagcagggattacaggcacccgccaccatactccactaatttttttttttttttttttttttagtagagatggtttcaccatgttggccagtctggtcttgaactcctgacctcaaatgatctgcctgcctcagcctcccaaagtgccacgactatttttttttaacgctgtgctagtcaatagggatttagttttgaatgcacttatgctcctaaagttaagttttttagagactctacaattttctcaccagtcacaactaatcaataaacagtgcgtatgttacagcaccaatgttaaaattttgaaacagccccagctactcaggaggctgaggcagggggattgcttgagcccaggagtttgaggctgcagtgagctcagattatgcctgtgaatagccactgcactccagcctgggcaacataataagaccccatctctgaataaataattagaattctaaaacagactatcactttaattagccaaacaaaaagtcctgtaagcctcatactttaagaaagtctgtgttcttggatctataatccgcactgagtgttgaatgcatcatagccttcaaatccttactaataattcaaccaacacatctcagaacagtagtatgcaaaggaagctaacactcggggctaggtactctacatacttgtatctcatttcatcctaacaatagccacacaagctagacataattatcccattttccaggagaaactgaagttcagagcatttagtaacttcctcaaatttatacacctcaataagtggtagagccagaatttggacccctgtctgtttcaaaacctttgtcccagaacaccagtggtcttcaattccagataaaattgcttgcagagaccacacctatggaatcaggatctccaggaatcaggggtttttgtttgttttgtggttgttgttgttgttgttgttgttgttgttgttgttgttgttgtttgagacagagtctcactctctcacccaggctggagtgtagcagtgtgatcttcactcaccgcaacctctatctcccaggctcaagcgattctcgtgcttcagcctccccagtagctgggattacagacatgtgccatcacgcctggctaatttttgtatttttagtagagacaggatttcactgtgttccagactggtctcgaactcctggccttaagtgatctgcccaccagtgccacccaaagtgctgggatgacaggcatcagcccctgcgcccagtcaatttttaaaattttttttctagcactttgtaggacatgtgaaagactgtatttttaaactgtatttttaacaccccatgggtgataaagtactgatacatgctatagtaattgaaacatcatgttcagtaaaaaaagtcaattacaaaggaccacatattgtataatttcattatatgaaatgtccacaatagacaaatttgtagagacagaaagtaaattagtggttgcctagggatggtcgtggaggttgggggaaatggagagcgactggtaataggagtacagggtttctttttagggtgatgacaatgttctaaattatgtgatgatggttgctcaactctgaatacacaaaagccattgcctgatatactttaaatgagtacgctgtgtggtgtgtaaatgatatctcaatagagttgttatttttttaaggattccatgggtatttctgctgattcagaaccactgccccacactacctaaactgtggaacagaaactcctgaagagtggcagagagtcacactcctctttgaaccgtgagagacacaaataccattgggaataaagagtgggtagattacaaggcaactctcaaatctaaactgaagtcaacagatggggtttgatgagaatgattcagaaaccagggaactatttgcagtaaagtgaatcaatacttaacagttccttgcagtccacaaattaaattgtcaagcatggagaaaagacacaagggctaaagagccccagcctcatgcagggagtggccgactgaagctcagaggccaaaagatagcaccagccctccatggtggatcagccacgcagaggtgggcacacatgctctgtcatccaggaccactctgcatgacaaccatgcaaaggaaaatccttcctcccgtcccgcagttaatgaaagaacccacagtaaagatcatcatggatgaacagacagagctcatcatggatgaggccccaaggaactgagaaaaaccctccaaggctccaatttttaaagaaatcacttcaccatcagcactgtgataaatggcaacctggacccactgtgggcaaagctctaaggaagtgatgttacaccactcaccctctgcgccttcacacctagaaggttccttccacctagaatgccctgaccttctccattcctcccgaaaactactgcccatttgctatagactgagtgtttttgtcctccaaaatttgtatgctgaaacccaatcctcatgtgaggatattaggagatgggcctttgggaggtaattaggtcatgagggtggaaccctcagaaatgaaattagtgcccttataaaaggaaccccaggaaactccctcaccccatctaccatgtgaagttatagcaagaagatgccatctatgaactaggaaactggcccttatccaccacaaaatctaccagcaccttgatcttggccttctcagcctccagaagagtaagaaataaatttctgttgtttataagccacccagtttatggtctcctgttacagcagccagaacagcctaacacaccatacttcaatatcaagtgagggttaaactagatcagggagaacaaatagattttatcttgtgtgataactctaaactatcagtagtagctgtccacaagccatgttaagattctgaagcaaagatcagatagtgatggggagagcttgggaagcagggaacggtagagggtgggggtggggactggtagaattgaaggggaggaggaagatgaagagatgaacagagtgtggagggaggaggtgcgcaaatgccccatgcttgctacctccagattacatgattttaaataagtcacctaaacactgcacacctcggtttcttcacctgtgaaacggagataatctcaagctttctgagacacatccatgatatgatacattttcctttgaggcttcaagtacaatccttgacatatgctccatgcctgctctctccccttctcattttttacccgtcccttccttctaactggaaaaggtggaggagtctttaaaaaccggacgaaagtaaaaaaaaaaaataatgcaacatttaaaggatacatccaacagactgatcatttccctgcaagtgttgatgttgaatccatcgaattttatgtctgttcctaaagatttaaatagaaaaggggagtgggaatcggatcatttgaaggtgagggaaagaacctccacggtagaagacctccaaagataccatccaagggtgtggaaccgaacttggtctctgccaaaaggggagagcatcatggcaggcttgtgggcagatacgcctgagcctcctggtgccgtgggagatagaacagacaagcaccagcatccaagtacagcatctgaaccttggcttggctccccacaagccacagacttcagcaaattaatatctttgagctttaatttcctcctccatcaaatgggaataatcatgatagtaacaatgaccatacttgccccaaagactggctgggtattaactgagataatgaaagtgaagttttagcccaggcttgatatatgataagttcttaataaaacagctaactttatatggctaggtattgttataagcactgcacatctactcttcaaaatcactccgtgtggtagatgctatcattatacccactttatagatcaggaatctgagtcccagagaggttatatgatttgctcaaggtcacaaccagtagggggcaaagctaggagttaaatgcaggccagccagctccacagcctgagcttgtaatcacaacacacagccactcaatgacagcagctatccttccttactaaattgcaggcatgtcactggagctccatccctggcctccaccctcaccttccatatacctgggagccaagacaggtgccaaagaccctgcaaccccttctctttctctccactcttcaacaactgcaggagcaagagtggtgtggagaggagacgggcctgtgctccgagccctggggatccatctgctcagccctgggttcgtccctgggaagggtatgacttggctcctgggccaagcccctgcttcctgcattctcaagccctgtcctgctgcagtgagtgaatgagagcccatcactcactggaagacttaacctggcccatccctggacccggaaagaaaccagctccctgtgtcctcctgtgggctggggctcagaggggagatgcaaatctttcctcctgacagctctgaggcttgcaaaaatctgaagatggggaactgaggacagtctaggagagtcagaatcatcccttccttcctccttccctcaagatgagctacagaactagatctttcatctgcagaggtttccacagtatccaagttattaattttgtgaaaaaaattcacttaagtcaatcccagcccagctctttttctcctgggactcagcctgcaatttcacttgacactatggagctttgttccttcaggtgctggctgcttgccagcaccagccccgccttcacctccaccctcgcctccccgtcttctgcctctccttcttcccctcttgtcttgctggactgaatcagggctcctggggtcagacaccaatgccctttctcccacctgtggtgctgccagcccaatgcctgcctacccatccctcaccctgccccagcatctcctacggactttctgaaagaccccaagaaggaacttactcttggaaaacgcctcattcaaaagtatcttgagtgcattggcagtaatctcagaatcctagaaagaggaacccaaatgcaaatcatgtcaggccctgacaagttgtttcaagacagtaaattaatgcagtgcttcctcacagtcagacaccaggcccactggccctgtgaggtttatttgtttttgttttttgtttttttttgagacagtcttactctgtcactcaagctggagtgtagtgccgcaatctctgctcactgcaacctccatttcccaggctcaagcaattctcctgcctcagcctcctaagtagctgggactacagatgcgtgccaccacgcctggctaatttttgtatttttagtagagacggggtttcaccatgttggccaggatgatcttgaactcctgacatcatgatctgcccacctcagcctcccagagtgctaggattacaggcatgagccaccgtgcccggctggccctgtgattttaaaagcaggtggcatctttaaaaactcaaattatcctcttcttttggggatcccagcagcctggccagaggtgtgttagtgccatgagtgtggtacacaccgtggcagaaggctgccatgccagggtcctgctgcctttcacagggctcgcttgaacagggataaagtaacaggaacagcagtgataggattgaaccagatgtgccagagccagtgtggaagatccttaaatcctcagcacaattccacagccattttcaagttaaggaagtcgtgattttgtaaactgctgaacactgtatacatgcaacatcatttgtcattttcatgtgacgtaattgcttgtggtttgtagctaccaagaggcagagctagacttggaaacctaaggttggttcaccccaaagtgccggctttccccaccacacctacaggagttggtatttcacataggagcccatctcaaactgggggcagagattgagagaatagcatattctgtgtgcatctgggataaacactgagccagagggaagagtcatcccttaactctcagatggagagcagatctcaggcaggatgaccaaggaaatgcagagaaggggtgctgggctgatgtctgggtcccagtctcaactcagccccttattcatcatgtgactttagccgagtcactttccatcttcccatcctccgctagccaggccctggcaattctactggaaatgagagaggcaagagctgcacaaagcagtgtctcctctgaggacaactggcctcaccccagcacagagtggtcagtcccaataataagacctgaggacctgggccaggcacggtggctcacgcctgtaatcccagcactttgggaggctgatgtgggcggatcatctgaggtcaggagttcaagaccagcccagcgaacatggtgaaacccctactaaacctctactaaaaatacaaaaattagccaggcgtggtggcgggtgcctgtaatcccagctactcgggaggctgaggcaggagaatcgcttgaattcgggagttggaggttggagtgagccgagatctgccactgcactccagcccgggggacagagcaagactctgtctcaaaaaaaaaaaaaaaaaaaagaacttctaggaataaatctttttaaaaaaagatgtgcagagaactacaaaatattcctaagaaaaaattattgctttggagagtatcagtatgaacccacaattcttaatatataaacagaaggatgtaccacgcccatggattggaagacccaatacggtaaaaatgtcaggtcaccccgcatcagtcaaaagaatcaatgcaatcccaatcaaattccagcaggtgtgtgtgtgtgtgtgtgtgtgtgtgtgtgtgtgtgtgtgtgtgtgagatatttggcaatctacttctgaaaagcatatgaaaatgcaaaaaatagccaacgcaaggcaaatcataaggaactcaaacctgaaagagttagagaaaatatttagaaagattcagaaaaaatttttaaaaacatgtactgccatagggaaaaacagagagatcaagggtatagaacagagttcaattacaaacacatataatttacagactcctgatacacagcaaagggccccgcaggccagcggcggaaaagaccttctcagggagaacgtaggtccactggaaagtaaaacgggaacaagtgaattttgagccctggatcacagcacacacaaaaatccatgccagacgtactacagatctgaaagtctttaataacaaatcgtaagagagtccgaatcttgactattaggaaagaaaaataggaagagaaaaagaaaaaaggaagggaggaaggtcaggaagaaccccagagtgttgattgctttggagagtatcagtatgaacccacaattcttaaatatgtaaattcctagctctgactgctaaaaggctataaaaacaaaaatacttagtggcaatgaacaaatctagcaccaagatcctggtttctaaattccccactacaggagaaataactgattctagggctaggaaccagaaagtctaggatgcgcctggaatgttttgctgaaagcaagaaaatgctttaaaaaaaaaaaaaagtctacactgatagtaaataaatagtaacaataaatgaaggaataaaaccagtgagtgggggatataggggaagctctttcctgtaagactgctaactagtaaatatgggagttgtggagttagaaataatcataattgggggccaggcacagtggctcatgcctgtaaccccagcatttcggaaggcactggcgggccgatcacctgaggtcaggagtttaggatcagcctggccaacatgctgaaaccccatctctacaaaaaatacaaaaattagccgggcatggtggtgggtgcctgtaatcccaggtacttgggaggctgaggcaggagaatcacttgaacccaggaggcagaggttgcagtgagctgatatcacgccactgcactccagcctgggtgacagagcgagactccatctcaaaaacaaaacaaaaaccaatcctatttgcacccatcagagagcagtacctgattcaggcaggaatcatcaataaatactagaattaatggatggaaggctgaggacaggcaggatatttacacagcctcttctcacaaaggggagaacagtgaccacctggcagagaccacctgcaccaaaccatcaaaggaacatcaccaatattgagccaaagtggtgtcacgtgactcctgtgacgcactgagaaggttccgctgctatgaattgcagctgaaatgcacaacctgaccccagtcctgaggagaaacctgacaaacctaaagagagggacattctacaaaataatgaactgcgcttttcaaaggatcagtgtcaaaaaagatagaggctgagacactattctagaataaagagatgaaagagaagaaccacaaaatgcaatgtgtgattctggattaaataccacatcagggaaaaaaccactgttctaaagaacaatattgagacaactggaaaaaggtacagtctgtagttacatgaggatgatggattgagataacacttcttgaattttgcacagcgtactgtgattatataagagaatgtccttgtttgttaaaaaaaaaaaaaaagttcagccttttgatgtaaagggcataatatctgcaacttactttcaaatggtttagtgaaaaacctctacaagtaaaaagaatgacagagcagatgtggtaaattcctaccaattgtgaaggggatacagaagttctccgtacttatcttacaacttttctgcaagttgaaaatgatttcaaaacaatgtgtgttttttgtttttttacaaacatagaacatcatcatgatcctgagggaggaagaaatttctttaaataggatataaaaactgctattgtacaaaaagtttgataaacttcactataaaaaattatattaacaaaacggaaagttgcacagtgggagaagctacttacgtgtctgacaaaggatgccaattcacagtgtagaacgtgcaaagtggcaagaaaaggacagataactcactctgcgaagaagtggggcaaaatatttaaataggcacttcacaaaggaggatgtccaagtggctgataagcctatgagaatgtgcccaacgtcatgactcattattgaaattctacctaataccactgtgagagaatcaaggacggcaacttggagatgctcaacaatgtaacaattacaatgtccagcatctattaaaaaaaacaaacaagtgaaaaaccacagaaaggtcaccttaaggagaagaaaaatcagtaaacagaaacagaccaagaaatgacaaaatgctagcattagctgatacaggttattttatatatacatacacacacacataaatacatatatatacacacatacacatacatctatataaatacacacatatacatatacatatatatacacacgtatattagctgacaactggctattataaacatgatcagagcattataaaacaaaacaggaatgaggggagaaatggaaagtataaaaaagaacaaaacagaactttagaaaagaaagcccttgagcatgaagaaaccacagcagagattactcggctgaaagcctatagaagaaaaagtctaaataataatcagaacctcagtgacaaaaacatacatttagtttaacttctagagggtaaggggcagaagaatatttgaagaaacaataatttttaaaatcccaaatttgattttttaaaaaagtaaaaatgcacgtgttcagaaagctcaacaaatcctaagcagaataaatacaaagcaacacaaaggcatctaatagtcaaattactgcaaacatgagataaaagcagcctgagaagaagacacaataaacacagaagaacatagataaggatgactgtgatttcctgggcaatccagaagacaaagaatatgacacccttaaagtactgaaagcaaaaaagaaccgtcaacctagaattctatatgcagcaaaagcttccttgaaagatgaaggtgacaataaattacacaaggaaagctgatgccttttattttatgcaaggtttacctcacttaggcagatatttttatataaagttttttctttttttgagatggaagctcactcttgcccaggctggaatgcagtggtgtgatctcggctcattgcaacctctgcctcccgggttcaagcgattctcctgcctcagcctcccgagtagctggaactacaggcacacaccacacctggttaatttttgtattccattgtatggccataccacagtttgcatactcattactaattactcattagtaattatgaactaagctgccatgaacatgtgcatatgtgattttgtatgcacttaaattttcattttttttttttgagacagagtctagctctgtcactcaggctggagtacagtggtgcaatctcagctcattgcaacctctgcctcctaggttcaagcgattctcctgtctcagcctcccaagtagctgggattacaggcacccgccaccacatctggctaattttttgtatttttagtagagatggggtttcaccatgttggccaggctggtctcgatctcctgacctcaggtgatcctcccacctcggcttcccaaagtgctaggattacaggcatgaactactgtgcttggccaagttttcatttctattgggtcaattaacctaagagtaggttatatggttaaaaaaaaaatgaaaacttaagtgcatacaaaatccagtacacacgtttatggcagcttagttcataattattaaaatcctaatgtcctttaaccagtgaatgcgtacacaaattgtggtgtggccatacaatggaatactacttactcagcaacaaaaaagaatcaatgctaatacaacatgaatgaatctcaaaatgtattcagatccaagaggccacatactgtatacaacaccatctataagccaggaaacagattagcggtggccgggagtcaggggaagcggggggaaatgaccacaaaggggcaggatgagtttagagtgatgaaattgttctatatcttgattggggaggtgactacatgactatacgtatttttttaaacaccaggctgggcgtggtggctcatgcctataatcccagcaccttgggaggccaaggcaggtggattgcttgagcccaggcgttccagaccagcctgggcaatgtgctgaaatcctgtctctacaaaaaaaatccacaaaaattagctgggtgtggtggcatgtgcttgtagtctcagctactcaagaggctgagatgggaagatggcttgagcccgggaggcagagggtatagtgagttgagatcgtgccactgcattccagcctgggtgacagagtgagattatgtctcaaaaagtaataataatataaatttttttaaacttccaaattgtacatcaaagagtaaatgttataatatgtaaaatttaaaagttattaaaaatggaaaaagattactttatggtaaaaattacttcttcatatgctataagcctgatgttaagtgcaggacaacattagcacaaaggactggaggaggaacatgagaatataccattttaagggtcttaagttatgcacgaggggcatcgcacaattgaggaggtgggctgagggaagtgagagatgctaccgtgcggtctagagcaattgctaaacaactgaggcagaagcaggaatagctagtaagcaatcgtggagctaaaaacgatcatattcaacagagaaacatgcagggaaggagaaaaggtaaatgaacaaatagcaagatggtagacgtacacctaaagccactgaaagtaacagcaaatgtaaatggtctaaagattccaaataaaaggcagattgttagactgcataaaaatgcaaatcccaaccatatgccgtctctaaaaaatacactttaagacacaggtaagttaaaagcaataggacaaaaagagccaaaaccacacaaatactaaatataagaaagctgaagtgctatggtgatatcaaagtgacttcagagatggataaatgacatgaaagaccattaccatgactagaacaagatgaaagagaaaatcctaatagttctatgtctaaagtaatattggtaattaaagtcaattgtaattggtaagaatgctgctaattacagtaaattggtaattaaaagccttcccacaattaacaacagcaacaaaccccaggcccaagtggcttcgctggtaagacaagtttatcaaacacttcaacaacatcaagcttatatcaactcttcgaaaaaacaaaggagaagggaacataaagccagcataatgtggataccaaaaccagacaaagacattagaggaaaattacagatcaataaccttcatgaacataaatgcaaaattccttgagaaaatatcagcaagttgaatctagcaatatatgtaaacactgtaatacaaaatgaccaagtgaggtttctcccaggaatgcaagggtggttcaatactggaacactaactgatgcaatacaccatatgaacaaaactaagaacacccacaaaatcacttgcatagatagaaacttctacaaactggtcaaatgcagccatgcaaaaactacaagtgacatcacacgtaacaaagaaaggctgatatgttccccccgagagagagcatggcaaagagatgtttgctttcaccacttccactcaatctggagtggagatccagaaatacaaggtgtgcaaactgcagtaaaactgtctttattcacaaacaggatgatggcctatgtaggaaatgccaaggaatttacggaaagctattagaactaatcactaaaggtagcaaggttgtagaatacaaggtcaacatacaaagaaaccaactttattccagctgggcacaggggctcactcctgtaatcccagcactttgggaggctgaggcgggtggattacaaggtcaggggattgagaccatcctggctaacatggtgaaatcctgtctctactaaaaatacaaaaaattagccgggcgtggtggcgggcacctgtattcccagctactcgggaggctgaggcaggagaatggcgtgaacccaggaggcagaggttgcagtgagccaagatcacaccactgcactccagcctgggcgacagagcaagactccgtctcaaaaaaaaaaaatcaactttattcctatgtactgaaaataaacaattggaaaatgaaattataaacaatataattcacaaacacatcaaattaaaataaaataggagaacggagaaatacatgcaaaaaatatgtaacatcagcaattctactcctaggtatgtaggcaaacatgcaaaacacatgtctgtaaagacttgtacctaaatgctcacagccgcattattcaaaatagccaacaagcggaaacattccaaaagtccatccactactgaactgataaataaaatgtggcattatccacacaatggaatttgacttcacaagaaaaatggccaggcgcagtggctcacacctataatcccaacactttgggaagccaaggcaggtagatggcttgagcccaggagttcaagaccagcttgggcaacatggtgaaaccctgtctctacaaaaacgcaaaaaaattagccgggtgtggtggtgcacgcctgtagttccagctactctgggggctgaggctagaggactccttgagtctgggaggcagaggctgcaatgagtagagattgtgccattgcactccagcccaggcgacagagtgagagtgagaccctggaaagaaagaaagaaagaaaaggaaggaaaggaaggaaagaaaggaaggaaggaaaggaaaggaaagaaggaaagaaaaggaaggaaggaaggaaggaaaggaaggaaggaaggaaaggaaggaagcaaaggaaaggaaaggaaggaaggaaaggaaggaaggaaaggaaggaagcaagcaagcattcttggctgggcacagtggctcatgcctgtaatcccagcactttggaaggccaagacaggcagatcacttgaggtcaggagttcgagaccaggctggccaatgtggtgaaacctcgtctctactaaaaatacaaaaaatcagctgccatggtggcgggttcctgtaatcccagttactcaggaggctgaggcagaaactgcctgaacccaggaggcggaggctgcagtgagccgagatcgcaccactgcactccagcctgggtaagagtgagacatgatctgagaaaaaaaaaaaaagaaataaagaaaaaaatgaagcattgacctattcttcaacatgggtgattcctgatgccaaaagaaaaaagccagtcacagtatatcatacgattccattgaaccaaagtgcccagaataggaatctacacagagagtagactagtgcttgtctagggctgaagggaatacggggaaatagaaatatctgccaaatgccaaggggtttctttgggggatgacagaaatattccaaaattgattgtagtgatggccacacagctctgaatatacaaaaaaaacactggattattactttaaacagatgaacagtatggcgtgtgaattacgtctcaataaagctattacatctatgaatgacatccatatattaaaagctgggggaaattacagtggcaagaaattgagagatgtactttcttcatggattagaagcctcaatattgttaagaggtcagttcttctcaaactgatttacagaatcagtgcaacatcgatcaacattttagtaatcttttagttagagatcagcaaacagcaaaggactacgataatccttcaaaacaatttctttttttttgagacagagtctcactctgtggcccaggctggagtgcacgatcttggctcactataacctccacctcctgggttcaagggattctctcgcctcagcctcctcagcagctaggactacaggcgcatgccaccacactggctaatttttgtatttttagtagagatggggtttcaccatgttggcaaggctggtctcgagctcctgacctcaggtgatccacccatctcggcctcccaaagtgctgggattacaggtgtgagccaccttgtccagcccaaaacaattttcaataagaaaatgaagttgaagacctacacaacctgacttcaagaattaaagctacagtaatcctgacggggggtatctggcataagcacagacacacagatcaatggaaccgaacagaatccagaaataggcctgcaggtacgtattcgactgattcttgtcaaaggtgtgaagggaattcagtggagacctggtgctgcaatgactggacgtccacaggggaaggaaatgaaccttcccactacctgaccccttctgcaaaaacgagcccaacatgaaccatccactagaccatcagagcaaaactgttaagacttttgcaagaaaacacacacagactcacagacacacacacacagaaacacacacagacacacagacatacacacacagacacacacacagacacagagacacacacacagacacagacacacacagacacagagacaagagacacacacacagagacacacacacacacacacatagacacagtgttgccccatcctggataggcaggaattcacacacagacacatacagacacacacagagacaaacagacacacacacagacacatacagacacacacagagacacagagacaaacagacacacacagagacagacagacacacacagacacacagagacacacacatagacgcagacacacagacacagtgttgccccatcctggataggcaggaattcacacacagacacacacacacagaacacagaattttaggtagacaaggatttctcgaacaggctacaaaaagcactagccgtaaaatacaactttaataaattgatcttcatcaaaatttaaaacttctggtctttgagagtcaccattacaataatgaaaaggcaggtcagactaggagagaatgcccgcaatacccatatgtgaacttacttgcaaattatatagggaactcttaaaatctaatttttaaaaaatggacaaaagatctgaagaaatacgtcacaataaaagttataaagtacggcttattcaacctgtgaaacgtgctcagcgttactgaccatcagggaaatgcaaatagaaactacaatgggatgtcactgatattccacccacgaggaagggctgaaacgtcaaggctgacagagaaccccggctgccgtaaggccgtggggcgcctgctgctctcacgggctgctggtgggagtgcggcctcatgcagccccttggcctcatgcgttcaaccacatgacgaacagaaaccatgacacacggaaatatacaggatctaccgctgcacggtctcacgcacagggatcctatgagaagcaaaagggcagtaggaggcagcagggtggtggtcccgtggggccaggatgaggtagacgactctgtgcaaagaaccccagggtaacattgtacaggagggaactgttctgtatgttgattgcaacattgcacttgattgcacagtgaactcactgatggcacactttgtaaaggatacaaatacttttggtttttgttttttggttggggacagggtctcgctctgtcaccaggctggagtgcagtggcgcaatctcagctcactgcagcctctgcctccttgttcaagtgatcctcctgcctcagcctccagagtagctgggactacaagcgtgcatcaccacacccggctaatttttgtattttcagtagagaaggggtttcgccatgttggccagccagctctcaaattcctgaccttaagagatctgcccacctcagcctcccaaagtgctgggattacaggggtgagccaccacgcctggccaatacaaatactttagcaagcaaaaaaggcggggaggagagaacaatggcctagacgggccacaccacagatgcaccatatctacaggatgctgatgaaagcagacagatggtccagtgcggtgctcccacctgtaatcgcagctttttgggaggctgaggcgggaggatttcttgagcccaggaattcgaggccacctggacaatatagcgagaccctgtctctataaataattacaaaattagctgggcatagcggcacatgactgtggtctcggctcctcggaaggcctgagttgcaggggtattggcccttcaaagcagaaggaacccttcacccccgacccctgcagccaacggcactccccggtctggccatctctgcttggggcctcctcttgggccccaccctatccaggccagagatgaaggcaccctctgctccctgggtggtggtgggggggctctaacagtgcggacgcccccgtcccaggccacaaggcagcagagtggggacgatggtgcgatttgcatactcagcaaccccaagttcagcccctcttcttgcttctctctgggaaccccaaacaacagtcctgagttttgagctgctggtgggagcggcctcggacatacagccctgctccccgaccgggcaggtgtaccttccggatgggtaatggtggggggtgagtggctgcaacggagaccaccctagccagcagccctggccacctgggttctgtggcccagggccgggagcaccccacccaagcctgggtgttcagccgggggatggacggggccagtgctgaccttgcaggtcaccctgaaaagggtggggcccgcagcaggcctctcctgatgggcagagccaggacagatgtgctgctgtgtgccacgacccacacccagtggcatctgtccagggtccaggatgtgggcagctggtctgaggctggatgggagggtctcctggaccctgagcagttccaactttgcctgttttgcctgagttcagaccgccccacggaagtgggtacccagcttagggatgggtgcctgacccccatgccctgcagagaggcacacaggggacaccgggtggaccccagagaggtgggggtggagggagccagaagggaaggggaagcggacatgcacagggccacccactcacgggcccacaggccctgtggccagagctgtcccctgccaggaaagggttaccgtcacgggcccacaggccctgtggccagagctgttccctgctgggaaagggttatcgtcacgggcccacgggccctgtggccagagctgtcccctgctgggaaagggttaccgtggaaatgtgcagctggtgtcaatacccaggcgtggctttgtctctgccagccacacagagtgacatctgccagctgcaattaaacatctgcccgcccgaagccactgctgagggcatgaaagggatggccgggcgagccccatcaggcacaggagggggtgtgggcgcaggtccgggcagccccctccccttcagaggacaggagagaagccccagcatggcactaccccttccctctgcgagctccatttccctgtccctcgacctcagcggtctgccatgccacaggtgcccgtcctcagcttgggtgacaacggccacccccactcaatgaaataaccgtcagggccccgtgctgtcatctgccctggggtaaaagcagctgccatgaccgtctcggctgttgcagggacctgtggatccagatgtgccaaggagaccacgggaacagacccctgagcgcagctggggagcccccaccccaagcccagccccagctggcgctgcccacccggccggctgccttgccggggaagccccggctcccggtgtccctgctggacgttcagatgcccccgagccctgagccccagcgggaatgcagccgcaccctgggggaatgaaggcgggtacgcgaggaagagggcccgaagaggaaaggggctcccgctcagaccacagcaccaccaagtcccaaggcacaggctccctctgcccggcccacctcctgctctctggaggggctggcccctgactcacccccgtggtggggcgggaagggatgggggtgcaggggaggcggaggcaggcatttcgcaatctctagctcagatgcaaggcccctgacaacgccaggcagggacgcctgcgcctcaccctctgggaggtttccccatcagccagaggggaactgcactgggcgtttcccttccggtggatacgatgtttttctttcacccctgggtgcaccccacccccagctcatcttgctccggggtctcccgtggctgccggccacagggccaggaggaaggtccctgcctgccgcaggggtgatggcttaaggcccaggagggcgccctgaagtgactgctgcagagatgagggctggtgggtgggaagcactgagcgtcccgagccagcgtccacctgatggggaccgagacggggcctgcctcgctgggggtgggggggcttgaactcggccccatcaacctcacacacccatgcatggcgccttctcgcagctttgctcctgactgcaacaaactgaaaacaacctgaatgtcctttgataaggcactggagaaatcaaacgtggcggctccttctgacgggtggtgacgcaggacctggagggagggaggagaggcacgagacagacaccgcatggagacccttgccgtgaggccacacagaccatggggcgggggctgtgccggggacaaaaggcaattaactttatctgtaatattttgacttatttcaaaaacaggagaacagccctacaggacaaactgtccatggttcttaacgcgagagagggtggaacaggcacacgcattaccacacaccaaggtgcagctccgggaccctcggcaatcgctcaggcccgcctctcactcaacagatagggagactgaggccagggaggaggaggagctcagcctgcagggaccttagaacacgctagtcctaccagcccagagagacagctacctggctccactcctgcacggcctggcgagggcagcagccagcctcctgcgtgggtgtgaggacgttccccggacgagcccgggacacggagggcacggggagctagcacccaggggcagctccaggtcaggcgacggcccctccctctacctgctccccccatggcaccgccaacccagcacacccagcgacgccagcaacgtcacagccagtaacctagattttaaccaagaaatcacacaccccctttctctgccccacttatgggcttgccgaacagaaaaaccatgacaagaaacccagactgtggcatccagagccaaactgtatggtaggtgggcgggagcaggcctggcctcccagccgcccactttccacctcgctggcatcagcgacacccgtgcaaaggcagagaatgccgcgcagcacctgcggcctggacaaagccctgcaggaacatggccttgagggtgtccccacccctcagccccaatgggactgtacctcgtgtggtctgagtacgggggagttggagggaaggactcaccagagcagctgcctcccgtccccacccaacacacatccgggactccacagagccgcttcctggctgcggtcctgctggctccccaaaaacccatcaaggcaggtgggcgtgagggcttctagctcacgaagtccaggtgatgtgagggcttaaggctgacccagcacccaggggcagatgcatgggacaagtcacgaggcttcaccgtgctcccagcaaacccgacacccagccctggctcccatcaccccaaacacaccaaggcccaaggtcacattggagcagcagggggctgtgcagggaggaccctgggaagatgtttggatacgatgggtctgtttccatctccatggtgcagctccctgacccgtcggcaacccgtcggcagggccctgtctggctgccattgtcggcagggcactgtctggctgccatcaatgggggatgtcctcagggactgtaggggtgcccagcctgtctggggttctgccctgggactggagcccatggacagagctccttcccaacaggggccctgggtgggccttgggagccttccccagcagcctctggctggtcccctgccttccctggggtggctgtcagcaggggcagagggaaagcgcacatggggcggattccccggaggcctcagccagccgggtccacaagcactgacatcctgtacggcctctgtggtgagccggagcccggtgtgctctgccctcaggaagggccaattccgtagctagcaaagctcccagtctcaggaaaaatcaagccctaccccctaccactaaaagaaaacaaaagctgtgaagcccagatcgaggtggcctgtgagctggcattctgtgggattcatgcaaacacagcaatatacatttaaaccaagtgcggagttctcaggaagacaccacggagcccagagcacctgctggcaaggcagtggcttctcctgcaggcggagagggagccaggttggccaaagcagtggttaccctgctgtcccggctgtggtggcagacgctgcacagggacccagctggcctaggggtccaagctggtgggtggtcctggccccctctgcccccaaccagcactgcaggaggggaagggcaggggggcgtcccatcagggcacagggatatgcgtggtggggtggagagagtccctacactgcccctcggggtccaccacctgcccgtggctggcattatgcacccgtacccaggcccaggccgctgcacacaggccctgcatgcagaccagccaggtggccagcccagacacacagtcaggttgcagggacacccgatcctgggcaccaactgtgggactctgcccagcaaagcctgaacagtctccagaggctgtaaccaggaatctccaattagggcaccctgggtttgtggggcccaggacggggagcagccctccttgaaagaaaggaacggagaggagggggagcgactgctcactcggctcagcacaccgggcgcttcctggcccatccctggcgcggggcctggagaggtggtggcaaaggggctgggttcaggggactctctagacctggccgggtgaggcgcagactgaggttaaaggggaagtaggcgggtcctcccgtacaccgcgtggcgccaggcccttcacagacggggaacgtgaaccctggggcaggtccctgggccacgggacacctgcgtttcctcatctatccagtggagacaagacccttcctacaggctggcagagtctcctaggagttcttgtctcatccaggaccaagtctgaaccccatggtgaacagagctctgccacctcctccaggcttggtggggggctcccctgtggccccgcaggcctccggcccagtggcctcctgagccacccgggtcccaggcaggccccgcttcccagccaggtggtgtggggctccaccccgccgcgttacctgcatagctgccggaggccttgatgtacatctggccgtactgctcctccaccatggtgtcgtaggcctcgtcgtcctcctcgtcctcctcgttgtggtacgaggtggggctgtcggtggtgggcaggctgctggcgcctggactggtccgctccccctgggggtagggcatctgctggatgccggggatgagggtggccaggctgggcaccccgtagtaggagacacggggcagtttgagaggggctgtgcccgccgccaccgcagcccccgcggccaccgccacgccgtcccggggccccgtctccagcgggcgcttgggggccaggcctgggccggccggcggcagctccatggcttcatgctttactcgggtcagcagcgggatgggcaccgagggggacacgacgtagggggccgcggcggcggcggccggctgcagctggttgcaggggctctggggctcggagccggcgtcctcgatcacagcggtctgcgagtcgcagtggggcgagctcaccttgaacatgaggtcggtgccgcgctccacgatgtgctggatctgcaggaagccggccgtgtacatgaccacgagctgctcgctggccgtcatggtgagcctgcccgtgtagcagaaggacaggatctgctggaagcaggcgggcggcacggagccgggcagctcgaaggcgctcttgctgttgccgctgaacaggtcgcggaagtagaggctgctggcggccagcaccgcccggtgggccttgaaggcctggcccttgaccacgatggacacatcgcagtagaggcccagcaggcgctgctcgttcaggcagcccagcactgtgttcccgaagttggggatctcgatgtgcagcatctgagacatggcgggcgggcagcggcggggctgggctctcagcgcggggcggccctagcggggctcatctgtggggggcaggaggcacgtggtcagttcctccaggtcacgggctccccgctcaaggggccgttcccaccccctcctcccccgccgggggcttacaaagagcgagccttccgcacgcgccctcccccgcccctcctggctgggacactccagagaagggacacggggtctcccagaccccctggcatacgggcaagagggcccggccagcactgctgcagatccccggggtgctgcccggcaggagtgcgcccacgccactcccagggggctgctcttagcgactcggtctcagcaggcgaggaggagcgcaggcctgaacctgccccgggacaggaggtgggggccgccgggggagcctctgggcaaacctgcagccactctcctcccctcaaaaaagttccagcccgcacaggagctcccgggaggggccgcgctggagcagcggggaaggagggagggagggggatctctggagctgtgcagtttgcggtttgctttccctctcttccctccgagcagcctcgcagagggcccctgcggggaaggcgggccagcgtcccctagtccccctgagcctcccgggcaggtagggaatggctgggggtgccgggaagtccgctgaagccgcgtccactcctccctcgcgcagagagaccaccctgggcgcgcccgctccgttctcccgtgctctcctggctcggaccagacccaggttcccaagccgccgccagggcaggagttgggaagcctgtcgcagccccactcgcggacgccccccaccccgctcgcctcgctccccacgcgggccaatcccgacggcccggccccaacccaggtgactacaggggtcccagccctcgccgggctgcccggaccccggggctgggagctggggagggcgccgctgtttatctggtgcggactccggagggggcgggggcggcccagaaggcgccagcccaactccgcagggccgcacaaaggccgctgtgtcccacgggaggaaagtgcgggcggccgcagaggcgccgggtggcgggaggagggcggagccaccgcgccgggagctgggcaggtggacgcgcgccgggggcggcccgcagtgcccccgctgcggagaagttgccggccggtcgggaagacctaccttcagccgctgcggccgccggccggcactgcccgctccgcctggcaggacaggctccccgcacgcagcccgcctgcccagctgctccgcgaatgcagcaaacggagcgggagccctggggcggggagggcgcagggagccggcaaggaggaggaggaggaggaggaggaggaggaggaggaggaggaggagatggtggaggaggaggaggaggagggcagagcgcctgggcgctgggctcgcggccgcagctcagctgcacccaggccggccctcccgggcagcgcaccgcatctcaatgaaggggccggatgcagacgaacgttccggcggctcgggaatgaatagccgcctttgatttgggagccgaagtaaatgccagctcccagccccggctttaaaaacagtggagtgttggtgccagaggaatgcgcggccccgggtgctggtacgagacagacttttgatgactcactgcaatgcaaacaaagatggcagaaatactgtacagtagtggagaaatgcttcccggtgccacggcaactgagacagcctggaaatttatggtgcagttttgcatatgaattacccagtaaactgcctcccggccttccaggacagccccagtgtcaaagcatttaaactattccaaacagtctgcagagctggcagagctgaactcctccagcgagggtggggaatgggcagaggcgccagggggagggggtaagggggtcaggacagctaggggagccagggaaggggaggggaggtacagcagggggtgaagagaggcacagaaacggcaggcagtgggtgggcgaggcggcaccccaggtcctgggggccttagagctgtgtcctctgcccaggcggcaggcccgggagtccagccccagcacccctccccatcccactcccagcgccctcctggcactttaagaaaagagcgactttgtggccgggcaaccaggagccggaaggggcagccccgcctgagaggtcccagcagagggcaaagcggccgcctcgctcctcccgcacactcctggctgcggccacacaggctgcacctcctgcccaagggggtctgcagcgtctggctgttattgagccttttcctgggaaggggctgctgctgtgcaggacttgtggtggccccgggacccctccagagaatgtgtacttcatcctgggctcataccaccctctctgcgtggggccctgaggctgacctctggactgcccagcctcagtttccctgccactggctgtgacccccaggaagagcacattccacccaaaagaaggggcagggtccaggctcgaggccttgaggtgagccccctcctgcttggccagctgcctccaccaccctcggggtaaccctggcagcaggatgcggaggaggcccgaacaggcctggtgggaggcaaggcgacacagccctgcccctcactcccggcgcccctctgaggcatccggagaccagagagagggccatctggctcctccctagtcacacaccatgggctcagcttctccagaccagacaaaaagccactgaatggggacgggaagagatccaggtgcggggaagctgccggcaaaggcccgtggaggtggcttcgtgcctagtgttttctgcctcctacaaggggctggtgacaactcaaggagactgggatgggggcgtttacagaaacgtccccactcggccatgctgatgagctgggctccaccgggccaggagacacagggcccagctgtcaccctccccgccacaccctccaccctcaggtccccacttagtttctgcctcatccaggaagtctgccaagtgccctcataagctcggcaagggctgaatgctggacacaacccgggcaggggggtacaagagaggggcctgtgcaacacagcacagagggcagaggcccctagacagctcccttcacagacccactgcacccaccaccaggagcctcccagagagcccgtggcttctgttgtgggcaacttcgccccaaggacaggggggtagggatgtctgagtcatacaggggcttttgtaccaaaagaggggacaggcagaggccagcacggcgcaccggttcctgggggtcccaagtacctgggctgggtagggcagcagccagggctgacacagacagcaagggacaatgtaggctctcagcctgtcccttccagcagcaagagggtcctggcctgttggcaaggctgaaatcctaggtcccgtgggcaccagccacttcctgtaaggacacctcagcctcagacgctgagctgtgaactggggttatgatttaccctcagatggttcctgggggtgaatggaacaatgtttgtgaagccggcggctgaagcctcacacacagaaagccggtgatgcctgcaacctgctgtgacctgggcaggagagcagctctcagctgggcatccaggtgggcgtcttaacgcccagcccagttcggcctgcgtccgcacctcaggagctggagccccagggctgggggacagaccagctctcccagagaagggaccattattccctttgaaggtgatggggccgtgtggtccctggggatcgaggacaactggagcttttgctggcttgtcctcaggccacctgcaccggtgaggctgcagccccacgccccagcctgctgagagccggacaggagctggttttaggttgctttcttggaaggctcaagaacaaagctgaactttaggagaaaagaataaaataaaggcttggctcacgcccccagggccaggaaagcagacacacgggggctgaccctcctgctacacccagagaggagggggccgagggcccaggtgggcccagggacgtgagcagagctgtctgctcaggagggcaggggccaagcctggttctcagacatcagggcatccccaccctcccctgcacattctccagtgactcagtttccccaccactttgcttcccaagcaacacctcctattgtttccccttctcggtgagattcaacacactcattcacttatggaaagttctgcagagccaggcaaaaaatcagaggtcgccaactttgtttaccccagccatcctcagggttgtggcaccaacgacccttgctctcaaaacgcccttcagaacagaacccactttggagaacctctgcaggtgacccaaggcccgagtccactccctgcagctgtgccagccttcggtgccccaccccacacagacacacagaggaggctgggttcctctgagcccacaagccaccctcaggaataagaaaatacaggtggctgtggtgtcggagtggggggtctctcctctgcagagcctcacttgaggaaggctgagatccaggcctgccctgccctggggttaggggttgcccaccatgatgagccccatacccagcaacctgccgatgggtgagaggagcccgcggggaggacaggggctcactggaactgcagccagacgcgcacacaggggttggggcagcgtctccagaacgacccccctgcctgagtgtcgtcccggcaggattcacacaaggacacaggttacgaggttggtgccaggccagggcacctgggtcctggcatcaagtacccaggagcagaggctctggcaggtacaagacccctgaaagcatcccccaggccagaggactgggacagggaccagtcaggcagcccaacaggaggagcccttttcctggggcccagccaggcagctccatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaagatgcctgtgacagaggccaggtgctgatacactgcaagggctgttaacttctgtgtgacccagagctgaaatgtccaccccagagtggacagtgttcattcttggtcatcagaccctctttggattacagatctgctaagcaaagaaggaagcaggccacctgcccccactaccctagtcaggactccacatagagccctcaggcagtccccactaacccggccactagggtgcccacagtccttgagattctccctaaaaatgcttacattctgggcaggagaatgctggtggtgtggccagagaggatgtgaccaaggcctacatgtcatgagttaaaggtcattcttgccatacctgatggtagcaaagggaggagacagggcactggtaggagaaagcactcaggagagttgaagtaaggaagctactctaatttgtcttgggttgggaagggggcaaactgagttccagcaagaatccaggggtggagcaggttagagaagtcctatttgggggccagagtgggaactggaggacactgaggcaagatctaggtaagactctgtcctactagggaccccaagtaagcaggtgccacaaggtccctggcccccacatctgcccttgacatagctcagctcaaagttacaggatggaggttgggcaggtttaactaagggtggttctcagtgtgggatcaggatcagcaggagcaccccagggtaacttgttagaatgcaaattctcaggccccaccctagactgaaagaatcaaaaactccaggagcagggcccaaaaatctgtgcttcaacacgccctctaggggattcagaagcacattctaagtttgacaactgttgtcctgaaggccccccggcactcgtagagcacaggatccagggtgacacattgagggcactgtgaggtgctgctggagaaagctccattgtgtgtgcacgtcacctctctctcatataaatggggcatttctgatgggaaccaccatcacccagacttaaatcagctttggttttaattattttccagtagtaatgaggtaggaggtaggactcaactcccagcaggacgctggaccaaatggagcactagctgaaacagggaagaggtgaaagcacctctccatgagacatacccaccagtgtgccctatcagtttactgttgccttggcaacatccagaagttactgcccctttccatggcaacaacctgacaacccagatgttaacattctttttctagaaatttctgcataatctgccccttaatttgcatataattaaaagttggtataaatatgagtgtggacctgcctgtcagctgctactgtgggctcactgactatgaggtagccctgctctgcaaggacctctgttgctgctctaccctgccacttcaataaaagttgctaacaccactgtctggtccttgaattttttcctgggtgaagccaagaaccctcccaggctaagccccaatttgagggctcacctgccctgcatcagtaagaggtatttgctctaaaccattcacttccttgtctgttccctctgtaatcaataacatgcactttgtgagccaagggcaggtggaccagtaatctgcagccttggatcaaggcatacactagagctgatgaattgagccttgctggcacatgcttcatggctagccaagcttgaaaacccagaagaactggggtaaagctgagcagggtggatgcacctatacataattagtgcaactgactccagctagaggaagcccagatagaacactggttctcaaccttggctgcccattggaatcaccttgttcagaccaccaggggcatggggaaaaaggtcaccactgttccttccatgagggcctgacagatgggacttgcaatggtcctcacccactctcagagctaccagcctactcatgtggtttgattcatgactggatcatgtgagagctgtggaacaaccagcttctaccacaggaaacagacgctgctggctgcccatcctgaaggcagccaagctatttctcaccaaaggaaggaatctctgtcagcactcacatacctccttgggaacctgtggggcagaagaaaagagcaggtcacctgagagctccaaggtcctccttctgctccttttcctctctccctatgtcttgcaaacagactgtgcagtcctggggcaactgaggagacatttgtgctaaagtgagaagccagtcagcatttctgaaactggaacactactgatgaatttcaaggccatctataaataggatcctagaaatctggtgggggaccaccagatttctaggttctactttcttattttctagttgtagaatctaccaagatctcaaattattcaggagtaatagccttggggtttcaatgagagctaatctcttcttcagacctacagacctggtgtccaagatcaagagtttgaccagagtgggggaatctcactcaacctgagccatagtttattctgcccttggctatggtgaaatggttcaagaacaggcacatgacccaagctgagcccatcagagacttacttctctgggatttctgaattggaactaacagaagggactcctttcttaatgctagtgatattagggaatgaagaaatctagactagcacaatgtcatcagcactagagaggagatgtggaaagaaagaatcctggtagtatccaagtcccttgtcccaagccttcatctccttcccttaatttggtttcatgagctggtacactattttcactagcctagctcgagttgggctttattatatgcaactggaagtgttgactcccataagagagtagctctcagatccagagtagaagctttcccatgcctggggttcctatgccaggctagagaagaggattcagaccccataatttgtccctttccattctttgtccctgacacataggcccttttgaccagaagaccatccattatttgtggtttaggtctatggtcaactgcctataactctgaaaaacaacaatattacagaaaatgtgtatcagctggcatgctcacttctggagcccccatgggtcattggcagcagaagtagaagagtccagggtcacagtcattcctctaattttgagtgtaaaaccaaaatcacccatgcagaggcctcacaagtatcttcctgtcagctcctggcctaatagcctttacacacccttggcaggggcttgcccaaccacatgggccgtctttccacaaacaacttgaccacctctgctgccatcagtatgctccagatccaccctaccaagaatcacccagcagaaactgagccaggcaggtggggcctcttggtggcacaaatccagagcagcgaggtaagggagcaggccttagccactgcccatgggtggatggaaagaaacagtcatctttcaaatgcaggatcctgactgcaaatgacaggctggcctggcatcactgcaggaagatagaggggagagagaggaggccagacaaggagggctctttagtctttggaggcacctggctgcttctcagtcagcagcaggttttcatcctcaatccaaactccagttaaagcaagagaagggagatacaggaatgagaatatggcacccactccctgcaaccccagctactccctataaccccagctacttctgataccctcttaacctgacttttaaactgttttcacttatggatgtcatgctctaaattatatgcctgtggccagatatagaaggaccacagatcacacacactggaatattttataagcagctataatttgatgactaaaaaactgatatgctttatatattatttatgagcgcaaatgtcatgccacacaaagctatttcagtccctttgaaagaatgctttgctggtctggttatataaggtaggcctggctgagtgcagtggctcacgcctttaatgcccgcactttgggaggccaaagcgggtggatcacctgaggtcaggaatttgagaccagcctggccaaaatgggtgaaaccccatctctactaaaaacacaaaaattagccagatgtggtggcacgcacctgtaatcccagctactcaagaggctgaggcaggagaattgcttgaacctgggagacggaggttgcagtgagccgagttcacagcactgcactccagcctgggcgacatagtgagagtccgtctcaaaaaaaaaaaaaaggtaggcctgatggatgaagaactgagtagcccaccctgcagccatgcccacctactattgactctccaaaaccatcacttaactttcaagctgccaagaaatgtccttttggctggaatgttctcccttgaaatcaagttcatctttcaaggttctcatcaaaatctcctcctcgatgaagctgaggtgaacccagcccattgtgtcaggtccccatcacagcagatctgacctgctctgttgccagtggagtgtgcatctcactttccacttcagattgtgagcaccttgagggcagtaactatgtgataatcctccatgtcctcagctttcagcacagcacccggcacataatagatgctcactacagtttgttgaattgatgcgcatacactaagtgcctactcaggtttttatctcttcaaacagagtctggctttgtgctacttacattctaggtggagatgaaagagccacactggagtagaattggagtttatttatttgcaattcctttctcctgccatcaattagcaattattttccaactcccattcttcaacataaaatatactcgcatgctcgtgcatgtgcacacatgcacatatacaccctaaactctaaagccctaaattccagaatatgagaaataaagtgtggggtgcagataggatctcgaccattgcactatttccttactggtttcttattacaatatttttttcatacattaatttatactgagatattgggcctccagacagctcttggtcttcctgattagaattgtatttttcccaagaaattcctttaataaaattgatttaaaaatggccaccatgagccccgctggaatttgctataaggagtctttgcctgtataaaaaagtggattccaatttgcttctggctagacttgtcaagacacaaaggtcttgctttaacatatctgtgaggctgttaagtctgtagaggggtggctgccaggaaaactggcatattagtcagggactgcagcgtgagcccagagacagctgtattccagagttcagagacaccagaactgaaaatgggcacgtggtttccatcaccccagctcatgccctgtgtgctccaagtgtctcaaggcctcccagggaatagttgtctttggctcccatatccagcctccttccctgactcagtgatgcccctcatcttccttgtgccacctcaagtgccttatgcccccatgttcttggctcttgtccctggggaagcctgtacttggaaaagagtctaatgaacacatgtacactgagccctcaatgacaggcaaaggttaatgtatcacacatctcaatgttaacagcagagacttaagccataggaatgaatctctaaatgtggaattcaggcctcagtaaggccactgggagaggtatatagaggagcaaggacgcttctcgattaggaatactccagcaataggaaagatgtgctacaatgactggccaagatattcagccccaaaacatcaagtgtataatgaaggacaaacccagcacagcagtacctggtagacggcatagccgatgctaagcatgccttgtcctatccgcttccgccacctgcgatttttctgcatcaggcccagcagcactgtacagcagggttcaccgatgctctcctcctggtcctcatccacttcatccaaacggattttgaactggggattggtccagtacgtggctggaagtcacccaggtgatggtggttccccacgtagcgggtgaggagatgaagaagaataaagtaaaagggaagaaacttgatcatcctaatgaatgcacagctccatccaaactgtgcctagtaagcaggcctcagaaagtgttctttacaaggtggtcaggcatttcctcctaccttcctacacatccacacacacagacatatggcatcgcatttggaaatgtgtgcttgtccatttgatcaacgaggagcccagaagtgcttgactgggaatattcaggatcccatgatccgagggctacactgggcagcactgcctccaagtcttcctggggaaagacttaacatcaccttgctctcagcacttgacatgtgaaggcaaacccaccttctggaggaagggagatctctgggtaaaaagcatgtccccaggacagtagaggagaaagtccctgaagagactagctaccaaaaaggtctctccgtgacactattaagacaactgctcttgccatctgattgacacctattctccctctgagagggccccagctgcagagcacagcctgcggcacccctgagaactaatctgctgtccatcaccccaggggcctcacaggatggcttcagtgttgcagcccactgatgagacacactttcttcaagagaaagtcatttaataatgcatgaggaatcacaattggcaattaagaagcagtcctgccacaccacgtatggatattgaaaaagactccttcatttcaaagatggctttttttaaatctctcagaatagtaagtacacaagccaaggcacggagagattaaaaggatcatccaaggatatgcagcaagtctatgacagagtccagtggcagagcaaaattgcagaaggcacgcctgacaggtgtctccactctagggcctcaacaatttcaataatgatgtgcccgggaggaaaaaagaagtggaagggcatgggatttttccttacatcctttaaagaagagtctaacttggaaaataacaaggcattcacaggtgaccaagagccattgattatcacttttctttacagtaggattacttattcaattccaccttctcagaatccccacttccactttttttttgggggggggggttgtttgttttgttttgttttgtttttttgttgctgtgttttgtttgtttgtttgttttagggctcaagtttatggattttaaagccggatatctgtggatcccataggagatggaaaaaaaaatctgtaatcgcctatacttccatcactaccaaagggcaggaactatccatgtcttcctgacagctagttggcagcatggatgggactgtgatttggtgcatccagataccttgtgcaccccctacagttctgagctcccaaaatgatccatgcaaatttcctccacattttctaagagcttgctaatggtgagcatattttaatttctcccaaatgcaacattactgcaatccatacattttttgtttactccttaacagtactggaggaagagaatgggccataaaaataatactcccatttatataatgctacacagtttacaaagtgcttccctacacactctgtgttccaaggcttgcagtgacccagtaaggttggaaggttgaaccccatctggaggactaggaaactgaagctcagaagagggaaatgcccttcccagagtctaaatcaagcaacaagggcaggatgtggacccctttccttcctctctgttcagcactctggtcacagctgcctgaaccgggagctttgggttggatgggtgatgaaagaagagagaacttgtcaagacccagcactgcatccaggtggggttttattctaatgctgcttccctagcaccgagcacagccctgcagtgagctctgtcatgagaagaaagtgactggccctgccccatgcgcttacagtctaagtcaatcaacagatcaacagcaaaccaggcagggaacatggggagcaggaggtgaaaagtagagagagcaggatttgcttttcttcatttctccttagagatgtggggctgtcttcctgagtttcttcatcaggtgctgcctcagctgattcaacctaggaggagcctacacagggacacattagtgatcttctgcgagccaggaaagcttcccaccttgcaccaggtgaggacccagggttagtgcggaggccatgctttgcaccatactatctccaccagggtctgagtccccatgacacgcatgccctgtgtgtggccatcacggcccacgctgtctttgcccctccacctccaactcaggcacaaacacacagtgaaacagcagctctattggatgcagcctattgaaacagcagatgttgtacccgtgttcccctagcgcaccatcagccactctgtcccagaggtcagcagggtgactgctagccagctgggtgtggggaggggagtggggaggaaggggcaaaagcccaagggaagaacaggaggccttagcataaggtgccaagagcagggctagtgtggaaagcacgtcctttgcgggcagggcaggtgggtgaagcagggatggtttgaacacatggttcaggctgcagctgagcggctgcagagccactgcccaccctcacaaccctggcctccaagccctagggagaagcagggcctccagagggtgcccagaagtcaaagaacaaagtccaaaggccttatccaaagattaacacatagggctgggcacggtggctcacaactgtaatcccagaactttgggaggccaaggtgggtggatcacttgagcctaggagctcgagaccagcctgggcaacatggtgagaccctgtctctacaaaaacattttttaaaaattagccaggcatggtggtgcatgcctgtggtcccagctactaagaaggctgaggtgagaggatcacttgagcccgggaggcggaggttgtgatgagcagagatcgtgccactacactccaacctggggaacagagcaaggccctgtctcaaaaaaacacacaaaatagcaccaaaaaattacataaaatgacccagctcagggaggataagctggaggaggttgggccaaggcagcccttcaccttacctgggtagttctggcagcccccagctgtggagccccgggtccagtggccgttgaacaggaccaggttccatttgtgcacctcctcgctactcagagagtccggggacaggttgcagatctccaaccgagagaactgcctcacgaaatctgaaagtgacatcctggggcagaggcaccagagggctctcagtgaagagggctgggttgtgattaaaggcacgcatactgagcacgggaaggagccctgtggcacaggccctagaggccgtgggctagcttgatctttcctacagcacactgatacaaacacgcagagacaacagtccacattcttcactagcgctagcttcttggctcttacagggagccccacacacatatcttaacaaccaagcaaaggatctgaactgtaaactgcaaaagaccccaggaggtcatctcaacaaagcctctgcctctagattgggttaagtctaagctcacaagaggtttctttttgtttaattcggagtgatgtccagctaagccgtaccatattcaaggagtatccttattatcttccttagctcactagcaaaggaagttctcccatattgatggtaggtaaatcttagcttaaagagatagaagcagtgctctcagttcattggaaagataatagaactgagaaagacaggctgatagctaagccaggttgagggcctagatatcatggtttcagtgctttagacgtgctggtatagaggtggaattataccaggacaaaaggagaagaatgaattcaccatgatcaggaaccatgtcgccttcctggaagacccagagacctagagttcacatcagaactgaaaatggacccatcaccaatgggacagcgcttcagcagaaaactctctcaccagaattctccatcctcaactttcttgtccagttcttccttccgccgggggtctatgtgattccactctggtgcactgaggggaaaacaagcagagatgctcgctcctgagaggttctacaagcagggcaagctgtttactgcagctaagcttccccctaagagccagaaacaaaataccaaaagcactgcaggcagacagaaaggcagaatggacagtgtggcgcgagcacactgtctggggaagggacacagacccaggacacggactccatgggcactagcacgatggccttggacatgtgccaggaacattatgactcaaacattatgctctaatttttactctctagggcaaatttgacatttctaattaagactcccaggcccctgtttgcaggaatggggaggcccaggagagaacgtggatgagttctcgtcactggaaaggcaggcactccagtacccattagtcacttatcactctggcttatccagcagtctagggtgaatatgctgacagagtctaaccagctctggggacatggacatggttcacttccttacacccacgagaatgatcatccagcccagttttacggcaatttcccagaagaaacgtcaccctgtgagacctcctgctggtggcctttcaagggcaatatctatgcactttgtttgaatgccatctccagcttcctgacctttacgaagttaggttttcctgaaatatgtatgtgacatctaagtaacagagcagtatcaagatccatctttaaaaaaaaaaaaatccctgcctgaataccttcagcaaaacctaagcaccttctctccccagcataagagctggggcacactccagcgcagcctcttcctccaagccaggctttaagaccccgggggtcagcacgacaattcccagagcctcttcaattcattgaaacattaatttgattaaaaccaaatctcagaatgtgcttgttataaacaaagattagggcaggagttggaaaattccagatctgacctactgctccaatttcttttttttactttttttttttttttttaagtaaaatctcactaatccctgggctgagcttagggatgttgccttagagattcggcaccctcctcctccaatagctgatatatataattatcccaggttgcatctccagctggtagggcctccaggacttgacagtcaccacctcccgcctgccagggagcgggtgctcagggaaaggagagaaagtcaaacaagccctttggacagctcggtagtgacttttggtaagaatggcccacattcagggtttcaatttcacgtggccctgtcatccttttagggaagttggcggaactgaggttttgggttttgctcaatcttacacagtagaatgaaaaatccttcctacaggaggctcatgtgtggccctagagacacgtgtttcttcgtgacacaacctgaagggagttactgcccctctgcgtggtcatgacatgagcagtcatgatgctgtgattaaacttggcgatgtccccttcgaaagccctggtggcatcacagagtaccgacagcacttgaggattaaggacgtattgggagggggcattattgtgaccattttcatttctggtggttctttgtccatgagactggctaattattttttttttttaaatggagtcttgctctgttgcccaagctggaatgcagtggcccaatctcggctcactgcaacctccaactcctgggttcaagcgatttccagctaatttttgtacttttagtagagacggggtttcaccatgttggtcaggctggtctcgaactcctgagctcaagtgatccacccgcctaggcctcccaaagtgttaggattacaggcctgagccactgtacccagctgagactggctaattctaattcctcccccacactaacctgcctctgccaggccagctgtgctcactggacagaaaccaccccatgctttccaccctcctgcatgatggggacatggattccagggcccagctgtcctgggacatcaccacctctgactgactttccctcatcagcagagaggcctgcccaagaggagtctctccagtcagtgatcaaacgtgcctagggtaggagcgagtgccgctgcctcattcatcactgctgccagggcccggggctcctagggtcaaatttcattttctcagcatccttgtttcttcttggtgctgaggggtttggcctttgtcagtgtccagtgtttgtggagtggaaagaaacagactgtgagtgatcgatttgacctttggaccagcacggtgcgtcaggtaaaaaacacaaaaacctttcagcgcaaagcaaaattccacagagccgccaaactttcaaatgccaaagcagaaagccagaatcgaagactacagcccagtggtttttattttgcttttcccagcctggatccatttaatactcttttctgaacacactgtgtgatctgcagacaggacgtgctgctgaactcactgtgacatcgatctcattgttgtgtgttttacacgacacccttccgcagagggagagatgactggagaagcgggggaaaaaaacctactcatcgctccaggctcccgaccactccacttcaccccatggattcctgagtctgatcagcttctctggatggccctggaaattcacctgcaaattccatacacagaaaagcgactgaattactatgctcctgttgccttgcaggcatgtctgcacctgacaggatctgcattaaatttttcaaatgtccctaaaggaccacacttttattttcctttaatgcatcttttcaggcttgggccaagtgttttcataatttgtttgaataaatgaggtatttttcataatttgtttgaataaatgaagagtgagtctagcccaaaaacaagcttatgtctgctttaactcagatttagattttatagttgactaagattgactgagcttttaatacatgagacctaatgataataaacgccctccaaacaaacaccaaagcacggcagttaacatttatcgagcaggtactacagatgaggtgtagtgctaagcattttaggtgctttattgcctcatttaacactcacgacaatcctgagaagataaagaattatcttcatttcatagctcaaaaatctgagacttaaagaagttacattatccgagattatctagttagtaagtggtgaacgcaggccaggaactcaggcagtccgtctccaaagcccatactcctaaatccacatatactgctttcccctatttattgaacactcaagcataagccccttgggcccctgcacacacactggcattcacatatacacacaccaactgtgtaggctgttaggtcctcattgtcttcatttcctgtgtatcccccaactcacctagcccaatgtttgcatgtacatgttcaattcccatttatgagattaacttcattaaagagcatatttgggccaggcgcagtggctcacgcctgtgatcccagcactttgggaggccgaggtgggcagatcatgaggtcaggagatcaagaccatcctagccaacatggtgaaaccccatctctactaaaaatacaaaaaaaataattagctgggcgtggtggcgcgtgcctgtaatcccagctactcgggaggctgaggcaggaaaatcacttgaaccagggagtcagaggttgcagtgagccgagatcgtgcccctgcactccagcctggtgatagagcaagactccacctgaaaaaaaaaaaaaagaaaaaagaaaagcatatttatgaaacacaaacacatgtaaagaacatctgtttcatttaactctatttatttatttatttttgagacagggcctctctctgccacctaggcaggagtgaagtggtgcaatcactgcaggctctcaagcgcctgcccgggctcaagcgatcctcccacctcagcctcccgagtagctggaactacaggcacaccctactatgcctggcctatttcagttaaataaataacaagaggtgggacattcattgcatttccctttctgccttggccattgggaagcccaaagcaaaattaatttctcaattatagcactgtcttcagcgtggattgatgtattttacttagttgtgtggttttatcatgtctgttcttttaatggtaaaccactagctgggtatggtggctcacacctgtaatttcagcactttgggaggccgaggcaggaggatggcttgaacccaggagttcaagaccagcctgggcaacacagacagactctgtctctacaaaaatttttaaaaaattaataattagccaggcatgatggcacttgcctgtagtcccagctacttgggaggctgaagcaggagggtcacttgagcccaggaggttgaggctgcagtgagccaagatcatgcaactgcagtcccacctgggcaatggagcaagaccctgtctctaaataaataaataaataaataaataaataaaatcattgtaagccaccttaaatcccttttgaaagaagacacaatgtaggaaataaaaataatgaataggccgggtgcggtggctcacacctgtaatcccagcactttgggaggtcgaggcgggcagatcatgaggtcaggaaatcgagaccatcctggctgacacagtgaaaccccgtctctactaaaaatacaaaaattagctgggcgtggtggcgggcgcctgtagtcccagctactcaggaggctgaggcaggagaatggcgtgaacccgagaggcggagcttgcagtgagccgagattgcatcactgcactccagcctgggcgacagagcgagactccgtctcaaaaaataaaaaataaaaataaaaaaaaataatgactagtatagcccatgttttttcctcgggttggagagtgaggaatacttacatgcctttccatgactctaccccaccctaaaagctgggactactgccccttttcctgttttgggattttgtgagttcccactgttttgcccacacaaacatattttttggaagatctgtagaatctaactgacaatctctacagctttcctggctgcatctaaggagagggcttgcatttagttagaacctattgagcaaaagctcagagaggttacgttgtccatcttcaagtgagtaagagtcagaagaaccttcttttattttttttgttttagaaaaaaaatttttaattttttcgtagcgatgaggtcttactatgttgcccaggaatggtcttgaactcctggcctcaagtaatcttcccacttcagcctcccaaagtgctgggattacaggtgtgagccaccacacctggccggaagagctgttctaatgagcaaaagctaatgctcatctgtggtgtcaggggttctgtacaggcagagtgcatcccaatatggcagtgaagctcaaaagccaattccgaaccttctagtagtaatcacctctttcctcctgtcgagatggcttggattcatggaaatattatcacacgttaccttccccaccttccacacaattttacctcttcgactccagtgacagagtacgcatgactcttaaccagcttctggctggtgatggcttcggcttcggctgcactggagacctgcgtagagaagaaagtccactcagtggctgaccctgacctctcaggggccggccgtagaatgctttccaaggacacactacacagccactgggggcttcagtgtgggactaggggtgtaggcatggctatgaacctcaggtaaagagtcatctccatccagactccctctttaattaggcctgtagttccgggccagtgcaggtgcctgccaagcctggaagacaatttaccagccttcaaaatgccaccaagaaactgggaagtcatttattctctgagagtgacccccagctgcctgaagaaggctaattctccatgctgatggctctggacaggtcccagtcctccaaggttctccctgagtggactcctcattacccttcccatttcctcagcaccccctctcccatgccccataccacccctccaccaaaaaccacatctcctgctggggtttgcagagagaggaaaaagggaggatcttctcactttgtcgttcacatttctaaaatcaccaggtaaggacaagagaggaagacagggcagccagagggcagctggtcacaggagcccgaggtggtgacaggacctcagggctgggggcctccagcctctgtttccacagccaccttggaaatccacacagctcagcctcctgtccagccacagcctctggtttcagaacttgtcttttcttcagggatctcaagatccatcaggtatcatcaatcatcacatttgttttccaaaacctcaagattatttagcaaaaaggaggtagcaaatggggggcctaggatccagggatcctagactatgttcttagggccactccagcagtactgaaggggctctaacaacgagagggaaattggggctcctgcaatgcaactaaccccagttcctacccactaattaggtcttcaccagcccctatatgttcaggcctttgtgtcactagacttgcccactaagctccagactctgctctgacccaaagccttcctaggcctctctcccgctgtctcatcccttccctaccacacaaggggtggcggtggggggaggtggggcagtagagaagccatatgcctcacatcaatggagcagcccagcagagaccccgcacagagggccttccggatgatctgatatagattggctggtggtttcttcaggtcataaaactcagagatgccacctgtgaaatcctcaaacccctccactgtggaacctccagcgagagcctcataacaaccattaagcctattggaaaagaaagaacacatgctccattagcaccctcagcaaggagacccggggattggggaccgggacagtgctaggacatactgtggcctggaagataaaggaaggctctttgcctattttgcctatgggccaggaaggtgcttaggccactgtttcatgtgcccagctcagcacttcactaggaactgacctcagccaacctctctccagccaccccctcctttacaaagccaagggcaacccctccagagttggccccagctgcctgggtttctgggggctgggggcacagatggggagaaggagaactttccctcaaggctgagaggcatctgctgaggcttgctgggaaatagaactggaaaggaactggggttgcagaaaagggtatcagtaaacaaaactaattaaaagaaccccaaagaaggttttgaacatcaaacgctggtgagaagaactcctgaggaaagagcagacactttgttgagtttggtatctagtacatttgttttattattcttcatcattcttttaaacgtttacattgccccaggaacctaccttgggatttgaaagaggaaaagctcaggcccagaggggcagggaggctggccccaccacatacacattcacccgaggcagagctgagatgctaaactccccgcccagatttctgtttctcttagttactgaaaaatgctctctctccggctcatgggggtctggatgctgggaaagacgccatgacgccctgagtttggggtggggaggcagacgtgggagggacaggtgagagctttcagggaggctctggcgtctcccagctcctggcttcccccacttacttggcataggctttctccagcagggcactccagaattcattgccttgttccgagtgtaggaagagcagctgtccattcttggtgggcagcctgtcgtcaatgaccacctccacccactctccgtactgccagaactggggaggggggacacagcggctgctcacatgaataagcagatgtgtaaagggagtccctccaggggacctcacgtggggactctgtgccatcagtgttcgagtcttggctccttaggagcaggacatgtgtctgccttatctgtgcacataggagatgccagatgaacccgggaacatctagtccagggtctgcgtttgtgcatcagagaacttgcccagcgccacctagtggcagcaggaagtgattcagacccacacctcctgaccctcagtccacagggctttcctgaaggccacgtggcctaggggagctgggaagaggatggatgtgtggatatctggatggatgcattaaagcagaggttctcagactgaagtgtgcatcagagtcacctagagggattattaagacataggtcactgtgccccaaacccagaatttctgacgcagtggacctgcagtgagccctaagaatacggaaaacagcaacaaagggccagagcagagcacagtacctgaaagtgaaagattcccgcatagttctcctggaagtcctggtccctggggaccacccggtaaagcagctcttcattcagggtcagggaggcaatggcagccagaagccagcagtcacctgcacagtgtcacaggggacacagattggtcaggcccagcctgcaggggccctgctttctctgaccctgtcccattcaacccagagtccacgttgccacattcccttctgagtcaggtagagtttcctcctccggtgctggaaatgcacccgcagccatcagcttcttctgcctccttgggatttgtttactcgggagtggatcctctgctcctccctgtggctgccccctcccccacatgctgatcatttccccactcctacacattcagccagtggagtggaaaagaaaagaagaggagaggagagaaaagaaaagaaaattagtccctttggtcccttattagcagctctgattaagttggttgagggaaacattgaagctgttaatccaatctatgatgtgtacgtgtaagagtgtgtgtgtgtgtgtgtgtgtgtgtgtgtgtgtttatgttccttgcccctcctgaccttggataatgaagagctggctctgcgtggtctgtttacagtattgccttttcttgtttcagagttcaccaggagagccttgatgccttattgcttaaagttcccttgagatactgcttagcattaaatcatcataatttgaggcagaagaaataaaagtcaagagaggttacaaatcctgggttttggtgttcgtcacattggagattcaaggaaatgcagaagaaaacagaaaacccctttctgtgcaagttgggacccaccacactgatgccactgagtggcacttccctgggaggcatcgttgtcccttgcagtgtcaacttcaaaagaagtagcacgggccccaggcaccactgcctaccttagcatcctatggcgaatctatcatcctagaagtgacgtaactttgctcacctctacttatttgcttattccacaccagctgctgaggtctcagtgtcctcaagcgtgctttacatcatgtgaaggctattgcatctttctggcctggtactgcttctttccaccttcattgtagatctctagctctaggagtctaagatttggtgaacaagtccctgtttctcctattcattccattcaaacagctccaaagtcctacctgtgcatcttagcctttatcttttccatatcaaagatctgaatcttttcaatgtgtgttcagatggaaggcccttcaaccttttagagaccatctgtggaccttgtctcactctaagttttcttttaacactgtggccagagctatatacatattctaggtgtgaacacattatggttttctcagaaaacctgttgcctgagcaagcagtaagccaggaacccacatctgaggagccaacatctccatcatcactcagaattgctccatcaccaggtcatcctagaaagccctggcctctgtctgcctggatctttcccaacaaagtcattcatgatctgaccccaaattaattaattcctctctctctctctccctctctttttgtctgtctgtctctctctctctcccgctcactcgctctctctctctgtctcacacacacacatactcatttactttctttttcttttaagagacagggtcttgctctgttgcccaggctggagtacagtagcgccatcatggctcactgcagccccaacctcctagtctcaagcaattctcccacctcagcctcctgagtcactagaactacaggtgcatgccatcatgcctggttaattttttttttttcatagagacaggatcctactatgttgcccaggctggttttgaattcctggactcaagtgatcctcccatcttagcctcccaaagtgctgggattacaggtgtaagccaccatgcctggccatattactttttgaagagcttttctgatccaggaggcaacctgcttcctgcctcactctctcaccaggctctgtttcacagacaaacactatcttcctaatggcaacagggctcctaggtgagactagacctggtagtcgagggaaacagagttgatgtggatgggctggcatgagttatgttacttctcaccaaagaagcctcaagcagggcagtctctcattaaaaggcaacttccaaaggttgagcaaaataacacagtgtcctcctcccacccagctcctctcagcccatttttcttctatgaacacctgtgatcatgtcacacccctgctcgcaactgtcctccattgctcaccaatgaaatacaacctaacagggcatcaacacccttcacaatatgactccaacctacttctccagtctttttcctattacactctccgctatgaatctaatctcccaatcgaacttggatatgtacaaaacataccctggtcgttttcattgatgtgatttttcttgtttgttccctctgcttgcaaacttcttgatgaatcttaccccttctccatgaagctttctctgataccgcctaccctccagccagaagtcaccgcttttttggtatgtgtcctaaagaccttatttacgcttctcttgcagagttatcacaagctgcctcagatcatgatttgcacccagactggcctcaaaactccattcatgcatcaactccttggcagagctttccttacccctatccctggcctgtcttaccagcaccaagcccttcctcctcacacctccccagcaagttctaaggccacttgattacatctgtttttctctctccctcatccctctctgacctcttcttgcaaagcagcaatgtggattcactcatctcggcatccccagcaggtggctgacacacagaagcagctcaacggatgtttgatgaataaaaacaaataagcagatgactacatgaatcaatgaatcatattttgttcttctgcaaatctccaacagcatcttacatatatttgcacctcagcctcccaagtctgtggggaagtggcattcaacaagaatctgcatcaaacctgacagatttcactttcaccagcatcaggcagagggagataaacaaggtagggcaagcacagaagcccagtcctctggggagtgaagggggagactgctctgcaacacctctaaagctagtggcttctcaaagagatcagagcagccacatagccctcattactgggcatggtcctggttgccttccgatgtgaaggttctggctcccggtctaagcttcttccgacagcccacccagagcactccctagatattacaattcaagtcacggcaacaaaatgtccctccgttgctgacatcaaatgaggtggcccagctggaggagagtttaattttctcttcatctacctcactcctgacatttcacagggtctacccagctcttgcaagcaagcacagaggctcgaagggatgctgtgggtttggaggcttttggatccttgccagtcactgcatgaagtgtgaatggattgtcatgacgagaatgcgttttcaaaggaatatatccaaatgtgcttcccttcagagtcctctggaagatggacatttactctgctgttcacatttagaaacttgtttggggaactgccagcaaaaaaacagctttgatcttggagcataggttttgttttgttttgttttgttttgagacaaggtctcgctctgttgcccagatgagtgcagtagtgcaaccatggctcactgcagccttgacctcctgggctcaagcagtcctcccacctcagcctcccaaattgctgggactacagtcatgtgccaccatgccgagctattttttttaaatacagagctggggtctcactatgttgcccatgctgatcctgaactcctggcctcaagcaatcctcccaccttggcctctctaagtgctgggattataagcatgagctaccacacctgactaattttcaattttttaattttcaaaagcagtcaggaggctttgacatactagttaggtggtgaataaggcagacaaaaacactgggaaataccttgatagacaagtccctcctggccaccttcgagctagggctgctcaggagttagtgctcactcatgcgctttaagcagaggtgcacttcatgggaatttagggaaggtttccatgtcctgatgaagtggggcagacttggctggcagagacttttttgcccattgcccttcctccttcttcccatctggaaagtccacactgtgcttggaggtgcagagccagcttgcaatcccaaggctgcaggtgcaagatgaaggtcagcataggagagtgcagagcagagcacagtgtgagtctagctctccaagggcattattaaagttacactagccctgggctgtctgcctctagttttcttattataaaagaagaacttgccccctatttatgcttcttgtagcccaaggtttttctaactgatattagaagcatgactacagagtgatttggtatgccccataaattggctctgaaaaaagaattccacaaaaggaattccaaaataaagttgggaatagcctttcaaatacacacattgcactgggttgaatctattctagggagactggaagacctggatggtaatgcctgtgtctggtcccaaaacggagactataacaaatgctctcttaaaaaaaaaaaaaagaaatgtatttgagaggccaaggcaggtggatcacttgaggtcaggagttcaagaccagcctggtcaacatggtgaaaccctgtctctaccaaaaatgcaaaaattagccaggcgtggtggcaggcacctgtagtaccagctactcaggaggctgaggcaagagaatcacttgagcccaggaggcagaggttgcagtgagccaagatcacaccactgcactccagcctggacggcagagcaaggcgccgcctcaaaaagaaaaaaaataaaataaaatccaccaggagataataatcctgaatcagacattgttaaaaaagaatcccttaattcaaaaattccctttacacattaaaatcaaagcttaaaggtcgggatgtctaatgttattataaactgtaggtagcaagaactcgagctatagcttaatggaatttctcaaacaccaagggaagaaatggagatacttctggactgcaggtagaaagaaagaggaaggaaagaagaaaggtcagacatcagaaaccctacagtagcccctacattaccttgaggttgaacaatggctgaagtggaaacaagagtaaagcctcaggtagtttgaagcagaagccaaagcagggaacatgtatgccctgctgcccattcaggaatccagaagcagagtaaagatggcatcatggagcacttacacagaagatgagagacaacggaagtgcccccaagtctccctcgggtattatgtaagattgagctgagggcagggaggaaaaagtcagctcaatcctattgcagaggttgtggggtggacctctgggtcaggcactgaacggaggctgtgatgtgtcatgtctgcagcagtaaggagcactcaggtggggctgagtcagccaggaaaggtccactggaccctgaggaaatcagaagagaccccacaacatgccagtcacatctccaggaggccagcaaggacccataagtcagcactagggtacgtaaggactagcgggcttctctcattggtgggaggacattgtttggccttccttatacccacgtgccatcctaggatggtgggggaggaaccagactttacaaagtgagaaaccacctgttttagtccattcgtgctgctataacaaaataccatacacttgatgccttagaaacaacaacacaagtctagaggctgggaagtccaagatcaaagcaccagcagagttgatatgtggcaagagcccacttccttgttcataaatggctgtcttccagttgtgtcctcaaacggcagaaggggtgagggagctctctagggcgtcttttataaaggcactaatcccattgatgagggctttgttctcatgacctaatcacctcccaaaggccctacctcctaataccatcatattggatgttaggattgcaagatatgaatggcgggagcggggacagatacaaacattcagtgtatagcaccactcaaatagagtaattgaaagcaatatttatccaagagaggtaagaacttgaaacagacagaggcataatacctttaatcggctagtttatgtttccctcccactcatggtccatggaaactggggctcctcagcaagctgagaatagttgagcaaaataatgaatgctgtgctgattgcacatctgagtataatgtaaagattttgaccctgctaatatatgcttgttttttaaaaatctgtcttcaatattttatcacagctgaggcatccttagcctactcttccacagaaggctgctctaaatgtttttatacacagggagctatttcagctctgtacattaccacgaagcagtcacagagcctcccttcccccacttggtgaacacgccttttgaagcccttggcgtttgattcatgccattttgactaccttaaaacacacacacacaaacacacacatacacacactgattttttttttaaccactccttgcagagcagggctaattcatagtcagtgtgcccagaatcgacccacacattgacttttgactctatttgctttgttgacaattcccatctctctggctagacttggaagctgcctggaggcagacagtgggcctggtggttctcacagaccccagcataaaattcttactgactgaattcacctcagtgtaattgtatcaaaggttatttgaaaattcagaccttgagtagtctatcactagtaaagctaaaattcttactgactgaattcacctcagtgtaattgtatcaaaggttatttgaaaactcagaccttgagtagtcaatcactagtaaagctaaaattcttactgactgaattcacctcagtgtaattgtatcaaaggttatttgaaaactcagaccttgagtagtcaatcactagtaaagctaaaattcttactgactgaattcacctcagtgtaattgtatcaaaggttatttgaaaactcagaccttgagtagtctatcactagtaaagctaaaattcttactgactgaattcacctcagtgtaattgtatcaaaggttatttgaaaactcagaccttgagtagtcaatcactagtaaagctaaaattcttactgactgaattcacctcagtgtaattgtatcaaaggttatttgaaaactcagaccttgagtagtctatcactagtaaagctaaaattcttactgactgaattcacctcagtgtaattgtatcaaaggttatttgaaaactcagaccttgagtagtcaatcactagtaaagctaaaattcttactgactgaattcacctcagtgtaattgcatcaaaggttatttgaaaactcagaccttgagtagtcaatcactagtaaagctaaaattcttactgactgaattcacctcagtgtaattgtatcaaaggttatttgaaaactcagaccttgagtagtcaatcactagtaaagctaaaattcttactgactgaattcacctcagtgtaattgtatcaaaggttatttgaaaactcagaccttgagtagtcaatcactagtaaagctaaaattcttactgactgaattcacctcagtgtaattgtatcaaaggttatttgaaaactcagaccttgagtagtcaatcactagtaaagctaaaattcttactgactgaattcacctcagtgtaattgtatcaaaggttatttgaaaactcagaccttgagtagtcaatcactagtaaagctaaaattcttactgactgaattcacctcagtgtaattgtatcaaaggttatttgaaaactcagaccttgagtagtcaatcactagtaaagctaaaattcttactgactgaattcacctcagtgtaattgtatcaaaggttatttgaaaactcagaccttgagtagtcgatcactagtaaagctaaaattcttactgactgaattcacctcagtgtaattgtatcaaaggttatttgaaaactcagaccttgagtagtctatcactagtaaagctttctgggacccgctttctgtttcccccctttttctcccacttctgccttctctggctaaaatcaaattttggcattcaaaggaaggctctgacttgcttctcaagtttgttccccatgcctcaagtagagcctcatctccccgaccttctgacactcacctctctgaagacttcgcgtatatcatggttagactcaggtctacctggatttgagagactgactttttgacctcccacaagccatataattataccattcttcattccctccaaatgatacagatgccaacccactgtgaccagaggtaatctagacttttctgaacctggcagacagcagcttgactgggtctccagtgcccccatcctgcagccctagcactatctgtagccacactccacctctgccctttcccccagcctagccctggagcacagatgcctaccagccctggtaacgcctggctccagctctgccatgacttcttagcatcctcagtactcctgtttgctcctgtcacctgctcccctgattcccatcaccatccagcagcagcacctgggcaggctgaccaggtggcacatgggactggggagtgaatgagtcagccaggttcctactcctgagcaccctagcaggatcctctgtttaagttcccgtcctcttagaatcacttagtaaatctcccccatcttgcaccagcctccaaccctcctggagttcctctcccttccggcttaaggggtagctcctgtatgccatcatcactcaccagcacttgccaagcatcaccatgtgcggggccatctgcaggacactgggacaagagagacctaaagatcaccatctctgcccttgagaaggctacaaacttagtagagtagaaatagcacaggttttgaactcagaaatcctgtgttcaaagccctggacccttacttgcctgctgagtgtctggcagcaatcacttgactcctaggattctcagttttctaatctgtaaaatgagtttggacctcacagtttattgtgcaagatcatctgatactgagcaaaaaggacttacttgtaacaagcgaaatgtttagggatatctgtatatatctccagttggccttctgtatccatgggtaccatatccatgggttcaaccaactgcaggttgaaaatatttgaaaaaaatggatggctttgtctgtactgaacatgtacagacttttttcttatcatgattccctgaatgataccatataacaactatttacataacatttacactgtattaagtattataagtaatccagaggtgatttaaagtatatgggaggatatgcatgggctatctgcaaatactacatcattcatatcagggacttgagcatctgtggattttggtattcctggggatcctggaaccagtaccccacagataccgagggaagactgtatggggtgtgtgtgtgtgtgtgtatgtggtctccagttggctagagaggacatcaggatataaaagatatcaaagatacacatgactgtatatgtaacagcaggtatgatatttttagagtgcctctggagtatcttgtttaatgttcccccgtgggtaagccagcttctctctccccgcctgagtataatctctcccaataagcaactgcttctttgctgataaggaacaattccctggcctttccatattcaggacaaaagaggaccttcagtgcctccgggaatcgtaggcaggggcttctgctgacaccccaggctctgtggtccctactctccctcaaacaaacaacatagaaccgaaggaaataatgtcaggcagaagcccacacacacagttagaacatgagtccctatgctggggccctgctctgtcctaatccattcaccccgttaccacctgcctgcgctgagtcagatttaaagcactcgttctctgcaccttctttgaacctacaaatgtacctcagcctaatggaccttgcacatctggaagttgcccacaataaatcctgctaatgtagaattaaagtaggttaatctggccaggtgaggtggctcatgcctgtaatcccaacactttgggaggccaaggtgggtggatcacctgaggtcaggagtttgagaccagcctggccaacatggtggaaccctgtctctattaaaaatacaaaaattagctggacgtggtggcccacacctgtaatctcagctactcgggaggctgaggcaggagaattgcttgaacctgggaggcagaggttgcagtgagccgagatagtgcccctgcactccaacctggttcacagagcaagattccatctcaaaaaataaaaaaataaaataaaataaagtagattaacaagatggcttttggacagggtaagttcctagaaaatgcagatgagaaaaaaatgtactataggctcagcccttcaccctccaagagttgaaatcacataagccacaccctcatcagtgtattgcacaaggagagtgccttctgttacaatcattttaatcgggaagccatcaggctggggaagctacaccactgtaagtttttacctaagcaagccaaagcccaatgcaaacagtaaaatgaaactagaaactttactgatcagaaaccacaaactaacctctaaaaccagtctttccactgtaatcaatcaaatgtgttgtatttgtcttacttccatattcagcctctaaaagcccacgctgctgcagtggagctctctgaacctcttctggttttgagggctgcccaaatcatgaatccttctttgctcaaataaactttgtcacatttattttgtctaaagtttttcctttaacatttcctgtatttgaatctgcctgtgctttgcacaagacaaagtggctatttaatgcccatttgccagacaagtaaagctgaggccctgagttcaagtgaccccccaaggccaggcagtgtcagagccaggactagttctagcaagatgatgagttttctgccttcctaaatcttgcagtgccatgtggaagctgaagtaaatacattcacatcatttgaaatacatgccttagatctctgtacaaaggtagcaagaaatttcgggaagagtccctcctcctgtcaacctacacatagcttctcatcagccccttttcatcctcactttccaattgccacaaaccaccctctctccccaccccttgctagcattttttcaccctctgacctacctcataagatagcatctccttacattgcaataacataaaacagcctgacttcttaagagttcttataaagataaaaatgagataagatacgcaaggtgcctagcttagggcctgccacatagaaagccctcaataaacctccttattattcactgttatcccccaacatacaattaacccaaacaccagggaacccaaacaagtgaatcaacaaatgtttattgagcgtctactgcctataggaaaacaaaaactgaaatgataccaggaagttgctggtgtccttccctatccacccctctgtttggtataggactcaggactgctatctcactcccaccacctgccttcttgtccaggtttcccatctcaggcatcagagccactagtttgtcagttgctgaagcccagaagccattctgattccttttcctcactccattcatatcgaattgcttcccaagtgcttttgattttattcctaaatagctctcaaatcccatcctcctccctaacattgctgccatcgcctccactcccagtaagactataaaggaccctctttctccaaatagtcatcatccaggagcagtaattaggaggttgcaaaaagaagcaaaattgtcatgatgtggaaatattcatgagttttcacccaaccatccctccccacctaacactagaaacattaaaactaccaaccatgccaacctcacatgcagatacaatgcaaggtggttgcaaagtaacactgaacattttgctcaattcgatggatttcatgaagttgatgaaagtaatactggagatctgcttcagtaccactgaccaagaagaagttggcagagctaaagcatttgcagctgaggaaggaaaactgctgaggttcaaggcaggactggtccttgaaaagggaatggtttgagcgtcaaagtattgaaggacggccttggagaaactaatgaactctttgaaagttttcatgattcttcctcaaaactcaagcaggaagcaaaaagtgttgcttcctgctgtcttgtcatcttttcagcatgagttctccctcaaaaagtcaacaactgattcattccttgttcaaagagctagcgcaaaactgcaactattacataagtatcatgaaatacaaagtcacatgaaaactttttcataattttttgtattatctttcaaagtaagatactgatcaagcctttttttaaaaaaaaaaaaactgtttactaagaaatgtggacctccattttactttcagtggtccctttccaataccagttatctgcaaataatgagggtttcctatcttgcaattgtctcttcctggtgtctgcactctccacactgcagcaaatctggctataagcagccctgctttaaaatcttacatgattccccattgcccttaggaataaagtccagaattcttcacacagtgccagagccctgcgtgatctggccactgcctccctctccactctcagcctttgcactaactgttccctgtttgcaccagtcctaccactactttgcaagtccccgccccagtgctatgcacttcctagccaaaggacctttattcatctccttcctgcagcctggaaccctcttccccgccttctttcccacaagaggaaggagtgcctatttgttctccgctgtttcctggcatgaagaagacatttgataaatatttaaatgagtaaataggctgtgaaagttcttcctgattctgacaaatgagtatgtcagataagccacgtgttccctcactcctgtaagcatccacaaccaacggtacttcaatccaccaccattcaacaccgtgggcccacctcctactgtacttgtaaattaagaacctggcacaccttactagaacatcgtcctccttttagagtggatgatggcaagctaccagtgttctagaagcaagattatagagaacatcaatccagggcatgacagatacccagaaaactcaaaaggccccaggtactgtgttctcagcagacggtggggtattggggtcacccaagaaagaaagtcactaagagtttcaaagattagccccaagtctggtatttttctgaaacaaagagtttcgaagattagccccaagcactggtgtttttctgaacaatggtaacgtgactcatttatggcaactataatttttatagcctcaaaataacactttggagtcatgctacatataataaggcacactaatccacttctgctgccccccataggtttcccggcacctccactcctggttcccatgacgacccagaaggggcctctcagacctgatagcagcgtagaggcagctcctcagggaggggcagctatcacacatcactacatttggcatttggccgaggactattctgggccaggggggtcttcggcttccaggagctacagagcaccccagagagttaatgtacttcaaaacagaggaaagaacaggaaaggctgacgggtcatctttgaatcagaagccatttttgccttaccttctaagttttcagtggagaggaaaaggaaaaagaaaaagaaaaaaaagcaagcaaactcttcacagctgaagaaacttgttcagattatttcagagttcctcctagttgcttctgaagcccaccaggccaattctcatccatctcgtttctgtgattgtggaaggaataagactcaatggcatgaaacagcttcaggactttctgcctcacctccagctttaaatcagacctttaatgctacttagagggaaacatttttcttagtaaattataaaagtggaattgattcaccagagggagaaaaacccactgagtaaatatatttgaggcttatgtaaacacatctcagagcgtgtttcaagggaaagcggcttgcttactgagtttaattataatgctctttggtttcaaaaataagacaaaaatgctagaagccaggtgtaatggggaaagaaatgaaaagatgagcactgagatgcaattgttagctccagccatggctgaaatacacgggatgagatacaaaaatggcacatcaccgttattgctagggacagccctgacacactgtcaagtgtcccctccgaaaatgatcctaaatggcccggcagttccaactccgggctaggtatcctgaggtttccaaatatacatagatctttaaagtgcatcaaatattcaacagaggataatggcatctcctagcaagatgagggtggtcttccaggctcaaatatactgacatgaggtgaactgaactcaaatgttaaaatgccaaggaacccagtggggtgttgtgagcagaaaacgagatactttgaggctgggaaaatatcctgagtacaatgcccaagagcaaaaatatgtgaaaagagatagaaaggaagcaaaactcttaaagggagtagtagaggggacactggccaggctggtgggcagggcaactgcagagaaagcctttcaatcagaagccactgagtgcacagaagcctggagcacatctacagaagcacagagtttctccaaacagtttgtccaaagtgaggacagctagcagaagctcaacgcacatcacaggtgaaagccgactggcatgcagaaagtccccagggtccgcaccataattcaggcccggtgggggcttgatgtagactgaagacggtaaacccgtcctaacctgcttgccgatctagtctgtccagcgcgtacagtactggccagcataatgatttctagaaaatctagacttctgatttccttttaaaaaaaatttttttaatacaaacaatcccacagtacttattgtcatcttgtaataacataagggtaatcaaaacaatatgaataaatgttcgtattggacaaaggacacctaaaaacaaactatatccttctcaacaatttctcacttcattgatcatttctagttggagacactatgtacccgagtaatattatctccttttagcatgatccaacccagttgttttaactctgttttagaataaatctcttctgcatcaactaatacaaggttcatatactcatcaaaaccaatgatacagccttctatccacatattctctgcttatagagccatacctgaatctgggatctattttgtaagaatctgtaggtgaggttgatgggctccatcatagctttttgcactttctggccctgaccacggtataccatgatggaaattcctagatttctgatttcttataaaaactgcaaaatctggccaaaatttctctctctacttattctacagatatttactgagcattcattctgtgccaagtattccagaccctaaggatacaacagtggggaaaaacagagtcctcgatgttatggagtatacatgctagtgagaaagacaaacaataaataaacgcatgtgacaggtggtggtaaatcctgtaaagaaaccagagcagggtgaggggagtgagagtttctaggggagcgctaggaaacgcaaggcagtctgggaaggtctcccggctcctgcatggcaacatccagctcgagctaggtgatggcttcctcctcacacagggcaggttctctggtttgccacagtccctgctactctctcttgttacctcctcctggcctactttactcatttatgtggcctctgtaggcatcagagttgtggcccccagagttaatccttccctagatccctctgtattagtcagggttctctagagggacaggactaatagagatgtatatatgaaagggagtttattaaggagtattgattcacacggtcacaaggtaaaattccacaataagccgtctgcaagctgaggagcaaggaagccagtccgagtcccaaaaccccaaaagcagggaagccaacagcgcagccttcagtctgtggccaaaggcccgagagaccctggcaaaccacgggtgtaagtccaagagtccaaaagctgaagaacttggtgtctgatgttcaagggcaggaagcatccagcgcagaagaaagatgaaggccggaagactcggcaagtctagtccttccatattcctcagcctgcttttatcctggccacgctggcagctgattagatggtgcccacccagattgagggtgggtctgcctctcccagcccactgactcaaatgttaatctcctttggcaacacccacacagacacacccaggaacagtactttgtatccttcaatccaatcaagttgacactcggtattaaccatcaggccctccaactctggatacccaagatccagcagagaaaggagacactgctcccaagcagacacgcaaaacaagtcagagaaaatgggatttgaggaaatacgagcctaagccaagtctgaagggggtggggggaccactccaggcattgccctgttaaatgatggagaaacagtttttgagtcctgaacacatgtacagaaggggctccagatgcaactgggaaaggatccccagatctctctcccactatagggcacaaggctgggggccacaggtggcagagcatcagggaccaaggttgagcaagaatgcagaccaaagtaacaaggtactgggtcatgaagcctgggaacacatcccagggctgcttagctaccctatgggacccctgagggaggcacaaagagtcctcctggagcagaagggagagggtaaactgaagtgcaaagtaaagggagagggtaaaccaaagtgctccactttctaggagcaggtttggggcaaggtatggagtggcttcattccattccctaagccagcaagaaatgccacctgtaactttacgaggtgactatgggggagcactgtggggaaaatagactgcactctgtacagggaagatccaatccacttctgccagctggtgagggattgcccagccagaaatcagcaagaacagctgagacaacaagagggcggtgacacagcaaccacagggccaagagaaagcactagagaaagaacagtgtctgcaaaggacttgttagatgggacttgtttccattcctcaggttcatggcctcttagaagaagggtatcacctgtcctttctctcgtgagtaggtggtgtggatttgcttccagaaggaccagccttttctgggatcatcctgctctattccttggatggcgggagccagcctactgaagaactgagggtgtacatctcccagccagtcccagatgctgatgccagggcttccagtaaatgcccagagctgccctgaaggtgacagaggccttaacacagcctgtaacctcacccttcctgcttctgcgccagcctgcctccacctttttctcttcaaccacatccccaagagagcatgcataggctcccttgagccttggggactgggacattgcattactgatgcttgagcaaccgcgttgtcttcagatctcttttagttatgccctttaagaaccatccacatgtgctggaactaatggctgaggcgggacagcagggtacccctcgtaagtcagagagagctgaagaagcccaagactcacagccagtctgtgatagagaaattgtccttaggccctgggacgatgtctgcaaaactgaagccacaggcagagagcagagctggtaggtgtgaagtcaagtcctaacactggggtctgtgaaaggtgttaaaataattatcgcctagaacgcagaacagattcattttaacaagcaacactctaaataggaatcagcaacactctaggacttgatcttcagacccaaacctcaggcagctcagccaagcgggagctcagagagcaccccctggcctggcaccacctgccacctctcataaggttcagggggtgtcttcctggggactcaggctcactggcaattttgcacttttcttacaaagtgaggaatagtcaggtcacctctgagtaggtgacactggagaacactgacaaaattatcttctggcaaaaagaagtctcccctggtggaaggagcccagcattcctgtaaggcaggattcttaacctttcctgtgcattgtgatagaaaagtagaatcttgggaccccaaactcattatgctaaaggaaaagttaagcttgggaattgagtcgcccaaaaactacctttcttttgttcccagatagttgtaatttcacaggcttgctttatcctatgtaaaatgcagatttactaagcacaagaaaaatgcataaatgatttttcctctacccacttcttttcacatgtaaaatgtagattcactgagcactaatcagagcctcacaggaatgtaaccacttgccttattgcctaccctcctttctttcttccctcctgcttgctcttcctctttaaatattgaagttcctaaaaccctctttggaaaaagaacaggtcacagattccactgtgacttgtgtttctttttcccagatgtgtcctcaaccttagcaaaataaaacctcgaattgatcgacacctgctgcagtcatatttttggtttacaggaaggacccctttggcaaatgcttcagacaaaaaatagggccataaaaaaacaattatactgaaagttatcaaaatatgttttttaaaaattataataatgctgtgcttttctattaatgtcatgaacaaaagatttggagaggggcctgatagacaacataattatgaaatggcagtgagcagacgtggggttttggatatttgtagcaactgtcatgtgatatgaaaatcacccctgatttccatgactgtacttcatctcctgcagtcatacagaaaggagctaagttagtgagggttcatggaactctccacgcaaagcagaattctttcgtgctcctgaaataatgcgcaatatgcaaatcctcctgtaatccacggcctcaaactctcattaaagtggaaggggttgtcctggggaccctttgttcagagtagaaaggagagtggtgttagtggaacaaaaccagagggcgatgagcaccaggacccaagattgagggaaacgatgcgccgatgcgccgcggagtagaggagccaccacgggtagcaaagtgaacttcccccgaatcacggttaagccccctgggccacatggagctgtcatctgcagtttttcccacctcggaggcctgaccctgtgctctccataatcaatgagtagatttggccctttatgttccctgaggcttccctgactgctcattaaaaggatctgctcagtcctagtgaattgatttactttgccacagtccttgaaggatgctacagatcaaaaggtgtccaggaaagtgatcttaaagatgctgacactactcccagttactgactagcggtgtgcatgccaggcccctgttccaggagcccaggcctcgctccatgggggagcgtggactcacagaggaaaatcaatgtgcaggatgcagaagagaaggcaactggatttaggttgttgctgttggttccttgtttgcctttagagacatatgaaaaggtccagtcattctctttacaaaacagaaatacagaatataaaactcaataaatgcaacaaaaatgaaaaagacatccatttcatagaggtgaagagaaaaatcaggtcaatagagaaaagggggttagaagagaaaagcacacacaggcacaaacacacggagtataagacagagtgaaaaatagatggggaaggcaggagacagagaaagaaaccccagcacttatcaaacccttaaggtaaagctcatctcactcatgaatcctgctcccaatggaaaataagccacccactagattcaaagtttggataaacctagtagcatgtgttattcaaaaagcactctaatttctttccacattctggaagtctctggtcctcatttaggaaagaagaaagtatcttgctccccattcctgaaagcagcaagcatcaaatttcatttttcagagaccaaggtctacttttatacagtagcatcgctcatgtggcctctgggactatttacacatagagacgattcaagtcctgttgcattttcacaaccataggcacaaatgataccacaccttagtgtttcctgcctgtggatgcactcaggtaagaactggatggagcttgcatggcaggtagagttagcagttactgctgagcctgtgagaaacaggcttactctgagagtcctgctggggtccccaggatgcagtgagcactgtgttcctttttccacagccaccagcaggggctagggacagtctccttcatgacctgcttccaggacatccttccactgttaaggatcagtcagcacctccaacccccttaatgtacccacccagcagtgtcggcaagctggggacagacatgcagacaagctggtttgcatgaaattctgaaatcttttgaaaatagagacacataggcaacctcaggatggaatttttattctaaatgcctgatccatcttaattgccaaaagtgatactggcaaaggaaaatgaaaaatacaaaaaggcttggatttaggctatctgtgttttcaaatgatttaataacgatgataggcagggatttacaccaacagatcaaaagtgcaacaaacatttatggagccctgctaggtaccaggcaccgtggatatattgatgtgtaagacagtctcatggagcacacagtcaggactcccagagttattaccatccccctccacccacggtagcccccacttcctagaggacaaggaaccaagtgtcaactctctatccatcacaaccacctgaccagctggctttgattatatccccactttacagctgtgaaaactgaggtggagaggccagaggtgcaccaagaagactacccgtgcatgctgaattaggcactgctagtggtagatcaagagagagagaggaggggcccttggcaaaggcatttccaggagcattgcagagtgatagatttaggagagggggaaagatgccagggtcatggggctcagagggcagaggtggccttggagagggagagtgcaggctgggccagacctgggatccccctccatttacatgttggggtgtacctgccttattctttctgcccagagccatggccatgcccccttcttttggatagttctccctgtggttttagaggaggttcccagtcacaagaggctcccagcagctagagtggggccctgacccaggctgggcccacggctgtggctgcagtaactggctcaaggagtgggagaagacccaaaccataacatcacagtccttttctgagatctgtaaaaccaaagctggtttacaattatactgagggaaagtctggaatcattagtcgtcctgtttcctgccagatggatcctgtctgccatggaagagaatgaagccaacctgtagataccaacagagaagagagatgggcagagagtgtgccaggaacatttagatccctggaaccaggctccaaagccaacaatgccgttccccttccatgatctagttggatgagccaataaataatccttttccttaagctattaatagttgggttggactttgaaagccagtgaccaaaggagttctggttgatatatgggtatgacttactataagggggtgcacaaagccagaaatggatgctatattcattggacaaagtctatttcagtggccacagagacctcaagatgctctgagacgtgcataggccaaaatgcaagggagagagactgtgctggaacgagcagtggagggactggctgggtcgctgaagtttcctgagtgatgtgcacccttgagagtccactggaaaaagcacacacagacatgacccacaggggactgcacattataacttattccatcaccacatggggcgaccctgagactccttccactccagtaggacactgagtgtgggtggcccttgctaggcctggtgagaacaggctccactgagaagacggagcaaggaaaggctgggattgccaggaacagcaactttgaagaactctctttctcagtgtgccaggaggcctgagcgttgtgggagggctttcgtttgagggctgtttcaacaaaggatttactcatttaattacttaaatggaggtaaaatcatactgtcctccttcagggactgagctgcccaaagaaaagtcatattctacaggaaaaattacttgaaacaattggatccttggcattcagcttcctcaatctttattttcctaaaatatgtcttcaagaaaagccagctcctgggctctaagtaagcataagctctgatggtagccaagagactcatacatttaggatgaaaatctggcttagcaaggacagtagggaggaagggacaacacacagcccaccctgacagaagcagccagactttggacgtgctggcaaatagcctaacacacccaatatgaagtgcgaacaaggagatccactgccatgtgttttataagagtgcaagagaaaataactcaaatgtccatcctttggaggcaggataaatccgacagagtgtaacacttggaatggttcacagagaacgaagttctttatagactgttatggaaagatcccccaaatactttattaagtgaaatgacaccaaataatggcaaggtgccaaacagtgttgatagtgtgctgccttcaatacaagaagggatattcagaatatgtacttagatttgcttgaatttgcacaaagaaacacggagggaatttttcgcatggctgcaaggcagtgagcaacggagtcagtggcgtcaactggagacagtgggaaacagacttcaccgggtgcctttcagttgctttaatttttatactgtgtgtattcaaaataatgatgaaataatcacacagaactctatgaaaaagacatcattttcattatacaaatcaactgttttaaaaaaatcccagcctggacgacatggcaaaaccctgtctctacaaaaaactacaaaaaaattagctgggtgtggtggtgcatgcctgctgtctcagctgctcaggaggttgaggtgggaggatcacttgagcccaggagaaggaggttgcagtgagccgatatcgggccactgcactccagcctgggagacagagccaggccctgtctcaaatatatatatatataaacatcttttttagaaacccttagagcagatgacacagatgacaatctgtgttgtactctgaaaaaccaacagaacatttaacaaacattaatccatatcaggccccaattcaacaagtgctgtgtgctgctcccttgttctttgggactacacacggtatgtcgagtggggaatctctcctcttaatctctcacaattcacccactgttcaggaccagccctgactcagatccctcaggccacagaggctgttgcaactcagcccctggctccccaccctgacgctctgggttatagccttggcgctgtgaatctcctcttctactggcaaaggctcagtctgcacctggctcctttcaggagattggactccccagcccctttccgctctgttcattaaaaaccaccactgcagcggctgggctccccggggcagccaccacagaggctgctgcgtttgttctgatgtgagctggattcggagagctggttgggttcatttcctgtgcttccagcctccttctccattggcagcacgcactcaccatggtaacgctcaggccgctttttggaaaccctcacttctccttgcttaaaactattcaaagaaaaatccatccaagcccgtcaaggaaaaggtacttattaaatacctttcccaaagttaaaacatctccaacaaggagctgtctgaggcgccttcgaagttgtgtgtccctgagacacatgcataattaggttaaacatggagctggaagtaaaaaggcaccacacttacccagaacaagaaaaggtcagaacgctacccctctgtgagccctcacacaaaagctcgggaaatggaggctgtggttttcaggcaacggggcacgcgcttgggtgcggcaccccgaatcgttcccgctgcttgatcgtcacgctctgtgagctctttctaaggtacatttgctatattcattaaaggagagaacattggaagcgtttaaaataaaatgccttgtgattttcaaaatcatgaacatttccagcaggctgaagagaaagggctttcttggctgcaataagaaagaatgagaaaaagagaaaacctcctgaaaaaaaagtggcggggggtggtgatggggtccatgtgatgctgaggtttctgtttgttttgctgattttcagtaagcaggatttgtttctttttcaccttcacttccggttctgtattttgcagctgtcactggatggtggtttggaagcccctcaaattcaattcagagccatgttgcccataaaatgtaaggattgtccaattcaacgcagaaactcccatctgtgaagccttggtatcgggagggcttatgaaatcaataaagctcatctgccaccaaggagagcctcagtttctgacaatggaggctagaacttacaaaactaaatgaaattatttcttaaaaactcaactgcccctaatttaaaaggaatatgataagttcagaaatgaaggtttttgattacaggatcccaggcctatgaaagaatgtctggctacaaaaataagattcctgttttcttactaattataaaagcacttattatgacagcccataattacttagatatggccattccaaaggacaaattatgtctacttaaaggtaactacaacaaaaacacagtatagcacagatatctactctacgcctgtaatcctggctccttgctctagcattaaagtggttaaatgaactggcaaaatctctcattagggggagccaagaggtagttccagcatttggacctacagtgaagttccagcatttggactcacagtgaagaatgcagtctcagaaacacaaacccagacggacacatcaggtacctaattcactcggtgaagtctcacagcttcatctgatgtttactcatgacacatacacacccgccctctcccaaaacaaataagactctccccagttactcacctagaccaccctgacaaatgtctgtgcgcgtggctccaccaacgataaactgagggctgggacacaactcctgaaagtaatttggaacaaaacacaagtcacaaggtgctcagtgatggcagcagcctggggaaaggaacatcagagtcccaggttgcagagctggaagaaacccaggattgtctactgcccatcacatggttttattgctgaggactctgaagcccagagaggggatgagccctggtcacagtcacacagccaggggtgaacagagcagaagctggagtccagagcccctgccaggactagtgttttcattttttatttattttttatttattttattttattttaagtttttgagacagcgtctcgctttgttgcccagcctggagtgcagtggcatgatctcggctcactgcaacctccgcctcccggattcaagtgattctcctgcctcagcctaccacatagctgggattacaggcacgtgccaccacacccggctaatttttttttttttttttttttgtatttttagtagggatggggtttcaccatgttggccaggctgatgttgaactgacctcaagtgatccatctgccttggcctcccaaagtgctgggattacaggcatgagccacagcacctggacaggactagtgttttaatactatatgtgtggtgtgggtgtgtgggtgtgtgggtgtggaaaggtggtgaggagcagggaggtaggagaaaggcaaaggctgagataatatgtgatgaaaaatgatctcacctattcagacaacacccctatttacataaagagattagaagaatatttagcaaaatgctgtgcaccctgtgggcactcgttaaagtcttgactaaatgataatgaccccatgtgctgatggacacactgaagtgtcagaagtaccatgtatcctgagatgagaattcatctctgatacattcacatatctgacctgcacttcctccactcacctatctcaactggcatctgcctacagcaatctcatggccctggtgctctgttggggcacaatgacacatgctttagtcatgctttctttgtttacccagcaaggattttttgagtgcccgttctgtatccagtaccctttgaaccatggcaggcaggggaaagagggaaacatggtgaaatgaagaaagaaaagaaataaaccacgtagttcttggcctcaaggtgcttttgctgtatatagcaaaccaagattgacattatgaaaaaagtcagagaaaaaaggctagtgcataataatagaatgtaggctatatccacaaagggagaaaaaacacaaagagagaaaaatgagaagggcccaacagggatgatggctgcaagacttagtgggtgggagatgatgcctgtccattagaaaggtaggatgcaggagcagtctacgtactggttcctaaagaagagatgggtctacctgttcaccaggcaaactgctaggggaaaagggcaggacctcgagggacaaaacggaagtcagcctacatttaatcggtggcatcctgggctgcactacatcaaagactgtctggccacagagagagagaatcatttcattcttacttcatagaggtgaagaaagggcagatcagaaaggaccaggaagcaggagggtgggctgagggcagatgcatggggtctggatgaagctggcagtggggattctgggattctgctgtgtgaggtggaaccttccaggtggcagccccatagcctctataaggtgctggctcctgctgaaatggcagaaacagctcctctgggctgactttttttttttcccaagtattaaaaaaaattttgctgggtgcggtggctcacgcctgtaatcccagcactttgggaggctgaggtgggcggatcacctgaggtcaggagtttgaaaccatcctagctaacatggtgaaactccctctctactaaaaatacaaaaattagcccggcatggtggtgcgcccccgtaatcccagctactcaggaggctgaggcaggagaacccaggaggcggaggttgcagtaagccaagatcacgccattgcactccagcttgggcaacaagagcgaaactccatctcaaaaacaacaacaacaaaaatttatttacctgtttttcattgaaaaactaatacatgaacatgagaaaaaaaacccaacagtaaataatggtgtaaaacacaaaatcccttccgcctcagagtccgcactggtagcatttcttaagtgtccctccagaagctgtcttctgatatgaaagcatatttatgtacatacacacgttttgggtttttttgttttgttttttttttttttttttttgagacggggtctcgctctttggcccaagccagaatgcagtggcgcgatctcggctcactgcaagctccgcctcccgggttcacgcccttctcctgcctcagcctcctgagtagctgggactacaggcgcccaccaccacgcccagctaattttttgtattttttagtagagatggggtttcgccttgttaaccaggatggtctccatctcctgacctcgtgatccgcccgcctcggcctcccaaagtgctgggattacaggcatgagccaccgcgcccagccacatacacacatttttatcacatatgtcttgtacgtatgtcttaggacatagagagctttgtaacttcattaaaagtaccataagttatttagctcgtttattttcttgccatttatttatttgtaaataaaggttctctagtgatggacctttagttttttgtttattcattcgctttcagtcttttgcaatctctggcggcaacttaaagagaaaagtggcaccagccaatctgggtgttctaaaagtgtgcagctgcaaatgttcaccccgggtgcccaagagctcccagtctccaagcagtcattttttggcaaataaaaggcagagagatctgatagagtaataagtaaaaagaaagagaaaaaaattttaatttaaatgttgtttttaaaaaaagaaggaaaatgttgtgtcgtcaagaggaaagaaaagacagcacactcaataggggtttggaagaatctcttttcttaaaaactctcttaaaataggttcttggctgggcatggtgactcacacctgtaatcccagcactttgagaggccaaagtgtgtggatcacttgaggtcaggagttcaagaccaacctgaccaacagggcaaaaccctgtctctactaaaaatacaaaaattagccaggcgtggtggtgagtgcctgtagtcccagctactcaggaggctgaagcaagagaatcacttgaacccgggagcagaggttgcagtgagccaagattgcgccactgcactttagcctgggcaacagagtgagactctgtctcaaaaaataaataaatagatgaatagattcctgttcttcatccgccattcatccatcggtctactgaaatctgacttctacatccatagcttcataaaactcctctcacccatgtcatcaataataactaacttctctttgcatttggtaccgttggctattccctctctgaaattgacttccatacccttactcatgcttgattttctccttgcctctctgagcatttctcctcagtctccttcatgcattcttctactgtgcttacccctaagtatcaaggaacccctggctcttggtcctcaaccctctgagattatcccatttcatacagcagtaacacccctaagcattcttctctcagtgacatcattcgacctcatggcttcaactattaactgcagaatatgctgatgcttccaaaataactccctgagctgtatcttcaattacctgtgtcacattgctcatttttcattagattcatatctaataggcctcccaagttctgctaaaatgttgagtttgggttggaagacagagtcattggcaaaggctacagacaattacaagtgaaatatacagaatggtgctaagtggtttgtaggtagatggaatgtccattttactacgtggtactcagtataattcaaaaaatgcccccaccccagaaaaacacatacacacacaccaaggaatgtcatgactgatatgttgcatgaatctttcagggaccacagaaagtccccagctttgggctgggcatggtggcttacgtctgtaatcccagcactttgggaagccaaggtgggctgatcacttgaggtcaggagtttgagaccagcccagccaacgtggtgaaatcccatctctacaaataaaaatgcaaaaactagccaggcatggtggtgtgcacctgtaatcccagctacccaggaggctgaggcataagaattgtttgaaaccaggaggcggaggttgcagtgagccaagatcgcgccaccgcactccagcctgggtgatggagtgaaattctgtctcaaaaaagaaaaagaaaaagaaaatccccagctttgcaaggagattccatctcactacgatgcccaaagaacttaccccaaatctctccattactaagttcctgttgaagcacagatcagagatacaaagtaattgggagtcagagaggttttaaagaggcaggattctgtgaagaggcagcctgccacctacccacacttagaacccttttttatctttcctaataacaatcatgtctttttagtaacactgttttctattactcaagcgaggatctcaaaacactccataaatacaaattactctaacctaggatcagcctctgatgaccaggcctaaggaaatacaggtatcagtcaagaatccaaggcagaaagtgactgaaacccacactgtctcagtgatgatggctgtttggccacactgctctcctagagcgttaaccatgtctgatagctttggtttgcactttaggagctctggtttttagaacccccagagatgctgccatcttcaccatcatcatcttcaagtatagccacattgcttgacccagcacctccatccctctgtgatctggccccactggatgtttccagctttgtctgtcagtttcccacagtgagtgattatcactctcttcccatcacagtggactcccaccttcctctgaatacacttgctcccgatgcactgccacaacccagtacctctgcccacacctgcgccttctcttcagtctctatcccgattctcttccaccaacaatcccaactcaaacgtctccggtaattaacctgccccaatgtcactgtcaaatttaactgcttcttcccctgaactcccatacattgtgttcatatttctatttatttcactctctggatattctgtcttgtaataacagctagatttccttattcaagcatcccaataaccaaagcctccaaaaaacagtgaagtgggtaatattgttatctccattttatggaagaggaaactgagtcttggggtcattagtcatggttcctcagctagcaaatggccagaggggaccagaaacctgatctacctgacgcacgagctcatgctcttaaccactctgtggcctgccagctgtccacttgtccgtatgtctctccctgatgagccaaagctccacaaagactcctctccagcacctgaacacaaccagcacgcaataaatcatggctaaactgaaaactccagattcactccagatgtagcagctgaagaaagagtggaagctccaagctgaggcctgtcaccctcatccttatcctaacctcccaacaattcatccccttgacatttctcttaaactaggtccttattatgcagctgacatcacttcattgctgtcttgctgtatttctccttaagatcaataaaccacttaattgccaaaaagtggacacttcagggaagaatatcattgactgcactgcaccagggcctgctcatgctgggcattcctcaaaccacaggacctgggctgggcattaaccaagcacagaggggaagccagaaaataaggaggcaaaaatctacctgctaagaacacccccgatctcacatagccaaccatgctgtttgtggtaggattgttcttgcccaaccctaaattgtctcaggattgtgaataaccaaaagttcatcctgagaacctatgcttgaccttgagcccttcctctgggcaaacttgtcctgaaacccttgggacaagagctcaagcaaatctttgctcaattgcttatgaataggcagaaacgcccagcaggggcaggatgtcaaatgatgtgatttcagaaaatatctaagtatcaatctttattttattattgagaggacaaaaacatgtgtacatacatgttcaacccatctcatctgctttcccccaaagggcggtagaaattaacgtctgtgtgggaaccaggatcatatgagtcacatttaggcagtggacttaaagcccccaacactgaagaagtacaaaatcaccctcaaaagcagcagtgaaataaaaaagcaaacgacacaattaaaaatgggcaaaggggctgggcacaatagctcacacctgtaatcccaacattttgggaggccgaggcaggtgggtcacttgagaccaggagtttgagaccagcctcgccaacatggcaaaacccaatctgtactaaaaacacaaaaaattagccaattggtggcaggagcctgtggtcacagttacttgggaggctgggacacgagaatcacttgattctaggaggcagaggttgcagtgagccaagattgaaccactgcagtccagcctaggcaacagagtgagaccctgtcttaaaaaaaaaaaaaaaaaggcaaagaacttggatatatgtttctccaaagatgatctacaaatggtcaataagcacatgaaaagatgctcaccatcactgatctttggggaaatgcaaatcaaaaccacaatgaaatgtcacctcacacccattagaatggctactatcaaaaaacagaaaatggctgagtgcagtggctcacacctgtaatcctagcactttgggaggccaaggtgggcagatcaactgaggtcaggagttcaagaccagcctggccaacatggcaaaaccctgtctctactaaaaatataaaaatttgttgggcattgttacgagtgcctgtaatcccagctactcgggagtctgaagcaggagaatcacttgaacccgaggggcagaggttacagtgagccgaattcgcaccattgtactccggcctgggtgacaagacaagagtgaaactccatctcaaaaaagaaaaaaaatgaaagaaaataacaaacattggcaaggatgtggagaaataggaaccctgtgcactgctggtgggaatgcaaaatggtgcaaccactatataaaacagcactgtggttcctcaaaaacttgaacgtagaactgccatatgatccagccatgggtcatatcttttgggtatataacaaaaagaactggaagcagggtctcaaagagaagtttgtatgcccatgtttgtagcagcatgattcacaataaccaaaagtggaagcaacccaagaccaacaatggacaaatgaataaacaaaatgtggtctatagacaccacagaatactattcaacctttgaaaggaaggaaattttgacatatgccacaacatggatgaatcttgaggatattatgctaagtgagttatgccagtcacaaaaggacaaatactgtataattccacttatatgaggtacccaacataatcaaattcaaagagacagaaaggagaacagttgtcagaaactggggagaagggccaggcgcagtggctcacacctgtaatcccagcactttgggaggccgaggtgattgaatcacttgaggtcaggagttccagaccatcctggccaacatggcaacacccgatctctactaaaagtacaaaaaattagccaggcttggtggcaggtgcctgtaatcccagctactcaggaggctgaggcaggagaatcgcttgaactggggaggcagaggttgcagggagccaagatcgcgccactgcactccagcctgggcaacagagaaagactctatctcaaacaaaaaaaaagaaagaaagaaaaagaaaaaagaaaagaaaggaaacgaaattcggggaagaatgaatggggagtttttaaatgtgtatttagtttctgttttgcaagataaaaacaattctggtgatggagggtggtgatggttgcatagcaatgggaatgtacttaatgccactgaactgtgcatttagaaggggttaagatggcaaattttatgttatgtgtatcataccacaatttaaaaataaatgagtaaatgcaacaaatgaacttacaatgcaccacatttctggataccctgatctctttgcaaacccttgaaaggcctcttgggaggaaaaaataataatgaagcatttaggatcaggctaattttctcagcattcaatgcatgttcctcatagagataggatcagaatctttactgattcaggagtctattcaataactgtaagatcttagaggataagtctgccttctctaatgtacccttgtggtatgtgagcatgagcctgcccaaaagcagctgtgtgataatttttcactgatgattagggaaggagaggttaaattttgacacgcatttatttactcaacacgcacttgaaaactccaaataggagtccttcaattgcaccttccgcattactcaggttctactgcctcatgctctgaattttacttcctcctttgacagccacaaatcagcacatccagtctacaattaccgcatttccacagaccacgaggacaggtgaagacatagtttggggaagaacaggctatgtggttaaggaggtaaagtctctaaggatttcaaagaaaggagaaaaactaagcaaaggttaactgatacctgactttggtctctaaaggaaaattttctccccctccttcctctcccccaagacccttgggatctgcaatggtacccctccctaaggcttttcaccacccagttgtgacaacccaggttcccatggcccatcatttatgcctctgtagagttcttacttcattctgccttgggcatctgtcctttattcacacctgtgtctccccacactttccatcagagctgagaccacagctccttcctcagcttctccctgaccacctttccaatcagtgcagagcccatgcctggcacaaaatggaagctcaaaaaaactgtctgttgaaatgaaatgtggctgtcttgaaattagaataaaaaccattactcccaatctggattttatcaacataccagggtaaccctataggtttcagaggggaatgggaagatgaaccacggtgggcgggagggcagcatggccaaggagttattctcagagatgaaaactgttaggcaaaatcagcaggatcaaagtaaaaagggtagaggtagctagctggagttaaatagtgattttgaccattttagaagaagtactctccctttgtcttcctgtttcaaccactgccaagaaaataggaaccctgacttaatttccctatcatggtttagaagacaaaaggtgcccaggtcatttcatagcccctctcctgagacgttgttatgagctctgttgaacagagcactttgtatggatgagctcaattctcacaaccactctgtatgggagaggttctcatccctgaggaatcacttgacaagggtcacatagtgataggtcatgggtctaggttttgggaggactgttctccatcccttgcccttgagctttgggtagtatcagtaaccgcatccaggagcctctgccttccgtctgcatccacagagccccagctcccacctctccactcaccagccctgatggaataatgtcaattcatgaccttgcgcaaccgtgcacctttcagcaatgatgttgtcacaatttacctgccagctgattgcatccagcactgagttgttccattgtgcactggcccagggaccatatgcagtaataacaactacgtattctgcatctattatgttctgggcactatgctctgagatttatctctaattctcataccaaccctgaaaaataaggtgccagtaaatgccattttacagatgagaaaactaaggttcacagagtttaccggcccaaaacaacacaggcagagctaggattcaaatctatcttacctagttccaaagctcatccatgctcttctctctatacctcaccatctctgaacaagagttcaggctgggtgtagtggctcacatctgtaatcctaacactttgggaggctgaggtgggcagatggcttaagcccaggagtccaagaccaccctgggcaacacagcacaaccctgtctctacaaaaatatgtaaacattagctgggtgtggtggcacgtgcctataatcccagctacttgggaggttaaggtaggaaaatcacctgagcccaggaaggttgaggttgcagtgcactgtgatcgcaccactgcactccagtctgggtgacagagtgagactctgcctcaaaaaaaataagagttcaaaaggtgatgggggggccagatgcagtggctcatgcctgctatcccagcactttggaaggctgaggcagatggatcacctgaggttgggagtttgagaccagcctgaccaacatggagaaaccccatctctactaaaaatacaaaattagccagacatggtggcacatgcctgtaatcccagctactcgggaggctgaggcaggagaatcactcaaacccaggaggtagaggttgcagtgagctgagatcatgccattgcactccagcctgggtgacagagcaagactccatctcaaaaaaataaaattaaaaaaggtggtggtggagggatctgaaatatgagatccagacacttagggtccacagcctcaacttctccctcagttcctcctgatcagatgtaaggcccctccaccttgtatgtcactcaacagcaagcccgcttccttaccgtgggccgcttccagatgatgccttgagtttgcggagagcctggtccaagatccttgtagcccaaagctgatggacatgctgggaactcagggtccttaaataggacccctgagtccaagcactgttgcctcagggtcttgaaatcctggcccaagtacttcaaagcgttttggttggagccaagaccttgagtggctgcccgctgcctagatacaccagctgcctgggctgccatggccgtgggctctgtagggtggacagaagggcagggctgcactgtactctcagacacctgctccactgggaggggagctataaggcactaaaggaggtggagcagacaaacatttcacctgaggccctgttccagaaggaagtgagtcatggccagggacaaatatgtacccaaggtccaggccaatctgccccaccttcttcttctgccttttgcaaataatttggggtctgggaactttccagggcccatcccaggccattagcctaagaaatccattaggatcttgaccccaccccggcattccctccacacacctctttgcaagacctgcttaccttgcttcaagcccattgactgagatgagaaggcttattgagcagcttgaagcaaatattcatcaaggaattggaggcatggctctgagcaggaagaaggcaagtagttacaggggcctcctttcctgccagaaatgttttggtgcatatttcctaggaaggcaaaaaataccagagagtagtgattcacaggccagatttggaataagcctgactggaggaggttccacctgtgagtgaacgctttggcctctgactgcctcggtttctatcccagctcccccggtaatttgctctgtcatgttgggcaagttgtttaacctcttttctcctaagtttttttatctataaactggaagagcataggagagcctaccacaaagggttgttcggaagagtgatgagatagtacatgtcatctgcttagaacagtatgaagtaacattcagtgaatgtcaggtatcactattccttgaagccaggattcccagaaaggccttggaatcaggagccttgattccaatctcagaagtgagttacaagctgtatgaccttggattagtcacttctctctgggctccagtttcctacatctggtctacccgaaggatgtcaaccacaccaatgctttttgaacttcagtgtttgtggcacactagaaaatggtcccccaaggataccaggtcctcatcttgagaacctgtaaatagtcccttatctgggaaaagggtttttgctgctatgactaagttaaggatctcgagatgggaagattatcctgaccctaaatacacaagtgtcctaagaggaaggcagaagaagatttgacaatagacaaaaaggagaggtgatgaaatgaggcaggcagaggttagcgagatcctgccccactccagggaacaccagcagccacaggagctggaaggggcaagaatggattctcccctagagccgctggagggatgtgggccttccaacacctcgatttcacagccttgggacttctggcctccagaacggtgacagaatacatgtatgttgttctaagccaccatatttgtggtcatttgttacagaagacgcaggaaacaaatatagtgtgcagaagaatcccctggagcactcgctcaaaatgctgattccctaataggtgctaccacaaatcctccacccccatccctcccaaaaaagagttctaattcaggaggtctgaagtaagacccaggaatctgcagtttttaaaccagtaccacagagatgatgctaatacaaggatccagggatgccctctgagaagctctggaccagccgacctctgaggcctccaactctgaccttctaagccaatgacagtccacgtgttaagcacttagctaggtgggtaggtctgagcaagtagaaagaagggttgctcccaggtgttcagaaaaacatgtggtttcccaggtttcatcagaaactcaaggccaggccaggcatggtggctcagatctgtaatctcagcactttgggaggctgaggcaggaggattgcatgagcccaggagttcaagaccagcctgggcaacataacaagacccagtctctaaaaaaaaaaaaagaaaaattagctgggcatggtggtgcatgcctgtagtcccagctactcaagaggctgaggtaggaggatcacttgagcccaggaggtcaggtcaaggctgcagtgagtcacccactccagcctgggtgacagagtgatgaaaccctgcctgaaaaaaaaaaaaagaaagaaagaaagaaaaagaaattcaaggccaaaatggccttcagaggctaaagctagcctcagaaagactatggtccatgcccccttggggaccccgtcttccttccctcaacatcactttccctttgattccacatctgcccactattaagctcatctagtgttcacagttacattttcaccggcccacacagttgacacggtctcacttgggtggccccaaccacccctaaaaccagaaccacaactccattcagtcaaaacagaatggtcattgcaaatcttggctgtgtcactgccaagcttaaaacctccaatggctgcccactgttcctgggagaagagtaagggggattttgcacagcccattagaccttgagcagctggccctgcctacctttcctcctgctccattctcccctcctggctttctttccattcctggaatgttgtgttctgtcctgcttcagggcttgacaccttctgtgccctccacctgaaatgttcttctccccaccccagccctgttcatccagtagacctgggtgccccagaaaaggttttctggacaactccacacctcatactaagccattttcccctcttatacgctctcatagcaacctgcaagaccctgtcccgcaccgattcctgtaatcatttaattaatgcctctccaccccataaggctctgatctccacgaggacaattacccctgtttgttttactcattgttgtattcctgaaccctagaaagctcctggaacatagtagggactcaataaatatttgttgcatgaatatacacctacaggtatgagatgtgctgtggataaacgtgcaccaggtataatggacctgacaccttccggcagggtcattagttcattagcaaggatcctatgggattgtttttcttgcctctttctcccctacacctcccagaaacattccccttagactgactaaaatgaacaagcccttcctccatccaatcacagaataagcacagctggtaattttccttctgcacaagggaactccttcgaggttagcaatctccttcctaccccacctgcctgaattacctcgctcccacatccagatgctgtgcaaacaaacccttcctcatcgaggctggcaggtctgagccactgaaaatagagccttccttgtatccaggcacaaaaagaacaagtggagttgagaagtctctgctccccagcgcctcatgagcagacagcaaacatctatgtgttctccagccaggtacccaggaggaagcagcctgcatccactgtctctgtccacctggacagatgtctctccagcctcacaccccaggcaccacaggaaccagtgccagctccttgccaggcagcctgaggatccactaagaggttgatgagggtgtgcagacacaactgacacacgcctggcagcacctccttaataagaacacttctcggcaaagagcccaggtgaatgctgcctcttctctgtgcacaccagccaagtggggatgctgagctgtatctatacatggctcctctcagtcaaaaggatcaaggctgtattatccccttagaaaggaagataaatcactctggttgcacccagcggtccaagtgttcttttcagatgattaaagtttgcaaagcttgttgtcttgcataactataacttcagggaaaagatgggtgcaagctaactgcagaattctctctcctgggcctgacagtttcagaatgctaaggcaagcaggggttgaatccagtgtcaagaggattacagagttctcatacattgctggtgggaatgtaaaatggtgccgctgttttggaaagcagtccagcagtttctcaaaatgctaaacatagaattacacagtaactctgagtaacatcccacttcaaggattgaaagagaattgaaagcatatgtctacacaaaaacgtgtacataaatgcccataggagcattattcataatagccaaaaagtggaaacaacctaaatgcccatcgatggacaaatggataaacaaaatgtggtatatgcatatgatggaatattattcagccataaaaggagtccataaaaggagcgagatactgttacatgctacaacatagacggatcttaaagacatgcaaagtaaaagaagcgaatgacaaaaggccatacattgtataattccagttttatgaaatgcctagaattgcaaagccatagggaaagaaagcagagtcgtggttgccaaggattgggaagtggggctgactctaatagttacaaggtttcttttttggggtgatgaaattattatggaatgagatggtggtgatagttgcacaaccaaaagtcacattttaggccaggcacagtggcttacacctgcaatcccagcactttgtcaagctgagctgggagcatcgcttgagcccaggaggttgaggctgccgtgggctatggttgcaccactgtactctcatctggatgagcaagcgagacctgtctcaaataaataaataaatatcacactttaaatgtacactttggcgatgtttatgttatgtgagttatatctcaattttaaaattgaaaaggagaaaaaaaggcattacagaggggaaggctggctatgatacaagcattggtaggtggcctctaaggaagagattggcttcccatctgcccaggatatcaagtgcccagcacatgcaaacagttctagagctgtaagagcaaaccctacctaaccagaagcctggatgagttgagatgtgtgggctcattctctctccaggtctgcaggatcgctcatggcatcttaggggtcacagctcaggccttcatcctggcaggaaagggctcagtcaaggccagttgggaggccagctgagactgccccctagaggcctacagatcctgttgacctggtatgactaagtaatgtggcaaaaactcacatttgaatagaatgcaaggtctacatagcactttcctgccatggctgcttagagattcacgacaagtctgtaagaaagatcatattgtcaggctaccccaaggtcactcaagtagcaaacttgagcccaagtcttctgattttaattcccatgctctttttaaggcacgctacccacacataccaacagggagatgcgacctgggcagtaggctgtgagatgtgatgcctaaaaggaagaaatccaatgactcactcagccctccaatctgcaagccatctctgtgcctcactcagatctgcaagcctcactcagatctgcaagccgtctctgtgccaacactccactgggcaggggtcaatgctcgtaggaggataaaaggacaaatagaggccagacgcatttgttcaggcctgcaatcccagcactttgggaggacaaggcaggcagatgacttgagcccagcagttccagaccagcctgagcaacgtggtgaaaccccatctctataaaaatttcaaaaaattagccaggcatggtggcaggcacctgtaataccagctactcaagagactgaggcagaagaattgcttgaacccaggaggtggaggtttcagagagctgagatcgcgccactgcactctggcctaggtgacagagcaagaccttgtctcaagaaaaagaaaaaagaaaagaaaagaaaaaatcgaaagacaaatagacaccatgcctgcccacaaagaacttccatgcagtggaaagaccaggcaatgctcaaagaaagagtggttgattctgaggatgatgagtgataaggagggcttcatggaagaggtggccttccagttagatctgtaggataaggtgcttgaaggatgatgattttgaaagaaggcagtgtaaaaagggcattggagtcaaggggaacagcaagaaaatggcaagaaggaacagctctgcacacagtgccaacagaatattaattatctagaatgagatcattctagatcactcactcctggagtgaggcaggaggcaaacaacaagaggaaaagacactgggggccttgaatgccatcctaaatggatgtggacttcttctctatagttagggtgcagttgctctgaaacaagcaagaatcgatgatggcttaattcaggtagtggcactggggctgggcaggtagggagaggagttcccaagtttacctcctctgtgagtcccagaggctggggatgagtgtggaggaagggaagacacagccaggatacctcttgtgatcttgtgatttaataagaaataagtattttggtctttgtcctcagttcctggcacaaagcttctaaaatctttgtaatttcctgggtgataaatgtgctaggagcatcttttgttgtaatatttggtctttgactctagttcctgacagagctcctaaatccctggaatttcctgggaatagaagagtcttttgttctaataaggtgactcttgtgggctcctgaatgggggctagtcacaagaaagaccaagccatgattagaagcttggaaaaagccaggcaagttgcttcacaactgtaatcccagaactttgagaggccaacgtaaaaggatcgtttcagcccaggagttcagcgccagcctggacaacacagtgagatgatatctgtactaaaaataaaaaataataaactagctggacatagtggtacacacctgtagtcccagctactcaggaaaccaaggcaagaggattgcttgggcccaggagattgaggctgtagcgggccatgttcatgccactgtactccagcctaggcaacagagagagaccctgtctcagaaacaagaaagaaagaaagaaagaaagaaagaaagaaagaaagaaagaaagaaagaaagaaagaaagaaagaaaggagggagggagggagggagggagggagggagggagggagggaggaagggagggcttggaactttcagccccactccccatcttccaggcaggggagaggagctggtgactaggttgataatccatcatgcctatgagataaagcctccataaaaattcctgagctacaaagacctaacaacagagctatcattatatctggcaatcccattactgggtatatacccaaaggaatataaatcattctgccataaagatacatgcaagcaaatgtttcttgcagcactattcacaatagcaaagacatggaatcaatcaaaatgcccatcaattacaaattggataaagaaaacgtggtgcatatacaccctgaaatactatgcagtcaaaaaaagaacaagactatgtcttttactgaaatgtggatggagctagaggctattgtccttagcaaactaatgcaagaataccaaataccacatgttctcacttgtaagtgggagctaagtgatgagaactcatgaacacaaagaagggaacaacagacactggagcctacttgcaggtagagggtgggaggagggagaggaacaaaaaaagaataactatttggtactaggcttagtacttgggtgatgaaataatctgtacaacaaatccctatgacaggagcttagctatataacaaacttgctgtattagtccattctcacactgctataaagaaatacctaaaactgagtaatttataaagaaaagttgtttaattggcttatggttctgcaggctatacaggcttctgcttctgaggaggcctcagaaaacttacagtcgtggtggaagacaaaggtgaagcaagcacatcttacatggtgggagcaggaggaagtgtaggggaggtgctacacacttttaagatagcactagggggatggtgctaaaccattaaaccacccccatgatctgatcacctcccaccaggccccttctccaacactggggattacaaattgacatgagatttggacgaagacacaaatccaaaccatattctgtccctggcctatcccaaactttgtgtccttctcacattgcaaaatacaattatcccatctcaacagtcccccaagttttaactcatttcagcattaactcgaaagtccagtccaaagtctcatctgagacaagacaagtcccttccacccatgagcctgtaaaatcaaaaacaagttagttacttccaaaatacaataggggtataggcattggataattactccctttccagaagggaaaaattggccaaagcaaaggagctataggccctatgcaggtccaaaacccagcagggcagtcattaaatcttaaagctctgaaataatctcctttgactctgtgtctcacatccagaccacactggtgaaagggctgggctcccaaggccttgggcagttctgtccctgtggctctgcagggctcagctcccatggctgttctcaagggtgttgagtgcctgtggcttttccaggtgcacagtgcaagctgttggtggatctaccattctggggtctggaggatggtggtcttcgtctcacagccccactaggcagtgccccactggaaactctgcatgggggtttcaaccccacatttcccttctgcactaccctagtagaggttctccatgagggctccactcctgcagcagacttctgcctagacattcggccatttccatacatcttctgaaatctaggcagagactcccaagccttaactcttgtcctctgcacacccacaggcttaatgccatgtggaggccaccaatacttgcagcttgcaccctctggagcagctgcctgaggcatatctggagcttgagccgccaggacacagggagcactgtcccgaggttgtgcagggcagtggggctctgggtccagaccacaaaaccattcttctatcctaggcctctgggcctgtgaagggagaggctgccatgaagtttgctgaaatgccttccaggcattttccccattgtctcagctattaacattcagttcctctttacttacgcaaatttctgcagctggtttgaattcctcttctgaaattttttttttctctaccacatggccaggctgcaaattttccaaacttttatgctctgcttcccttttaaataaaagttctagttttagatcatttatttccttatgcatgtgactgtaggttcttacaagcagccaagtcacatcttgaatgttttgctgcttagaaatttctccctcaagataccctaaatcatctctctcaagttcaagttccacaaatgtctagagcaggggcataatgctgccagtctctttgctaacacataggaagagtaaccttaccccagtttccaataagctccatctgagaggtctccatctgagacttcctcagcctggacttcattgtccatatcactatcagcattttggccacaacaattcaacaagtttctaggaagctccaaactttccctcattttcctgtcttcttctgagccctccaaactcttccaacctctgcctattacccagtttcaaagtcatttccacattttcaagtacctttatagcaatgctccacttctctggtaccaattttttttattagtccattctcacactgctataaagaagtacctgaaactgggtaatgtataaagaaaggatgtttcattgtctcacagttctgtaggctgtataggcttctgcttctgtcaaggcctcaggaaacttacaatcacagcagaaggcaaaggggaagcaagcacatcttacatagtgggagcaagaggaaggaggggtgccacacacttttaaaacagcactagagggatggtgctaaaccattaaactgttcctatgatccagtcacctcccaccaggcccctcctccaacactggcaattccagttcaacatgagatttgggtggggacacaactccaaaccgcagcacttgcacatatacccctgaacctaaaataaaagtttaaaaaataataataaagaaagaaatctacacacacacacacacacacacacacacacagagagagagagagagagagaaagagagagagagagagagagaaagagagagaaaggcaaggtcacagctaaaaaaaaaaaaaaaatccctgagctacagaattcagagagcttccaggctgctgaactcatggaggtgctgggagggtggtgtgcccagagaaggcatggaagttctgcacccctttccccataccttgcctgtatttgtctgttctcatgctgctaataaaggcatatctgagactgcataatttgtaaaggaaagaggtttaatggactcatagttctacatggctggggaggcctcacaatcatggcagaagagcaaggaacatcttacatggtggcaggcaagaataggacatgtgcaggggaactcctccttataaaaccatcagatctcatgagacttattcactattaagaggatagcatgggaaagacccacccttatgattcagttacctcccacaacatgtgggaattgtgggagtcacaattcaagatgagatttgagtagggacacagccaagacatgtcattgccctgtgcatctctcccatctggctgttcctgaattgcatcgttttatgataaacccataacttagtaacttttctctttgctttctgtgaactattctagcaaattagtgaacatgaggaggaggtcgtgggaacctccaatttgtaaccaagtcagacagaagttgtgggtgacctggggacccaccacttatgattgggctctgaagtggggatggtcttgtaggactgagccattaacttgttctaactccaggcaattagtgtcagaattgagttaaattgtaggacacccagctggtgttggaaaattgttcagtgtgggggaaaaacccacacatctggtgtcagaagcgaaatgtgttgtgaatagaggaaaacagtgagtgcttcttatatgcctctgaatgctggcatttgacagagaccctaacctcatctaccccagaagctgtaacagttcaggactcatatttagcgtaaatagggagatattttgatttcctctgaaagaaaactactagctagaaaagggacaggctgggtgcagtggctcatgcctataatcccagcactttgggaggccaagcccaggagttcaagaccagccatggcaacatggcaaaactgctgtctctacaaaaaataagaaattcactgggtgtggtggtacacacctgtagtcccagctacttgggaagctgagttgggaggattgcttgagcccaggaggtcaagactgtagtgagctatgatcatgcccataaataggcactgcattccagcctaggtgacagagtgagaccctgtctcaaataaataaataaatacaatacaatacaatacaatacaatacaatacaatacaatacaatacaatacaataaaatacaatacaatagaaaagagagggcataaatgtggagagtcctctgacctagtcttagaaaacaaggccatgaaggtaggaactgtgtctctctcaagttcatcgtgcaacccttcacagagctccacatgcaatatggggacttacgagtgtactttgaggttgttcttgctgggcatgtcactatatcacatgcttccctgacctcagttcctgctgccaagcagccacagatgcacctgcatcagttttctctgtctctactggatcgttttctttcccatacaagtttgctatagtttctcctgccttaaaaaaagaaaatgtttaatctctcttgactccatgcccctgtcctgtttcttcttttctttcttttttttttttttttaccttgagtcttgctctatcacccaggctggagtgcagtggcacgatctcggctcactgcagcctctgccccctgggttccagcgattctcccgcctcagcctcctgagtagctgggattacaggcccatgccaccatgcctggctaacttttgtatttttagtagagacggggttttgccatgttgcccaggctggtctcgaactcctgacctcaggtgattcgcccgccttggcctcctaaagtgctgggattacagatgtgagccaccatgccgggcctcttcctttcttttcacaacaaaatttcatgaaagtggtgtgtattctcactgtcctttcatttctgtcctgcctttctctcttaccatccctctgggcagatggtcagggtaaaaccattggccaatatccaggtggtcttgatgttgctcaatccaatggttaactctcagtcctcttcttagttgacctgtaagtagctgattggactcaggtcgatgctctttccacctagaaatagagagggggatgaatttcaggagggatgtttttgagtggccaagaggaaatcaaatctagagcccaaggggagaggttggccttaggacacagacagttcatcccttgtcacagggtagatggcagacacagtgtgaggatagatgtcacagttggaccttgggaagttctgttttcagtgctttgacctttctcttggaaataggagtgaagggcattagctgagagtgagaatggggcagaggtgttggagatttgagagagagagaggaggtataaagtaagtgatctggccgggcatggtggctcatgcctgtaatctcaggactttgggaggccaaggcaggtggatcacctgagatcaagagtttgagaccagcctgaccaacatggtgaaaccccatctctactaaaaatacaaaattagccaggcatgatagtgcatacctgtaatcccagctacttggagggctgaggcaggagaatcacttgaacctgagaggtggaggttgcagtgagccaagatcacaccattgaactccagcctgggcaacaagagcgaaactctgtctcaaaaaaatttttaaataaaataaaataagtgatattgaaaattggataagagacatgatgctgccaggtggcattaagggccagttgagttagtgactatcaatttaatgtaagacagatcaacacatatattatttattttttgcagatgacaaattttcccaaattcagtggtctagaacagcatatatttattatcttaccatttcggtgcatagggaatttgggaatttagctgtatggttctgacctctaagactttcatgagacaccgactgcagctatagtcaactgatggctcagctgtggtgggaggatctcctatcaggatggctcactcgcatggccatgggcaggaggcctcggttcttcattacgtaagtctctccttaggctgtttcaatgttatcatgacacggcagctgacttcctccagaacaagtgatacaaaaatcagagagggaactgctttttacaatctagtctctgaagttgtctactcacttcaggtttattctattcattagaagcaaattgctatgtccagcccactctcaaaagaggaatttacctccacctcttaaagtaaggaataccaaataatttatgggcatttttttaactaccataccttgattgtgtgctttattccagtcacactgagctgtacaggcacaggtcaggcatggggtagatggaaagttggattaagtaagttatgaatatgtgagagcaagaaatctaagaaccagagccttgatggtgccaggcctcccaaaatcagcaggtgaattctgctgaatgtcggctgcacatggctccagcaggctcagcaccagaacggtgggtccttacgctgctgcacgcccattagcaagcttcagctctggtcacctgtctaattcagtcctgctgtccgctggcctcgttgaactactcattattttttgtttgtttgtttggaattgaagtctcactctgtcgcccaggctggagtgcagtggcatgatctcagctcactgcaacctccacctccagggttcatgtgattctcctgcctcagcctcccaagtagctgggattataggcgcctgccaccacgtccagctaatttttgtatttttggtagagacaaggtttcacagtgttggtcaggctgatctcgaactcctgacctcaagtgatctgcccacctggcttccaaagtgctgggattacaggcgtgaaccaccgcatccggctgattactcattgtttttgctccggcaaaacttggacttccccatggcctatcatagcctctccagctccaactctgtcttatgacttgcctaatacagctctcacaacttactagcaaataatccctttgtgtttctctgtctaaattgccaaaagagaaaaatctaattggccctggtaccttcttaagccagatcacacaggtcccatgtcactgaccaagctaagggactggttgctgtggcacataacatcaatgcccacaccccttggagccctgtatgtttgcaaactcacaagctctggtgtgcttgcaaccccagcagctagcccctgacttccttggccagagggctgtacctctctcagcctatcagagccaccttgccagaagtggctctctaactggggacatatgccccctggggtgcttggtaacatgctggagcaccaacatgatgttttcttggactattcattctattgaaagttttttttttttttgaaagaggaattcttaactttttttttcttttttctttctttttttttttttttttgagatggagtcccactctgtcacccaggctggagtgtagtggcacgatcctggctcactacatcctccacctcccaggttcaagcgattctcccatttcagcctcccaatagctgggattacaggcacccgccaccacgcctgcctaatttttgtatttttagtagagattgggggggttcaccgtattgttcaggctgatctcgaactcctgagctaaagtgatctgcttgccttggcctcccaaagtcctgggattataggtgtgaaccactgcactcggccaatttttaatatttttaataagaattatatacgggaagctgccaggctctaatttcaaggagtgcatattagctcttctccatgtaaagggtctttctcttttccctgtttagtggagaaattttgaatgtggaaaatataacatatgcatacaaatatatgaaataaaactcatgaaaaaaagaaaatatatacacgaagatcagaatagtggtctctttcaccctgaagagtgggaaacgaagtgaggaaggagcatatagagagacgtaagttttaagtaattttttagttctcgggtggggtggtggatacataggaattcatcatactttttgttttgtttttgagacagtctcagtgttgcctaggctggagtgcggtggtatgatcgtggctcactgcagccttgacctcttgagctcaactgatcctcccatctcagcctcccacgtagctgggaccacaggcacacatcaccatgcctggctaattttttgtattttttgtattttttgtagagatggggctctccctatgttgcccaagctgatctcaaactcgtgggctcaagcaatcctctcaccttggcctcccagagagctggaaatacaggcatgagctactgtgcccagttcgtcatactactaataataacttaaagaaattaaagaaagccatgtgctggccaggcacggtggctcacacctgtaatccccgtactttgggaggccaaggcaggcggatcatgaggtcaagagattaagaccatcctggctaacatggtgaaagcctatctctagtaaaaatacaaaattagccagacatggtggtgtgtgcctgtaatcccagctactcgggaggctgaggcaggagaatcgcttgaacctgggaggcggaggttgcggtgaactgagattgcaccaccgcactccagcctggtgacagagtgatactctgtctcaaaaaaaaaaaaaagaaaagaaaagaaaagtaaagtaaagaaagccatgtgttgactaataataatgagagtattatgaatcaaggattacaattaatccaattttgaacatggacagtaaaaaaagaaatccccacagcaggtagagagggagatatttacgagttaagaatcctgcccagggagcctcaaatctaacaagcctgttcccacagcaggcctggcagtgaaatcagctgggaaggtggtatccacagcccctcagtcactctcccttgcagttagggtctaggctgcacttggaaagagcctcatctcccgtccccagctccccagtcactagtccaaagagaacactgagttctccactgggttttcaaaggaaaggcaaaggaggataaaacattaacaggtccttgttagtataggttcttgttagactttcaatttacaaggaattttagagaaatgcctcaagctgaacctgtaatagccaggtgggaacttgggcagatggtagcaatttctcaaggttcgtcccaaaacactgctgcagatccttcccatggtcactgtttaaacacatgtcctgtccagtctttcttgtaaccatcccttgagtcatttctttcctctccatccccacagccatgacttaagtacaattctttattccttctagcctgcagcacaacaatagccttccaaatctctcaaatccctccaatctccacagtctgatcctgtcacttaaggtacttcaatgctcctcaccttgccttaaagatgatagcccaactccttggtacagcactgtgaccctcagcgtctgggtgtcccagccctgtcaccgtcacaaccctgtctgcccatatctcctccatgcagaactaacattggaaacaccccccaaactcacaatgccttttcacacctctatgctctttctggctgcaaggacagtcactctggtctctccctgcttaggcatgactcacctttctagattaagttcaaatatcactcctccagaatgtctctcaaggtaaaggctagcccatgcatctcactgaattgtaaggttggcttctccgttccatatcttccccactactcccattaaagttgaaattccttgcatgcagggactgtatttttcatccttatgtctctattccctttatctcaaatttctttttttttttttttttttttttgagatgcagtctcgctccatctcccaagttggagtgcagtggcatggcacaatctcggctcactgcaacctccacctcccgggtttgagcgattctcctacctcagcctcctaggtagggattacaggtgcacaccaccacactcagctaattttcgtatttttagtagaaatgggttttcaccatgtgggcaagtctcgtctcaaactcctgacctcaggtcatccacccgcttgtgcctcccaaagtgctaggattataggcatgagccactgcacccagcctatctcaaatttctttctgtgacttagaacctggcacataatatgagttcaatacatgcttgatgaattaataattagctaaatatataagtcatattcaaactttgtatttcacactcttggactggtaagagacagagtatagttaagcccgtgatgagtataattgtatgaattaaagtacacatgtatactgagggctcatttcacgtgtgagtctctgaaaatgtttgcgactacaacttaaaccaagacaacctaaggatttcgagaagcagtaagagtatccagagaaaatagtaacttagatgcagccaatacaagctcaagactgagagtctgcaaatctagattccagcctctgctctgccacattcttgagtgacctggagaagtcactttaaccctgggtcttcctgtgctcatctgacacagagggcatgggagcctggagcccagccctcctgtgcaccctgtctagctacacttctctggaggcgaaaggctgctgggcattgaacacagctatcagcctgggagctgggccgagcctcaccagggaatagtgaggggctccctgctccgacagcacacaggtgcacacacacgcctgctcatcaggtccccggctgacccctttacacacaccatctcctgcttctgcaacaatgccgtgcaatagcaactatcaccagccacattctacaggtgagaaagctgagcttcatccacagttcctcagtagcaggagtaggattggaacccaagtgtgttagctaaaagcccacacatttatccaagataccatattgacactgtttaaagtgacaaacgatcactttatgtagaatgcacccagggagttgaactgatggagtctgcattcttgtcacagagtccactctcccctccacatctcccccttagccccaacacaggactgctgggttcctctgctagtcccaggtgagatactctctcaccttccagcagcaggtaacaaggaccaggaggcaccagagacaaacccagctcctcactgcagccagcaagggaatatggcctctcagagcagctgggattctagccagctgaaattaaactgcgcagcgacagcagtcagaggtaactcatgttaaaggtatcagtgatggctccagcaactggtggtctctgctgccccctagatgtctgtttcctccaacaggcctcagattaatttaaaaccaagtgcttggtgtaatattgcatagtaacactcttttcctgcttcatcaatcatgcatttatcctacctttcctgtgtggactgtaagtagttggcaaggcaatgctcttcttaagaattgcagcaaataggagaacaagtgatagaggagtcaccgtctggcaacccttaatgacataatgagtctaggtagccatcaccaatggatgctaacacaattagatgaaaggcgaatggagaactttataatagatggatctgactgaaacacctaagcccacttatcaatctgtgcatctatgcatgggacattattgccttctcatataatacggtgtacaatataggttcatctgtgaagacctctgtccaccccccaaaaaataaactgaatccaatcaaacctctagattttactgccagtttagagaaaataagaggttagtcagggtttcttagcctctgcattattgacattttggataaccaccaaaaggatagtaaaaaccagtctaatggtgaaatgaaataataaaaaatagttaatccaaaagaaaggaaaaaaaaaaaggagaggaaggaaaacatagacttgatgggacaaacaaaaagcaaaaagaagaaagtaggtttagatgcaaacatattagtaattccattaaatctaaatgattgcattaaaaaaattctcagcctagttaaaagcaacaaagggacatagcttaactataaagatatagaaaagttaaaaataaaagtacagaaagaaatgcatgcaaacaccaaaagaaagatgatatagctatataatatcagaaaaagaacaccctgaggcaagaagcattattagcgataaagagaaacatttcataatcatgaaagatcaattcactgggaagatgtagtaaaactgtatacttataacaacatagccacgaaatatgtacaataaaaattggcaagacaaaaaggaaaatatgcaatcttaatatgagatattaatacaatactcttagtaacggatagaacaagcagacaaaaataccaataaggatatagaagatttgaataacacaattaacaaacttagcctccttagcatatgtagaatactgcaccaaacagcagcaaagtccgtgttcttttcaaatgcacatggagtatttaccaaaattggccaccacacaccccacagtcctggtggcatgggcacattttgtgcatagttgattgatatgggagactgtacctgacccaacatgggtcaatgagttttttccctagatttttggacttgaatctgatggttgaagctgtgaaaaataaagtttgggcacttttcctcccaccttgaaaaggggatcccaatgttatctgagtctctgtttaggttattcctgaggcatgcgtattctaccttggttttacaatgacattccagaatctttagcatgcatttactttggacttttttttaccgtgataaaatatatataacataaaatgtactaggtttagcatttaagtgtacagtgcagtggcactaagtacattcgcattgttatgcaaccatcacaccatccatctccaaaaccgcaggtttcatcttttcatcttccaagactgcagctttatctccattgagcaccaactccacatttcccactccttgtatcctctagcaaccatcattctactcctagactactttgtgactcagtttctctgtcacttaagagaagagaggctccattgctgactgcagggattgcttctgtatatgcaggccttcttgcatctataggattaggtttactgcagggaaaaaaggtaagagaaatatacatcatatgggtttttggaggaagaaaagaggcgacagcacaaaatggatgaggttttcgtgttgggtgtcctgcacacaggactcagcagccctgccatgtatctatctgcccaactctttcccatggagttcatcttgtgggccacttccaaattatagatccacaggcaagtttcacagctctgtcgctgtcacctgtggcaagcttctcatagtgcctctgtggcttaatgtcatgagcccctccattgtgagcattctgtttagggtcctgcaccatcacagcctggcaatgagcttcagatgttttgccataaccttagatttaagtcatcaagcagcaggaccaagacctatcatgcatttacttttgtttttggcttaatttgagttggtttttttccttgtacaaaaagaatctctgtacacagactcctattaatttttttaattaatagttttatttttcagagcagttttagctttacaaaaaattgagaagaaagtaagatgttcacacacacacagcttcccaattattaatgtctcacactagtgaggtacatttgttaaaatcgatgaacctatgttgacatgtcattatcactgtagtttactttagggttccctcttagtatggtatattttatgggttttgacaaatatatgataatatgtatccaccattatagtatcagacagagtattttcactgccctaaaaatcctctgtgctttgcctgttcatctacccctcaccaaacacccagaaatcttttttttttactgtctccattgctctgccttttccagaatgtcatatatttggaattatatgttatgtagccttttcagacggactagtgatatggtttggctgtgtccccacccaaatctcatcttgaattgtagctcccacaattcccacatgttgtgggagggacccggtgggaggtaattgaatcatggggaaaaatgatttgagcatctatcatcacaaacaaccccattctatctctaataatgacttttgcgggtctttgcagtgctgttctcatgatagtgaatcagtctcacaagatctaatggttttaaaaatgggagtttccccgcacaaggtctctcttgtctgctgccatataagatgtgccttcaccttctgcaatgattgtgaggcctccccagccatgtgaaactgtgagtcaattaaacctctttttctttataaattacccactctcagacatgtctttttcagcagcatgaaaatggactaatacaacttatttcacttagtaatatgtatttaagtttcttcaatgtcctttcataacttgatggctccttcctttcttgctttcttttttttaattttaactatacaataaagcactaagctaaagaaattaaactatggaatatctatctgctggctggtggggaaaatgtgaggagcctggagcttcctggaaacacacaatttcctccacaatcttcgctgaccttcccttgagttatccctcttcctttttaacattcctcttgatttgagcctctatcatcacaaacaacctcattctaactctaataatgatttttgccttaaagtattatgtctgattttaatatagttatgccagcttccttctcatactgttcacatagtatatctttttccatcattttattttcaacctttctatatctgtatctttatgcatcattctgttaatatatatcaatccatcagtgactgattctctgattccctaatgtttaagcaatttccttttttttttttttttctttttgagacagggtcttgctctgtcacccaggctggagtgcagtggcacgatgatgtctcactgcagcctgaacgtcccaggctcaagtgatcctcccacctcagcctcccaagtagctgggattacaggcacacattaccataccaggttaatttttttttaattttttgtatagacagagtctcactatgttgcccagctggtctcaaactcctggcctcaagcgatcctcccaccttcacctcaaagtgctggaattacaggcgtgagtcaccacacgaggtcaatctactattcttgacctcagctattggctgtgatatattatcatatatagagagctggatttggtttgctactgttttcttcagaagagaaagcaggatgttgctcagcctgggagggtcatgcccttggttgagttagctctctgcaactgaaacaaactctaaaggatttgagacctggaaactttctgctaatcccacctcccaaagttggggcagttcacatccaatgactgatagaagtaaggtataaagacacagacattttggcttaatctagcatctctgatgggccgtgtatggtccagaacatcccataggaatggccaaagctttgtcacaattgcatcacattttgacttttccctctgcccaagactgcttcctcctcctctcatccacggatgttgattcctaataaatactctgtacaccaagcacagtctcggcatctactcctggaaaaccagcaacaaggtcagcagggctagctagcttcatgggcagcaacctatgcagtcataagggccctgctccaagaggggccccatgcttaggttaatactcttgtcaactaacgagtggtgaggttcataaattttgaaataagaggtttatttctcatgaagtgttgcaatctgcaaggtggccattcctacaggctgggaagtgtagcctgtgacagaagtcagaagcaggtacttcgaggcagggatggataaaacaggaatgtataatgaatggcttggctaagtatacatatttagtacacaataggaggagtcatgaatatttatgaaaagagaaacatgtgcatgtgcaattgggcttcatgcctctttatgcgtcacatgttcaaaaaatgatgatgcttgcatgatccaagggtggagtttttggccctctgacatcaaaaggtgaaacagagaacacaaaaaccatcaacgtgcatcttctgcaaactgctgagaaccactctgtggtcagtgatctcttaccaggaaggaatgctggttagttgctgtgttaaaaccacaaaaaggccaggcacggtggctcacacctgtaatcccagcactttgggaggctgaggcaggtgaatcacgaggtcaggagatcttcaaaaccatcctggctaacacggtgaaaccccgtctctactaaaaatacaaaaaaaattagccgggcttggtggcgggcgcctgtagtcccagctactcaggaggctgaggtaggagaatggcgtgaacccaggagatggagcttgcagtgagccaagatcacgccactgcactccagcctggacaacagagcgagactccgtctcaaaaaaaaaaaaaaaaaaaaaaaaaccacaaaaaggaagggggagtccagtcatggcctcagatgactggctaaaggcaatgaagtagagtcatctgtatcttgttccccagggctgatttccgtgtactccttaggaaaaatttctggttaaagatgaataaggatagggcatattgaggtgtatctgacctcccatccccttatggctgggaactcagtttttaaggttcctctggggtccacttggctgagaggcactccattcagtcggttgggaggcttaggattttatttttatttcttactctgctgtcatcatcttgaaaatataaattttggtgctcacttcagcagcacatatactaaaattggaatgatacagagaagattagcatagcccctttttaaaaaaaaaatatatatatatataaattttgatggctttagaaatgatttgcagagaagtgagtcagaaaaatcttatgaccaatcaagatttcacattaataaagtattattatccattgtattatataaattggtgaaacaaaaaatggtacatttttgcaatttgtaggtttagtcattactcatatatcactattatccctattacattttataaaaattgtttttttaaaaaaaagctttatattttaggggtttgttcgtttgtttgttttgagacagagtctcactctgttgcccaggatggagtgcagtggcacgatcttggctcacttcaatccccacctcccaggttcaagcgattcttgcctcccaagtagctgagaatacaggcgccccaccaccgtgcccggctaatttttgtctttttagtagagacagggtttcaccatgttggccaggctggtcttgaactcctgacctcaagtgatccgcccaccttagcctcccaaagtgctgggattacaggcgtgagccaccgcacaggctttatattttagtattttaattacagtttttttcctgcatttttaacaagataagcacattttcattttgcacccagcgctataaattatgcaaattacatacccagcagggaggataggttcctgtgaagatgattgtccctggttgtcctgtaggagtctaggagagaagagtgacactttaagctattatctgttatttgcaacttcatgtgactgactttcagatactttgatgaaagaagacttttaaatgtgtgaaaaagatctcctcagggcactgcatacaaggaaaacagggagactaccatcaaggtgggaaagggtgatacaacagggccagggacctgatgataaactccagatttcaccaagagttaggctttgttagaatcctgttcctaacaggacacaaatcacacagcgaactattaaaaatgagagcaaagcacacagcacaactattaaaaactaaaaattaagctgtcatttatatgagtcattaacaaaactcccttatcaccagaagtatgctaacaccatatataaaattgaacatgtggggacatcattcaacctcttgtttaaaactggctttgaatggcccaactctagagaattagaatgctttttattatctggggtcctctggagagagatcaacttctcagagttctaaatagagaaaattatctggagttaattaaagtacgccaatactgtcattttccacgtggggtggaaagaactaatgtgtagttaggatatcagcaaaaggctagtagaaacacgaagtcactggtaaattgaatgcacaactcctgggaagtgatcaaaacgcaactgttttgtatattctgctacttgtctgtttgttatttctattatatgtctatggccacctatacaaaaagtgagggccctattttcatgtgaaaggaaccgccacagttagaaacactctaacaaagggtagtggagtaaaccaagccactcctgttctaaacagattttagattcagaaagaatcgctctctcttttttttttttttttttttttttttttttttggagagataggatctagctatgttggtcaggttggtcttaaactcctggcctcaggcaatccttccttggctcccaaagtactaggattataggcgtgagccaccacgtgcccagccagattcaaaaagaatctattgaataggggggaaactaagtaattcaagagactttgtctatagcattttgactatatcttctcagtaaggacaaaacgaactataaacaaacattgaaccctaacctagttggtagttgtaattttcatggtagtatgggtttgtgattctaaaactactttctgtgtattcttgaattaaataaataaataaatatattcagaaggatgaaagcaatatctctcactgttggagaagagaattacaaatatggaaagagggaaggttaaaataaatcacattgtggtcatttggaattggaggccaatttaaattcaagtggcagggtataatttttttttttttttagatagtctctgtcacccaggctggagtgcagtggtgcaacctcaggtcactgcaacctccacctcccgggttcatgcaattctcctgcctcagcctcctgagtagctgggactacaggcatgtgccaccatgcccaactaattttttgtatttttaatagagatggggtttcaccatgttggccaggctggtctcgaactcctggcctcaaatgattcacccacctggacctcccaaagtgctaggattacaagtgtgagccaccacacccagctgggtataatttttttttttttttttttgagacagtttcgctcttgctgcccaggctagagagtgcaatggcacgatctcggctcactgcaacctccacctccggggttcaagcaattctcctgcctcagcctcccaagtagatgggattataggcacctgccaccacgcctggctaatttttgtatttttagtagagacaaggtttcaccatgctggtcaggctggtctcaaactcctgacctcaggtggtccacccaccttggcctcccaaagtgctgggattaaaggagaggctctgcaccagcgtgggtataattttttatgagttaaaattgtattttatttatttacatttataaagagagcattatgtttagatttatgtacctggttttttaaaaactcgtttacctaattaatgagagaatgagtgggatggtaaagttggtttcaagagaacttgagagattaagtattataggcactgaataaaagatgttaaaatagaattttggggtggtatacaaaactggttaatgttatacagggcaagaagactataacctttgggatttagggtttttgtttatttgtttggtttttattttttattttagcttttgttgttttattttttttccctgaatgaaattattagtagctatactagacaaaaatctacatgctagtatgtaacgttatggtcttggccccattcaatagtgaataacaaatcaaatcaaggtacattctcctaaagaataagaaaattcatcctggcatggtggctcacacctgtaatctcagcactttgggaggcctaggtgagcagatcacctgaggtcaggagttcgagacctgacctggccaacatgatgaaaccccatctctactaaaaatacaagaattacccgggcatggtggcaggcacctgaaatcccagctacttgggaggctgaggcaggagaatcgctggaacctgggaggcagaggttgcggtgagccgagatcttgccactgcactccagcctggagactctgccaaaaaaaaaaaaaagaataagaaaattcttggctgggcctgttagctagagagtggacagagtgtcctctaatacagagaacagagatctgtctgccttgaggcaatagaagcaattccagtagcactaagcacccagatcttggtttctaaatactattcctcactaaaaagaaaaagaagaaaaaaaaaaggctccttgaagaaatgcttaatttccccccacaaaaaaagaaatgtttaattccagaactagggcagaaaaattataagtggaatctggaatagcttcatgttccaggaagtaagggggtgctcgaagaatgatgaggacacggcagaagggcacaggagctgtcctgaagggactctccctggcaaaatctggggcaatttgagcatcaaaataaataataatagtaatgcatttaatccattgagtaatataggaacctatctgcccttatttatgtaaataactgggagataatggaaaactcttcctagcagtcgtataccagccaataaaggaagaggaaatattataatttttaaaaacactattttataataatcatagtagtggttggttcaggcaatgaatgtaaaactagtaggtaaaagtttgttgaggaacagaatatgtatatggtctcaaagtagttcccaaaaaataattgattaatttcaaaggtattttaaaaatagtaattttacaatgaagaaaatgacagccaccaccttcactaaattctcgaaattatcatcatcagaaatggggcaaatcgatatcatgtgcctcctgatgtaatgtcctgagaaagacatatcacttttatgatattattgccaaaaatgcataacttcaatctattcataaagaaacatcagacaaatccaaattgagaggcattctacaaactaactagagtgtgttcttcaaaaatgtcaaggtcacaaatgacaaaataaggctgaggaactgccctagattaaagaatactaaagaggcataatgactaaaggcatttcatgatcctgtattggatcatttacctgagaaaaaaattatgaaggttataaaagatattattgggacaattgatgatatttgaatatcaattagattaaataatagcaatatgccagtgttaaatattctgactttcatacaccctgaagtacttaggagtaaatgggcacaatgtctgcaactgattctcaagtggttcagaaaaaatatacacacacaggcacacagcacatatatgcatatgtaatggggatataatgctatgtatatgcatataatggtgtgtatgtagatggatggatggatggatggtagaataataaagcaaaaatgaagcaaaaggtaaataattggtgaatctgggtaaaaaatatgcaggaggggtttggactagtcttgcaatttttccataatttttgataaagctgaagtttatttttttaaaaatcctccaaaagaccccccaaaagattggtgtcaacctccatcatatcagttcagggtgtgtagtcttaggcagactggtttggccacacttcccgatcaactaacagggaacaagtgagatgaggctaacgaggcaccatcctcccctttggatcataggcagaaaggaccagagtggcaggcggccctccagcacatgaggctcatttctcagtggaatggccagggacagccccaagccacaacagactcacccccacatacacactaatacctgtggaggggaagcctggtctcctctggcccctggcactctctatccggaggccctgctatctaagatgtgttcttagtcacagtgctatgaacctcggacttcttgcaggagaacagggagaagaggcctcagaacattagtttgcagctgcagctccctctcctgcatgttttcatgaaggaaaataccgttagacattaaacacccaacgttcaaaatcttagacacgaagttgggagaaaagggaattagtactcatcagattttttgctgaaaaatgagagatagttttagggggcgggcccagtggctcacacatgtaattccagcactttgggaagccaaggcaggtggattgcttgagctcaggggttcagcatcagtctgggcaacatagcaaaacctggcctctacaaaaaattacaaaaaaaaattagctggacatggtggtgtgtgcttgtagtcccagctcctcaggagtctgaggtggaaggatcattgagcctaggaggtcaaggctgcagtgagatataatcaagctatgatcgtgccactgcactccagcctgggtaacagagtgagaccgtgtctcaaaaagagaaagagagagaaagggagagttttaggctaatttaaacagaaaacatttttgaaagattattttattgttacaagatggactgtgattgatgtaaaaataccaacagacacagtaaaaagatataattcctctaaatataactagaagacacaagaatttcacagcatgaccacagctgtacaatacaggacgttagccgtgttcagagtcaagttcctcctgccttcgagtgcccaggaagctgccctcctgtcaacagtacccagccacaggaatgagaatcctactaggtcctctgataagctcattttgtcattattgcctttaattccccaagtggcaatccccatcctaaatgctctagaaggctcgtttccatcctggctaaaatatcctgatgggctgacatgatccaaccaactgcaaactgagaaataacgtctccaacttgccctgcgcacattttctccctcctctcaggagccaatgtgagccagtcccgcacattccagagcaaatagtgtctggactgaatcgatggctacttgtaggcctctccaggatccaaccatcccacgtaggtcttctcgaagtgctgtccactcagagaagatctggctgaggaaacagacacacagaggccacgcagccagaaccacagcccaaatcagcccataggaacaaggtggggagaccaccactactgccccctgctggacactgggcaaactccttcgcggaactcacaagccctgtgtgtcccggcacctgctctcttctctggccccatctcccatcaccatcctcatctgacagtccacactacagccaccgaaacttctctcagttcccagccaattactcagtcattttggagccctctccccttcctatcctctctccgtctatccatccacccttacactaattgaactcagctctcaggccccagttgatgacttcctcccttagggccaggcacggtggcttacacctgtaatcccagcactttgggaggccaaggcaggtggatcacttaagctcaagagttcaagaccagcctgggcaacatggtgaaaccccgtttctatgaaaaatacacaaagtagccagatgtggtggtgcacacctgtagtcccagctactcaggaggctgaggtgggaggatcacttgagcccaggaggtcaaggccacagtaagccatgatcacaccactgcactccagcttgggtaacagagagtgaccctgtctcaaaaaaaagacttcctggccatgcgtggtggcttgtgcctgtaatcccaacactttgggaggccgaggcaggtggatcacttgaggtcaggagtttgagaccaccctggccaacatggtgaaaccccatctcgactaaaaatacaaaaaaaaaaaaaagaagagtcgtccgtgtttgcacgcacctgtaatcccagctacgcaggaggctgaggcaggagaatcacttgaacctaagaagcagaggttgcagtgagccaagattgcgccactgcactccagcctgagtgacagagtgagactccatctcaaaaataaaaaaaaaaaattaaatgtaaaaagactttctcagtgtatgtggtatatccaagacaatagaatatcattccaccttaaaaagaaggaaatcagttgggcacagtgcctcacacctgtaatcccagcaccttgggaggccgaggcacgtggatcacgtgaggttgggagttcaaggccagcctgaccaacatggagaaaccccatctctactaaacatacaaaattagccaggcgtggtggtgcatgcctgtaatcccaactactcaggaggctgaggcaggagaattgcttgaaaccaggaggcggaggtggcggtgagcccagattgcacctttgcactccagcctgggcaacaagagcaaaactccatctcaaaaaaaaaaaaaaaaggaaggaaggaagaaaggaaatcctgtcacgtgccacaacatggatgaaacttgaggatattatgaggatattatgctaagtgaaataacccaagactccccaaatctgggtgaggatcctcagtaatttgtctccatagcgcttaccacagtgaattgcaatggcctgttgcccattgtctatgtcctctgtaaggacagtacagtatcctgttcacggttgaagcctcagtacccagcattatgcctggcacgttatgtgtggtcacaaataatgatagatagacagatagatacataaatagatgggtcagttcatgaggaactcagtatcagactccagagggctttgggatctggagtcatgactgcctgagatccaaaacaagacattttgccagttttacttgtttatgctgaaaagcatcaaaggccttttgaaatagaggtttccttttccatggctaaattaggggttttcttgctttgaaataacaatactgctttttgccacgtggtggagccaatacaacatcaaacgggccccaggaggcgccattttaccgtcatcacctgcctgggcaggaccacccgctatagctcacagtgaagagcatgattgtggtgtaataactttattactacaggcttatttttgttgttcaggaaatcttggtgacctttaaaacttcccaagacacacaaatcattccagttgcacaaaaggatggagcgggttattttctctccaatgagagcctgtcaacctgttggtgcagaaatacatgtgcaggctgtgtttaattgtgagtgggggttgggcgcggtggctaacgcctgtaatcccagcactttgggaagccaaggcgggtggatcacctaaggtcaagagttcgagaccagcatcgccattatggtgaaaccccgtctctactaaaaatacaaaattagccgggcgtgatggcaggcatctgtagtcccaactactcgggaggctgagacaggagaattgcttgaatccaggaggcagaggttgcagtgagctgagatcatgccactgcactccagcctgggtgacagagcgagactccttctcaaaaaacataaaaagtgaaaataaaaataaaaatcgtgagtgggaatagactaggagaagcccccaaattattgtatcttcataaagccaagctcacacttgggaggctgaggcaggataattatggaggccaggagttccagactagcctgggcaatatagcgagaccccatctctacacacacacacacatatacacacacaaattagcttggcatggtggtaaatgcctgtagtcctaactactgaggaggctgaggtgggaggatcacttgagcccaggaaacggaggctgcagtgagctatgatcatgccactgtactctagcctgggtgacagagcaaggtcttgtctcttaaaaataaaaaataaaaagccaagttcttctccatcagggcctgcttctgaagagtgggcaagcaggaccatgggcctacagtcctgctatcagaagaagttctcatggaccctggaacacctgtgatggggctcaggagcctctccaccagagctgcctagagccctactccttccccaccagcctgaccaccacactcacctctttcacccttcacttccaacccctccaattgcccttacaaggtcctatagcagctagtccctccccacctctcggcctcacctctggcctcttctggcccttgacaaagattctttgcttgaccaaactttagtgagcctcctgatcctttcctaggcccatctgtgcacttccttgaaaaattcagttttaacgaggaccctgctaagtcagtttagctagaacccctcaacaccttgctatctgatcatccccaatatctaactgtgctcctcatcctccaccatctaggtgatgtccaatgaccctgtcctgtcttcagcaagactcggttagggggtttagccagaatcccccttattctttacgtttactcttagtaattatctgtcactgacccccactctgcttcttggctatgcattcccacctggccgtgccatattccgagttgagcccaatctctatccaccccgcaaaaccccattgcagtggcccctatgcctattgcaacagtcctgaataaagccttcctaatcatacctcaacaagtgccaccgaataattttttcttttctttgacaccaatctcacattactaccaccaccctcccccaggaccctactcccagaacacactcaaccacccccatccctacatagaatgctcagggcgccaagggggcgtccagggacttcatggtttctagcactttgtagtccaccgaaatgcccccaggagtggcaatcaagtggagaggctgggctgtgtgttgatggccagtctggtcccaagtagaccccatagagatgtcctgggcccttcatcccccctccacaccagcaccagcacccacaacttagggacagaccagtcagccccagagagagagagaaagagagagagggaggagggagcaacaagaaatgcttgcacagctctgttctgcaacattcttatctttctcctagaggaattcaagcattaaaccctgggggaggaatcttctggttctcttgtaaaggagggtacactccaccccaccctaaactcagacatttgaagcaatcctagtggatagtaaatctgggctcctcaaagttctcaattcagggactcctttagcatgacacagggcccagggagcatttccctcaccctaaatcaatgattctgacatcaaagatgccaacaagttttccctgggaacgctttgtgcctatgacccttcgttcaacaaacctttaccaagcacccaccaggtgccaggcactatgccaggatcacaaaggtgaacaagaaagacatggtgtctcattcagaaatggatgggctagcggggaaatggacactaaatatttgtatcaccaggtgatacgcgctctcacagaagttacataaaacgtgccaagatgacagctctaattattcactattgtgcttttcagtttatattcaagtccacattgcagaatacatgttagagagcacttatgtcttgacatgacttgcacttttgatcagtccatagactgcttgagtggaaagaaattcctctaagacactcccttctgagtatgagtcagaaagctgaggtctccccagcatagccgggtcaggggcagggtgacagggcctcccgacacacgcagcatccaagcagactgagcagagcctgcagagcgggcagcaggatgggacctctcccgagagtctggaagccccagctggctccggccctctctagggctgcgggaccctcccttctctggcctcagcttcttagctgccttggttagactggacaggaggagacagctctgccctcctttccacctctgagcttatgctcttgtgagtctcattcttgccatgaagaattgaagaatctttgtgctctgagtcagaagctatgtggccgctttgctaaaatgtgactcaaacacagcctcagccctgaggcccctttcattatattcccttatttggtcccaggcagcatttccatattctctctggggagctggtgggcagagcctttctgtgggccaaggaggagctcaggtgccagacactcagactctgatggctctgtagctaactggcccatcctcagagactaacgcaaaggaacgaatttccaggatgttcgactatgtggagaaaacaaaaaaaaagcaaagaaaaaaatatttttaaagaaagaaagaaggccaggtgcagtggttcacgcctgtaatcccaacactttgggaggccgaggcagacagatcacctgaggtcaggagttcaagaccagcctggccaacatggtgagtcaatactaaaaatacaaaaattagccaggtgtggtggtgcacacctgtaatcccagctactcaggaggtagagacaggagaatcacttgaacccaggaggtggaggttgcagtgagctgagatcgtgtcactgcactccattctgggcaacagactccgtctcaaaaaaaaaaaaaaaaaaagagagggaaggaagggagggagggagggaagaaggaaggaaggaagggagggagggagggagggagggagggaggaaagaaggaaagaaggaaggaaggaaggaaggaaggaaggaaagaaggaggctgggcgccgtggctcacgcctgtaatcccagcactttgggaggccgaggtgggtggatgatttgaggtcaggagttcaagaccagcctggctaacatggtaaaaccctgtctctactaaaaatacaaaaattagctgggccgtaatggtgcacacctgtaatcccagctactagggaggctaaggcaggagaattgcttgagcctggaaggtagaggttgcggtaagctgagatcgcaccactgcactccagcctggttgacagagtgagaccctgtctaaaaaaacaaaaaaaaagaaaaggaaaggaaaagaaagaaaaagatgggaagaaacaaaggaaggaaaataaactacattatatggagaattatttggacaccatcaaacttccactagctgtccctgaaaaccgaaattaatatgctaaaaaattactatctctaagtccatagaaaagtctcctctgtatatacatcaagaagagagcaaaacggggaggataggacataacccacctcccagagagagaagcagcccggccagtggaagtgtcctggtgatattcccccaagcactgctacatttccaagtggcccctgtgactggaaattagaagcataggagttattgacctaggtagattttgaggcaaaaaaatccacaaaggtacaagaagaggaaggagaggaaggagctggtgaaggagattgagaaagaacagccaggaaggtggaagaaaaaccaggagaaggaggggtccatggaagcagagggaagaaagtaagggaatggcaacagtggcagtggcagctgctggacacagagagtaagaactgagaaggtttccctggatttcgaatcaaggaagtcattggggactgtgaccactgcacttcgcagggtgctgacaagtaaggcttagaatgttcattttctcccccatttgctctgcaaaccacattgcccctgtctaggacagaggttcccaaaagcagttttgcattcaaatgccaactccactacccactgactgtataaccctgggtgactcattgagtatcttggtgtctcagttttctcatctgtaaacatggaaacaatgacaagacctatcttatagggctattctgaggattaaatgagtaaatatgtgcaaagcatttgattttttttttttttagatgggggtctctctatgttgtgcaggctggtctcaaacccctgggctcaagtagtcctctcacctctgcctcccattgtgccgtgcctggccatttgcaaagcacctgagatgaggatgtgttctctccaggctgctccagccaatgacaacacagtagaggtactgggctggccatttctgcccaatgcagacttctattggcccagctttgccccagaatccccactgggttggccaaggctttctcagagtggcactgcagtctatggatcctcctaccacaccgcctttccttccccatctcttttcataggtgtaaggcttatgttatgggctgaaggcttttctggactactcctgttctctctcccctccagttacacaggacttacccccaataagtctcttgcatgtctaacttcgttttggcatttgcttcccagaggactcaagttgacacacttggttaaacagaattctctgctacaggacttgtcagagcctttaatattaaaatatacacattataactcatcaagagggaaaagtataaagcatttcccaaattcatttgatcactaaaaaccacacactcacatccacacatgccacagaccctctcatgaacatctcatgaaacatgttttgctgagtaaagtttgtttaacattgaactaggccagccgtggtggctcacacctgtaatccgagcactttgtgaggccagggcaggcagatcacttgaggtcaggagttggagaccagcccggccaacatggtgaaaccccgtctctactaaaaatacaaaaattagcagggcatggtggcgcatgcctgtaatcccagctactcaggaggctaagacacaagaatcacttgaatccagtgggtagaggtcgcggtgagtcgagatcacgccactgcactccagcctgggcaacagagcaagactctatctcaaaacaacaccaaaaaacattgaactgaagacccctaaagttccatccaaccctgagattctttcatatgaatctcaaagtgtgaaacgcctcagtcgcctagggccttattctacagaagggaagtccaaaggctcatttgaattgcattagcaactcgagctatatttgtaagtctcctcccatctgagaatttctttgtcagcaacgttttccctattctacagatggagaaattgaggtctaggaagaccaagacacttgtctcagacccacagttgaggtcttagtttgccactgagtcacggtccgtgtgacacaaggatggaaaaccaaagggagccatagctgagggaagggaaatgagaagggtatctgaaatgtcggccctgcaataaggtgggccacagcaataatgagatgtcactgggctcagccctgtgcctggaaggagggaggtggtcaaggatatcaacaaaaaaatagttgctgatcccaggagaaatacaacactgaattgaggggaaaacacagaaacacatctagactgtcattaaacaaatgtaaccgaggcaggggaaatgtggagccccaacgtgagtaggtgatggagttgggtgactgtcatatgtcacagcaggatgggtagttggctgcccccagccccctcctgccgctccctgttccagcaccctggcccaccagccccttcctggcaactcccatactcccccagttcatccactaaaggattaatagctcactcaggggaggcttcctgcccctcggccaacaccaacttccctttcagcaagccagtgtcggcactacagtggtttggaatactttcaatatcactccctgttaacaagcctatccttggactggctgagaaaagaaatggaacggggcaaagtaacaaaacaaagaggcaagacagagccaaatgtctcctatggttacctaaatcacaatttagacaagcactggtgattcttgcacatagagaaccaccactgaactgtacaggggaaactggtttctgccccagagatgtgttggggaaatgacatactgaccaccatgactacatcctcggaagactgagtggcagagtgctactttggctttcttaccaggtgaacttgagcatatatctgggcagttctagaatttcgatgtgggagggacttagggatgaaaaaaataaaatgtggatggtagatggcatttggggcaggggattggaggcttgtcttgtagctgtttctgcttagtaagctccctgttctggcttagagacatatttattggggagcttgctgatgggaattatggacggggccaactcctctcccagcaccctgtggtgctgacatctgaggtgatcacttcccatggagtggagaaaagcatgctgctctatatttgttccctacaacaggaagcgtgaaaacaggatttgctgccacatgtcaagtactcatgtgcctgtagaagaaaggggccattgctgctgatgataacaatgatagcatctaaggttttatagttccccaaataatttcacatacactgtgatttgatgcttataacaaccgtgtgaactatgcaaagtaggtattatttccccattttaagagatgggagaatggatagttagtattttgaaaattgccagaccccacacttataagactacatgtattattagtaaaattactactaggggaccccagctatgaaaacctctctgggagatagcactggtgggtgaggggcagcagcttcggctcttgcctcctggcaagggtgggatgtaataccctaagctccaacagactggggaaagagaaggggcttagaaaactgtctgggctgctggatttctttccggagtttccctctctccttctactgtcagcacgtcccatcttttgcaacaccagggagaagcctttccatgcctcttcagctcttggaatccctccagaagccccctccctcctgagtggcatctaacaggcctgtccaatactcatgctacagctatgaggaaagaataaaccctgcagctgcttcagaagagaaagaaatctcttttcaaatgaaaccgttttttgcagccctgtggaattcatattctctgtgatctcctttggattcaaatcacggacctgaaagagggaggggaagaaaacaggttcttttcctctgcctgggcctgccgttccctctgccctcctacactgggtatggacagaccccaagggaccatggtctaggtgttggcagccaggctggctctacaacacaacatgtcagctgctctgctgggcctctgtttactcatccattaaatgaggagataagatctcccttgactggctgtgaagattaagtgcacaaatatgtgtaaagtgcacaaatatgtcaaataaaaactgagactgacacgtggaggtgcaaaattaaaaaggaagctttggttagtatctccagaacctggctaggcacggtggctcacatctgtaatctcagcgctttgggaggccgagatgggtggatcacctgaggtcaggagttcaagaccagcctggacaacatggcgaaaccccgtctctattaaaaatacaaaaattagctgggcatggcagtgagcccctgtaatcccagctactcaagaggctgaggcaggagaattgcttgaacccgggaggcggaggttgcagtgagccgagatcacgccactgcactccagcctgggtgacagagtgagactccacctcaaaaaaaaaaaaaaaaaaatccagaacctgcagattgtgcctctgatgcatctcaaacatccagggccagggagaaaataatctaaagaaaaatactactgaaaaagattccattgccatggccctctgagacacacacattcttattctcttattttctctctctctctctcttcttctctctctctctctttctatctctctctctcactccctctctcatttactcacaaggtcagtggcccagacccaggcagttctggataatcccagctgtttctgactcaccaccatcctcagggctggctgactcactccaggaaggttttccaccatgaagtgtttgtctatgtccttgtgttcccgtgaaaaggattgtgtggtcagagaaagagaagactttgctgggtcagtgagatagcatagtgtgagaggctttgggaagtagaaaaagcaacattaactcaggtttaaaaactagactttgtccaaatggttggggaaagtagtcattgtatgtgtttgcaattaaatttgggtggcataggacagcctaaagccctttgtaagcagagctctatgtgcgcagcgatccctagaaggctggcaaggggagtggccagggctgcaccaaagagggtgttgcctagctggggaagaggaacttcaggtgagccaggaggctcttctgctcccaggctgtgcaaagcttctgagttgactggaatgataggtctgatctgcccatttgttgctaaaatgacttaggagggaaatgacctccacctgcctgggaggagtcacttcctccagagatgagctgtccttgaggagatcagtgggaggagaagcctgcgctctgccccactgggcagaaggacaagctttctcccaagagcctcgagcccagaagaagtcggggtggggccaatggaaatcagacagtggaacaaatgaacagcttccaggacagggctgtcgctttcctctgttttcaattgtgatggcttcatgaaacccttgcaccagaaacccatgagctagaaatgaatgcctgtatccccatctctggactcagagtccagagtgccaaccattacacaatggaacctgtgtccccgccttattcaagagtaaagaaagcaaagcctggtggtggacggtggtacctgcccatcaggcagcatgcccagacttgcaaaccagagatggaggatgtcaaataaaaacaaaaccatgggagactgaggcaggagaatcacttgaaccgggaggcggaggttgcaatgagccaagatcgcgccattgcactccagcccgggcaacaagagtgaaactctgtttaaaaaaaaaaaaaaatccagacttttataaagggacacttcaatagaaagaaagactattgcaggccaggcgcagtggctcacacctgtaatcctagcactttgggaggccaaagcaggtggatcacctgaggtcaggagttcaagaccagcctggccaacatgaggaaaccccgtctctactaaaaatacaaaaaaattagctgcacatggcggctggtacctgtaatcccagctactcaggaggctgaggcaggagaatcacttgcacccgggaggcgaaggttgcagtgagtggagattgcaccactgcactccagcctgggcaacaagagtgaaacaagaaagaaagagcgaaagagagagagagagagaaagagagaaggagagaaggagaggaagggaagaagggagggagaaagaaagaaaaaatagagaaaaagagaaggaaggaaggaaaagaaagaaaagagaagagaaaagaaaaaaaaagagagaaagacaattccaattcagagaatctgcaagcagctcaaaatcaaacagaaaaagattcttcttttctagggtaaaggaggagcaagtggagataagcagactcttgggaggggaagctggacaagtgaggggaaatgaccagtgggagctgacaggaaaagggtcttgctgtgttcagtcaattcccaggagaagctgggcagggaagtgacttggcagggacactccactttgtttgtgcttgttcaggcttgggggcaagcagcattcagggatctgtaggaaagagagaagtctgaccaaagttttgtcaagcaaagggggtaagcaatgggtgtcagagacaagaatagatgggggcagaggaataatagtgacaaaaatacttgctttaagaaaaggtaacatcatggctctcatattagtataaaataaacacattttaaagattccatttcggcagggtgcagtggctcacacctgtaatcccagcactttgggaggcagaggtgggcagatcacctgaggtcaggagttcgagaccagcctagccaacgtggagaaaccctgtccctactaaaaatacaaaattagccaggcatggtggcaggcacctgtaatcccaactactcgggaggctgagataggagaatcacttgaacctgggaggtggaggttgtggtgagccgaaattgtgccattgcactccagcctgggccaacaagagtgaaactccatctcaaaaaaaaaaaagagtccatttaacttgattaaacgaggcaatctggtggatgttataactggttcaaaggagaaaccaaagcagcacaatttacatgacgtgaagagtactgaaatggaatatgcaactagacaaaaaactggtctctctacagggggactgtagtgcctctactggacagaatgcatttgcatatctataggaaaaattattttccattgctacagttatctacaacttagattacttacttagagttacttaggtaactatacattgctacagttatatacaacttagagttataaaataactcaaaaacaatgaaaggggctcgtgtggtggctcacacctgtaatcccaacactttgggaagctgaggcaggcggatcacctgaggtcaggaattcgagaccagcctggccaacacggtgaaaccccatctctacaaaaaatatagaaaattagccagatgtggtggtgtgcacctgtaatcccagctacgttggaggctgaggcaggagaatcgctggaacccgggaggcagaagatgcagttagctgagatcgtcaagatcctgtcactgcactccagcctgggtgacagggtgctacatctcaagaaaaacaaaaacaacaacaacaacaacaaaaacaatgaaaggctagacccagatcttctggaaggagatgctctaaaccagggtttctcagcctctacatgactgatgtcttggactagatcatgttttgggtggagaatgtaaaccaaaaataaaattctaagcctccccctcccctacccccgccaaccatctaaatggatggttcctccttagccgaggctcttaaaattttaacctgaaattttcaggccatgaaggaaaggcaaggtcggacatgcttcattatacctctccagcgtgaacatcaaccagagtttaggtctgataagaaacattttactgcctgttcactctgaagcctgctagctaaaagcttcatctatgtgataaaacttttgtctccacaacctcttatcgcaacccaaacattcctttctattgatcctgggcctttagacaaactcaaccaattgtcaaccagaaaatgtttaaatatttacctatatcctggaagccacccccactacccacccaccaccccccgccactttgagttgtcccgcctttctgaaccaaaccaatgtatttcttaaatgtacttgactgatggctcttgcctccctaacatgtataaaaccaagctgcaccccaaccacctcgggcacatgtcctcaggacttcctgtgtcacaggtgtgcatcttcaaccatggcaaaagaaactttctaaattaaatgagacctgtttcagattttctgggttcacaagagctatcttggacattggaagatgttcagcggcatccctggcttctacttagtaaaggccagtagcacctcatctcctagctgtgaccataaaaactatctccagacattcccaaatgtctcctggggtgggtaggggacaaaactgcccccagttgagaaccactgctgtagaccatgcacagttttccagtgaaacccaaattcttccctactactgtagagaagaagaggaggtaatttctgcccatctgcatttcttggcacgcacccatgtctctgtgtgtgagatgagaatcacaccctagctccacaacagagtggtcacagtagccaacacaggcagtattctaaatgctctctccctatagtaacccaactaatcctgccagttaaatatgagtttcaggtaaacaatgaatcatattttcttttagaataagtatgtatgcccatgcaatatttgggccctacatatactttaaaagtatctgttgtttatctgaaattcaaattaaacatttgggagggttgttgttttattggccaaatcattttattttattttatttttgatatggagtttcgctttgtcacccaggctggagcgcagtggcgcgatctcgtctcactgcaacttctccctcctgggttcaagcgtttctcctgtctcagcctcccgagtaactgagatcacaggtgcctgccacgacgtatttttagtagagacggaatttcaccatgttgaccaggctggtctcgaactcctgaccccaggtgatccgcctgcctccggcctcccaaagtgttgggattacaggtgtgaactaccgcacccagccttattggccaaatctgacaaccctatctataatcaaataaacagctgagcagtagtaattgcagcattgtgattgcaataggcctccggtggcttagagtccctgttctgcctgtgactgttgtgccacattggggacgtcatttagcgtctccgaggctcagttttctcatctgtaaaatggggacaatatcagcgccttcttcagagtcgctgggaggattaaatgagatgatgtatgcagagccgttaagacgctgtttggcacaaagttcagggcagctggtttagtttcctcgacttcactacctgaccctctgctaactccccgggtgttttccggacggccacaactatcctagccttcttccctatgggctgcaaaggtggcctcgggttccggtgggagccccaactctggaccgcgattcgcgagcctccccggcgccgggccgcgccatcccgggagctgtccgcagatggcagcaccggccccgggtcgcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgacagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggtaggaagcgcgcggcaggacgcgggcagggcggggtgccgggcagggcggggtgcaggccggcccgcggcgcgctggggcggggggcagcccgggtgctgcagtggggaagccgcaagccaggacctcgcagtcctgcgacacctccgcgccgccagagcccgggactctgttcgagcgtggggggactcccggggccttccctctcttccacccaccacgctttcctgggcgggtcgaggcgaatcactgccctcagatcccactagcaggccactttaggacttcacaaaaactcagggtgatgcaggaggccggggtgaaactttgattggactctagcggggagctggaagggaaggggaatcgggtctgcagggaagggacggtgagaggcagcatctaccagacaaagtccgtctccaactggggttctgtctgttcatggagggggacaggccatagcctggtcattttgtgactaaggatagtctcctgcagccctggggttagatttatttttccaaaggggagccagcgatacctcctcataacattgacactggtaattaacccaggacacggaggtgtctcatggtttccctggcgggaatcacccgggaaacctccgggagccctccagacccccttatcccgtcccccagggtctctgacctcccggccctgggacaacttgtgctccccaatctacttgtccattctgtttcttggggaacccctgaggctcctcctcctttgggacacttccccaggcttcccctaccacgcctaggaaagcctgccctgaagtccaacttctagattcctgttgtgagaacaaggcttccagctctgcttccacacccagcagcctcccaggtcaccttctgttaccctaaatccagcccataggtagcaagggctgcaggaagcgccctagcccagactcagagcacttgggttcttcttcttgctaacctgctggtgaccttgaacgagccatttaacctctctgtgcctccatgtcttcatctaaaagaaaacatgctgcctaaatattttctctcttttgtggcccactaggccctgccgtcatggcctcctttcagtctctcaaagagccggttctttcctgcatgaggccttctcaccagcaaggcacgctgttacctggagtgtggctcactctcattcttcccaacttagtcacatgttcccttcctaaagaggtcttttctgacccttcttagcagccacctccccaccttgtttttctctgtcaccccactcatttccttcatagcattgtcacagtttagaatataatcacatgtatttgttcttcctactgaactgcaggaatcatgtgtatattatttaccagtatatccccagtgcctgacacataaccatgcctttcacagtattcattcattcattcattcattcatttactcactcatttgacaacactgattgagcacctgttacatgccaggcactgtcctgagagctcaggagatacaccagtgaacacaaaagaagtgactgtttgtagaatatggatgcaggattgtaatgtgcctcaaatgaaattatggttgtgaaagtgatacgctgacctgactcagtgcctcacacctgtaatcccagcactatgggaggccaaggtgggaggatcgcttgagccaggagttcaagaccagcctgggcaacacagtaagacttgtctctataaaaaagtaaaaaaaaaaaaaaaaaaagtgaaacacaaaccaagagaatgtgttcactttacatttgcatggcactttacagtttacatagtgagttcacatactcattcacttattctttcattcattcagtaagcatttctcgaatacctactatatgctgggcacaatgcatatggtttctgcttctgaagacttacttctgaggctagtgaggggacagagacaggtcccccaacagttggaaatgcctgtgggacttccagatgaggatgtagaggtctagagatgatctagcgccactgcttagggcaggcgggctgtgcactgcacaactaaggaagagtgtgacttttacgatccccatttgccagttgaagaaattgaggcttgggaaggttaaatacttgctcagagtcaagtggatatagggcatagatccaggactgtgtgtagtctgtgcatgttgagcctaccccttatggctgcgctctctgcctccttcctaccttctcaaatgctgctgaggtcaggcaaggggagcacagttgtttccgctggatttgaacactagcaagtcattggtgagtttagcagagcaatttcaatggaaaggtgagagtagaagccagattgttgtagactccagagtaaaggaactggaaattaagaacatgatcaacttatttaagaaggacccccgggaagagaggagaactgataggtagagtaggacctggactttgagagcctgtgtttttttcatatgagaacaacttgaatgtgtcatatgttgaatcaccaggaagaagggattaaagataaaggcagggagggggcagtgaaacaggatccctgaggaagtgagaatacgggttgtgggcaggggaggggagcaggttagccttgcagcaggaggagctgctcttcctcggagagaggatttcacaacactggcaagagtggctccagtgcctggagcggggattaaagcagtaagtccagtggggtccaagggccatgcaggggtacagtgaggagaaagcaggtgtgatccgggtggcacatcagatccttccagcaaccagtctgttaggagcaagggcagatgttgtgagcccctatgtttcccccaagaaaatcaaacctctgagaggtttctcacttgcttatcttcagctggccgaactcagcctcaaacccatatgtcctgtctccaagttcagtgactgttatcatcaacttcttcaacagtaataataatagatcacatttatggagtgcttgccagggcatgtttacatcattatctcatttaacactcagaacaatcctctgtggtgggtgttttcatcgttcccattttgcaggtgaaaaaactgagacttcaaaaggttaagtgacttcccagggtcctacgacctacataataagtggcagagccaggattcaaacctaggttatcagaataatgcagcaaagcccaaaccctcagccccttttcactgactggtaagacccatatttaattcgatgccctacatgccgtgcacaagtttcagttttctgaagcatcgcttagatgcttaggtgtttagcaccactctgaactctgacttttctagagaggctgctaaaggcattagaaagtttctgaagtataatggaaaaaccctgctggagtaagtgcctggcacactcaggattatcagtgtgattctttataataaacaggctcccagcaccaagcccaatctattccatcagctggataagagctctctggcaggccttgggccaagctggcttcctttgcctcagcagaagagcattctgattctctctgccatccccaaaactgacaggagcagagagaaacaaggcagaggcatgaagggaatgtcctctgcggcagatggtgcttccggaagagctcccacaatctgagctagaatgaacaggggctagatccaagtctcatataggcatacttctgcttgacagagtgggcatgccgagggccgttgggtggaggcaggcgtgtgcaacccaagcagacatgagacgcagctccttcaaggcaaggttgcctgagcccagagaggctcaaatttgtgccccaacttcctctgtggcttttgggtggggctcttcagaatcgaaacacactcagagggctgctgaaagggctaagaagtgttcaaggttggcttccatcaggctgctcatgacaatggcccctgaggttttaacacccttgaacgcttggtactaaatcaattagaggcagggcaggagcagaaagagttggcgcatttgatcagtaagttccaatgccagtgctgtctattatctgtgaactgtgttaactttggacacgtcacttcacctttttgagctgtttcctcgtctgtaaaagggggataatacccattccatgaggtaaagctttgagcacagtctctgatgtaagcaggtacagaatatatagatgctgtaagtttcatggtcccatggaagaattcaaaagggttagatcccgcctgccctcaaaagggtatgtgttaggaaatcagagtaatacctaagtagtaaattgcagagtccagagactctgggactcagacttgaagggatgagtgaggattggactaggacgacttcacggaggaggtgacaatgagcctcaaggtatgatgcaatatggaaaaggagggaagagagtgggaaaggaaggaatttcatgcaagcaaaacaacttgcatgcagtaacagaggagagaggatgctaacccagtggatagggtggctctagagtgtggatggtctccacgtctggcagaaaaggctggacttgctgctgtggcccccgggacacagcacaatgaaggaggctccaggcagtccagagtgtgcagggtccaatgcctgcccttctcagacaggaccacccatccacccatcagggcccagggagcaggggtcagaaggacctcatgacacagagttctgactgtgatgacacactttccccagaggggaggggaaggggagaaggggttagaagaccccactgagaatggaggcatcctagctgcagaagcacctggctggtaggctaacagcactttgtgggtctcgttcccaggagatctgcgctgacccccagtttatcattggaggagccacccgcacagacatctgccaaggagccctgggtaagtgatagattcagagcaagctgggggatcttgtctgtaaggctgtgggtggaagagatgagggacaacctgtggcttctctcccttcccaagcagcttggcaatttctatttgcagagaagctccatggaatttcttggccctagcgggcaatgattctaccctcagccccatgctggggcacacaaatgaggcctcctgtgtcccctgcacagggctagttgctgaggttacagagatgctgccactaggaggaccagggggcttctggatgtcagccaccccttggtatgcacctcctggagccagcattaccagtggttcacgaaatacactctgggcagaggactaggtgggaggactcccccagaccaatgacagcactgagacatcagttctgtgaggttcaggaaccagggaaggtgactcagtgtaaagaaagaggaaactctaatgctcgctgctgaaggaagttatagtaccagggcattctcagtgtttgcaagacaagctcaccatggtatcacagttgtaacgctcatttaagtaaaatgaactggagtagctgaattgtccaaaaccttgctttctggagccgagttcagatttgtttctggagatagtccttgttgaaggtttcaacccacagggttctccacctttagtatgaaaattcccaaagcttctaggaagtcccagcaatggggcctggcgctgttatctaagattctcatagaatctgccctcaatgttcttttactcataataaatgtgggcctataattactagagcagattatttgctctgataaaccaaaaatctattttctgccatcagcctcagctggctggctccccagacaagttcatcagtagcaaaatcagtcaactagagttgtacctcctgtcctcacccacctagcagaggttctgttactcatatactcctaataccagctgataacagctaatatgtatctctaaggcaccgtgattattcccattttatagatgaggatgcagaggtcttcctacagctaaagtggtggctggtacccctgaccccagggtatgtttaattcctgagctagactccctaagacgggacctggaaaattttctagccctgaggaatgtcagagcatcatgtgaatcattaggacagacagactgtgaggaagaacatgagctgggcgggaaagtttgtctgagctcaggctctgcagattcctgagatgccagagcacattcttacctgcagaaaacactcctttcatttcttttcttctcgccccacaaaagacagaagatagaggtccttgagcacccaaggcggatcctccaggaaaatctattcattagagaaaatggaattgatggaaactttgaccaaccccgggggctttagagaatccagaaacagccggcgcagtggctcacatctgtaatcccagcactttgggaggccgaggcaggcagatcacctgaggtcaggagttagagaccagcctggccaacatggtcaaaccctgtctctactaaaaatacaaaaaaattagctggacgtggtggtgggtgcctgtaatcccagctactcagaaggctgaggcaggagaattgcttgaacccaggaggcagaggttgcagtgagtagagatggcaccactgcacttcagccggggtgacagagagagaccccatctcaaaaaaaaagagagagaatccagaaacaaacacagcaactgcctaacatctgcttcagagtttaacaacaccttaagtgccaaagtgtaagcaacaaatacatgatttaagtcctgtgtaaataccactgggccaattggagaggagatagcaaaggttaacattcctgggagaaatttccctcccaggggaattataaaccaggtgaaatgtaaaccttttaaaaatttcttagtagctagtctgtaatttctcaggggtgtgtgcgtgtgtgtgtgtgtgtgtgtgtgtgtgcgcgcgcgcgcgtataatgcagtattggtcattttgttctttcagccttttattttggaggactctagttagatcacaatctgtgaaatgtggtatactgtactctcaccctgattctggcacctggccagcgggtgctgatggggccttgaccttcaccaaatcccaacagcctcacaagcaccaggaacagaggccatggcagtgacactctgtgacatggccagagatatgagcctagactcagctctgttggtagtccgaagactgggcaagtaattacctggaacttccatctggaacctccgtctcttccaaaaacggagaaggaaggagggtaaatggagtgacctcagacaccccctatgagtttgtattcagctattctaaagccattcccgggtttctaaccagctactcctcattccttgtgctagagggttagagcactacaagatcatccttattttctctctttctctctttttttttttttttttttgacagggtctcactctgttccccagggctggagtgcactggcaggatcttggctcactgcagccttggcctcctgggctcgagtgatcctcccacctcagccttctgagtacctgggactacaggcacacgccaccacacctggctaatttttgtatttttttgtatagaccgggtcttgccatgttgcgcaggctggtcttgaacttctgagctcaagtgatccacccacctcggcctcccaaagtgctgggattacaggcgtgagccactgcgcccagccaagatcattcttttattacacacagaaggagtaataacagtacccatcacctgcataacagtatgcaattcatagagcattttttcactacagtatttcatgtactcatcccaaatctaaagtaaatattctcacctcactgtacagataaaaaaaaactgagccacagagacgggagagtaagtgtaaagccacacagctagtaattgccaaaggattgaaccctggtctgattttgaatcctacactcttcctaacccatgctccctccaatttgccatagtgctgtgctgaggaaccattctcagcaaaattcatcttctctacctgcgctttctaccctgagccttactcagttcccccagggaacttgggcaggtgacattcttagacttgtgcactttgcaacgccctgccctgtttactgtgctgcccagcaatgtttaatccacaaacacccacgctccttcccagaaggctcagcttccaagcttcaccaaagtcatttaaaccatgtttacagagctgctctcaccaagagccatctccattgcagaatatagttgtgtaagaattgattcagcagagaaaaatctgcccttctggaggaagggctggagacccagctggagcctccactggctgaccctgcagctaaatatggctctgaaatcgtggggtaataaccacattcttacaggtgcttgccacttgaaatggctcccaaggacccaggaaactccaaggctgagctgctcctacctctgatgctttactttgcactgggtcaccactgagctttccccacagcctcacagctcacggatgaaggcagctaccccagccaggaaggcataggtcaccttgcaggcctctgatttcctggggtagagcccaaggctgccaaggctgttgaaacagcacacccccatttcattgtaacccagcaaatgttccctgggcccctcagaggtgggtcaacctgcctccttctcaagatgtcacatggacccccagagcacccactgggaggtgtttagctacagggtgccccaccccacagcctagctcagcagagagtggggaagggacaagaccaatgggaaaggcaagccagatggggaattttccagtcctgttccttctaccactcattagccacttatttggacccaacccctctgagcctcagtttcttcttctgtgaaatgggaataatgataaggatcccttcccagggctgtggagaaaagtgagatttatacaggcaaacacacttggcacactatagaatcccagacaaattcaagggaccaggattatcattactgattccagttatgtgaaaagtccttttgccaaattgccgaagaaaaagaggatggtggaggaagagaaaaggaggagaagaaaataagttgggttggaaaccagatccttgtccttgaaaatttcataatctaagggtggaaatgccaaaacgaggagagacaaacttgtggcctgtgtttgggtaacacacagattgaaactcagaaggagaaacatatggggagaaaatgaacacaaaggggtcagatgtgcattcctcaattttaaaaattgaatatttaagtgttttaaataatttttatttcttttcctttctttctttttctttctttcttttttttttttttttttttttttgagacagggtcttgctctgttgcccagactaaagtgcagtaacaaaaccatagctcactgcagcctcgacctcctgggctcaagcaatcctcccacctcagccttccaagtagccaggactacaggcacgcaccacctcacctggctaatttttgtgtgtgtctgtgtggagatggggtctcactgtgttgcccaggctggtctcaagttcctgggctcaagcaatccttctgccttatcctcccaagtgctgggattacaggtgcgagtcaccacacctggcaaataatttttaaattataaatttaaaaatgcatttttataataggtacctttaaaaatgttaatagacttttttttaagaacagtgttaggtttatagaaaagctgagatgataatacaggaagttccagatacctcatacccagtttcccctattattaacatgttacatcagtgtggtacacgtgttataatgaatcagcattgatgcagtattattaaagtccatgctttatgcagattctcttagttttcccctaaggttctttctctattccgggatcccatccaggaccccacgtttcatttagttgccaagtctccttcggctcctctgggctgtgacagtctctcaagtctttccttaattttgatgaccttgacagttttggggaatattgatcagagattttgtaagatgcctgtctattggaatttgtggtgcctttttaataagtatgcagtggctcacacctgtaatcccagcactttgggaggctggggcaagaggatcgcttgaacccgagtttgggaccagcttgggcaacatagcaaaactctgtctctacaaaaaaattacctgggcttggtggcacatgcctgtcgtcccagctactcgggaggctgaagcaggaggatcacttgagcccaggaggtagaagctgctgtgagccgtgcactccagcctggttctggagccactgcactccagcctgggcaacagagggaaaacttatctcaaaaagtaaataaataagtacccatgtagttaaaatgtttaaagactagcaaatagatgttggctggtttgatggagaaagtaaatccattctttttcttaaaaatgatctcttcaccaccagtcccagcaccccccttaccagcctcccagggcactgtccatggctacattgtccatgggccatcatgtcccctcggcttctcttctggttgtaaatgctcttgcacttttctcccttgtggctgccgtccacactcccagctgccttccctctgcacttaagatctaagatcttagagacgagatgagacatctcttgccttcgtgcatctaagacagctcatcaacaggtccaggtgaactgctaacactgctgtgttgcttggaggcccctgtcccaccctggctgcctcagctttggccatggtacccacggtctccagctacatcagatgcctgaagaacaaatctctccttagctctccctgccccctctccaggaataggagcagtgggacccccttcaagaatcccccatttcccatatactttcctgcaaagccacagggcgtgcaaagtgggattccagggctccagcctgctccccatgggcctctggatccaggggtgactctttgcctgtttgggtgcctctttagattttccaccagcttcctgtggccaggagccagaccacgcccctatacggccatagttgtcttatcttgtctctgagattagaaggttggaacagattttcctgatgccccactacttctgacattctgtgactttagaatgttaccttcctcgacagccccctgcaccctcacacatctggctttagctggactggtgtttgtgaggaattatatctccaccttgttcagcaccagtccccaagaagaccagccaagggacactcatctggggatttgagaaatgaaggaccgtgggttccatgaggtctgttggggtcctggctagcaacactgtctggatgattgagccccaggaggaggtggcctggccagcaggtgtgcagtgaggccacttctagaccacccctgtcccatagagcttctagtgatgatggaaaccgtgtatatctgcactgctccaaacagcagcactagccctgtgtggctgtggagcacttgaaatatgactcatgcaactgagaaactgaatttgtaattttatttaatttaaatgtaaatagccacatgttccttgtggctgctgcactgcacagcagcagactgttgcgctctggaatccagcctctcagcctttactctccaaagcgggatagtattcacatcagagccaaacaatgcacagacgtcaataaacaggcagggcatggtggcccatgcctgtaatcccaacactttgggaggctgaggtgggagggtcccttcagcccaggagttcaagaccagccaagcaacataatgagaacccatttccacaaaaaaaaatttttttaattagctgggcatggtggtgtgcacctgtagttccagctacttgggaggctgaggtgggaggatcactttgagcccaggaggtcaaggctgcagtgagtcgtgattgcaccatgacattctagcctgggtgatggagtgagaccttgtctcaaaacaaacagctaaacctacatcaataaacatctgtaaatatcagggtagcgaatgaggacttggtgtctggcagttagggactggcctcttattctgccacatactggctctgtcattttgagtggatcactatcctcttcacacctcagtttcctcatccgtgaaatgaagataataatagtgcctactatcaagaccatcctggctaacacggtgaaaacccatctctacaaaactacaatatgaaatacaaacaattagccgggcgtggtggcatgcacttgtagtcccagctactcaggaggctgaggcaggagaatcgcttgaacctgagaggtggaggttgcagtgagccatgatcgcaccactgcactccatcctgggcaatagagcgagacttcatctcaaaaaaaaaaaaattgtgtctacctcagaggactgtaaagatgaaatgaaataatagacatataaagctcagagctccagaggctggtacatagtaaaggtttaatccatgcagattgcacgttctctttggggacagtacagctggaggggagtactgtcaaatgaggtcgcgtcgctgaggtggagacacattgtggcacatcttgaatacccgactgggtcccagctttagcacttgacattggcggccacctaagttttggagaggggtatgacagaggaggtggtgtcccagggggaaggtccggaaactcagaggagtttcctgctgtaattttctttggtcacacaatggtcatggcctcctgatgtttcccacaaagggccagaggcccttcagtgccaaggaacgtggactctctcctatcccagcacatacacgtgcttccagtaccttgtgatctctagccataagtttccactcacccatctgcgaaatgggaacaatgacgatgtttgcgtcctttctttttcttttcctacaatgcagggaactttaagactatgtgacagaaaggtgccactggaacccagggcctcgtgggtttcctccgtctctcgggagaccaggatccgagtgagaaagtttcccacgttcattcttgttgggcccattctcaggatgatgtttctcctgtattttgctaccccagcccaagcaagactagtagttcagctttgtgaatcccctcaggaagtcaggaaaatagatactgtctttgggcttcctccaggagctaagaaaggagagttcctgaagagcaggaatttaagacaggaattggcagccgagggcaaggttccacctcctcctcccttcttctgtggggtctgtgatgagagcagggatggggaggaagagggtgggtttgcctgcgcctggggggagggcagccatcaggaaggagcagccacctctgctggggtactggagataaaaactctgatattgactagtgaccgtgggggcgatggcccaggagggtcagggctgcagggaacagggacacaaaaacgacaaaacatgcaacaggttatgtccttctggtccagggcacggctgagacaggcaagggactagagagaggaagagtgaatgtcaagccccagcaccctcgcctccctcccatcctcccttttagggcctcccttctggcagatagggcagggagaagggaaaggaaaggcctgggacacgtggtttggatcactggctgtggctcacagttctgatgtgtgtgcagtttagggaaggaggctgaagacttcttgttaataagggtggggcatgagtaaaatggaggatctgccccctcccctcccagcccctgatacaaatgaaggatgattgtacatgcatggggaattccactttgggggtatccttttctgggctgctgccagactctgaaatgagtaacaaagggatggcccagggtgactcatcagctaccctctcgcaggcctagcacgctggcggggtgtgcatttcctctagagaagcccctccctgccagtttcagagggatggccctgaattggcttttcagaggttccttctcctcccttccaaagcgaagacccacagctgcctgaaaatgtggctctccgccttcttgggctgcctaggaccttgagagatgtgtctctctgggacagggtgtcaggtctgctggagattgttaaaatgctgttgtctcaggaagggtgaaatttagccaggagcagtcttcagtagcttggtctgtttatcgtgtatctagctgtcagcatgcaaaacaaaagaacaaaaggtctaaagaaatataacgcaaaacaggtacgatttgagatccatcagggtttctcaaccttggcacaactgactggataattgttcattgtagggggctgtcctgtgaattataggatgtttagctgcatccttggcctctacccacacacccccgtgtgccactcaaaaatgtctgcagaccttgccaaatgtcccctgggggcttggcggagttggggggtgcatggaatgcccccagttgagaaccactggcagagcaggagtgaagggggaggtactgtgggggtcactgggcacacagaatgccatttggggagcctggtgcaagggagtggccggatgggaggtaggaatagcagtggtaatcagtaggtgagttgctgaagacaaactaaatattctttccagcattgcttcaatctaatccagccgcaagtatgagtaaatactgtaggaaaggagaaaacattgcatgtacggggtcagggcagcattgctgggatatttgagcctgtgggaggggagcttcaagcttcccactagcattgggaggaacacagcaaaggaggagaagggccctccctgcttcttggagaatggttccactggcaggccattccgtctgctcagcttcctagctcaggtgcctttccaaaccacacatcagcagggagacagtgggaacatctcaggtccagggtaccttgggaactgcagagcagctgggtggcctgacactggcatttctcagtgttggctccattctcttgctggcacccccaggtgggagactctgttagcaggtgtatcttactatccctggctccctggtatgcgttacagttcagactcccaagcacaagctccctgttttgtcacacctgtatctagtgtgtaacaatccaccccaaaacaaatggcttgaaacacaaggcattttgttctctctcatggttctgaaggatgacggggctgagctgggcaactctctcccgctctctcaagtggttgcaatcagatggggatggggacagagtcatctgtaggccccctcaaccacatgtctggtgcccgggctgaagggtggatcagcaggggtccagggatctctgtctcttttgtggtctccccatcacagggacttgaaggtagctgaacatcttacagcagctcatgtcccaagagaaagacctgggagctgtctcatctttacgacctaggcttggaagtcacatagcatcacttctgccatatcctattcattgagatcaatgaaggctcacccaggatcaaagagaagggacatggagcccacttctagatggagagtggcagggttctggaagaacatgtgaaaccagaaacattgttgccaccatttttggaagacaccacgattcctcccctttgaataatggccttcttgtcctttaccagtaataacccaagctgcttggacattagctcttcatggtttgcggggtggggaggatgtgttttctgggacttcccaaggtacacagtagtgaaggacttcacaagctgggctgatgtgccagcttcaggactccactcacccccaagcgttctgagatgcccatggggctcaggagccctgacttgcacaagccagcaactgcctttctgcttccattcagccagctttactgggcatctgttataggaagagcagtgggctgagacttcagcaaaaaagacaaaagcaaaacacaatcccttctctatacaaggttcttccctttctgtgtccaaccagtccctccattctcggtccttaactcatcaccaagccgccattttcttctattcccccattactccaaggcgggcctcagttctcacctggagtctggctcaggatgcctacaggtggccccagaattgtaatggcttgacatgcaatttttcagctttacaatggcatgaaagcaatacacatttagtagaaactgtacttgaagtacccatacaaccattctgtttttcactttcagtacagtattcaataaattacattgagttgttcagcattttattttaaaacaggctttgcctccttagataattttgcccaactgtaggctactgtaagtgttctgagcacaattaaggtaggctaggctaagctatggtgttaggcagtgtcaacaaaatagtcaaattctgtgaaatatttaaagagtttattctgagccaaatatgagtgaccaaagcctgtgacaaagcccaaggaggtcctgagaacctgtgcccaaggtggttggtttacagcttggttttatacattttaggaggacataagttacaggcagacatcaatccagaaaggcgggacaacttgaagtggatggggaaggcacaggggctggagggggctccgagtcacaggtggattcagagatttttctgattggcagttaattgaaagcattaagttactatctaaagacctggaatcaaggccgggtgcggtggctcacacctgtaattccagcactttgggaggccaaggcgggtggatcacctgaggtcaggagttcgagcctggcctggccaacatggtgaaacctcgcctctactaaaaatgcaaaaattaactgggcatggcggtgtatgcctgtagtcccagctactcagaggctgaggcaggagaatcgcttgaacccagaaagtgaaggttgcagtgagccaggattgcaccactgcactccagcctaggagacaagagcaagactcgctcccaaaaaaccaaaaaaaaaaaaaaaaaaaaaaaaacgaaaacctgaaatcagttgaaaagtgtgcctgggttgagataagaagttgttagagaccaaggtttttattatgtagatgaagtctcacagagggccactctcaaaggcaatagatggcaaatgttttctattcagacctttaaaaggtgctactagatgctcagctaatctcttcaggatcagaaaaagacctgaagggaaggtgattctctacatcaagcttgtccaaccctcgtgctgcccaggatggctttgaatgtggcccaacacaaatttgtgaactttctcaaaatattatgagattttttttttttttagctcatcatctatcattagtgtcagtgtattttatgtgtggcccaagacaattcttcttcttccagtgtggcccagggaagccaaaagattggacacccctgctatagaatgtagattttcccacaagagacagctttcagagacatttcaaaatctgtcagaaaaatatattttgggctaaaatactttgatttctttcagggcctgctatctgtcatgtgatgctctactagagtgtggttggaatttggtatcttattgctaggaagagtctgttttgtgagtcttaagatctctgttttcagttaaggctggtcagctgtgcctgaattcctaaaggaggaggataaaatgaggcatgacggacctcccttcccatcgtggcctgaacttgtttttcaggtttaccttggaatccccttgactaagggggcacccattcagttagttaaggggcttagactttgatttttagtttacagtaggctgaggtgtattaaatgcattttcgacttgcaatattttcaacttctgatggatttgttcagatgtaaccccgttgtaagttaaggagcatgtatacttgtatctaatccactttgggcattgctgccagaaaacctgtcctcagggagctatggaagtagtggaggcaaattattaaatggatggattaattccaagttcagatcatgttgggagtcagctgggagtcagtgtgaggatctgggaggggaacagtaaggggttaagagagataccccaaaggatgattaaggagggagagttggaaggaaggtttcccacaaagaggaagcagggagtgattcattctgaaaaaggcaaatattttattatgcttggagggtctggtgcagaaggggaaaggaagagaaggaagtttggcttaaattcccttaggagccagttcagattcctaagctggcccggacatccaacccaatccgcctagccccagccctctccagttcccaatgcccagccccacaatgcccgtcctgctgcctgcctgttctggactctgcacttgaccttccctctccctgaaagtgcccctgctcttcctcacccagctccccgctctaagccttcctcgcccaccccagccctcctacagtcccagtctgccctgttcagactcaaagcctcatgctcaccaccatcatccacaaccagtttccacgtctgtctcctgccggctgtgagctcactgcctcagaaccagcgccagtctcctctagactgagtacaggcctggcacggagccaggaatgcaccaacaaggagcctgagactagattggaggggaaagagacatgtcctccagagttgacttacgcgaggacagaggtgtgcagaggcacggcaagctgggccccaggcgagaagcatggagtgagggatgtggaggcagcggaaggcatctgggagtctgggctgccccgtagcagctctgtgttctgcctgctcttcctccaagatgagctcccttggccagtgtgtgaaacgtgtgtgtgagtgtgtcaccggtaagctgagttctttccctacttggtatcagttgcaaagaaagaacactcagttggaaaaaaaggcaagagggttttattcctgaccaggagaaagagaaggagggggctcttgctctaaagacaccttcaccccgagccatggaaactggggagttgtaaggagataggtgtggggcagggaggtgtgtaagcaggtgtggggtcacggtgtgggggtggagacctctagacgctcaggcccaggtcataaacatgcctctccatacaatgcaagatgtgttaccagaaaggggtcctgatctagaactaagaaagggttcttggatcccgctcaagaaagaattcagggtgagtccatacagtaaagtgaaagcaaatttattatgaaaataaaggaataaaagaaaatctacttcatagagcagccctgagggctgatgattgcccatttttatggttatttcttgattatatgctaaacttcttgattatatgctaaacaaggggtggattattcatgcctcctctttttagatcacgtagggtaacttcctgatgttgccatggcatctgtaaactgtcatggctctggtgggagtgtagcagtgaggacgagcagaggtcactcttgtcaccatcttggttttggtaggttttggccggcttctttactgcaactgttttatcagcaaggtctttatgacctgtatcttgtgccgacttcctatctcatcctgtgacttagaatgccttaactgtctgggaatgcagcccagtaggtctcagcctcattttactcagctcttattcaagatggagttgctctagttcacacgcctctgacacatgttcagaaataatggtgattttcttctacaggtggggacgttagcattataatgacatggtaaagttctgaaggtaacaaggggttgcctgttccagtttctgccagttttgggggtcttatctccctctggtatctgggcagaggtcaagaagctctggcaccatcaggggccagcttgtttctttaagcagctgtgcctacaaataaagggactaaagaaaacaataagaaaacccagttatttcctgggggttgctctggtatccagcgtgttttacttcaccaagcgcaattcttcccagtgcaggcactgggtgtaactgtgacagccagcaccaacctgcccacacacctcctgtcctgcaggactgtcagcagcctctgcactatagtgtgacagagccacaggtagctcaggtgtgcctcagcccagcctctcctgcactccccctcccctggctccccaactctgcctcacttctgtttgtgaaggaaagacagcagtagcggaagggaaagaaggagaaaatgcagagcaaatattatgctttcctcttggaaaacctccaggagctgcaaatattagtaatccagctgcatcccaccccccaggatgggctgggcctgtcacacagccaaccttcaggatgcagacacccaggctggggagcacagctctggaaatttactgacatggccctgaatgaatttatcttttcagtagaaggccctggagtttaaaggagtcattcataaggtctgtctgggagtgccttgtcctcagaggagggtctgggtgggttggagtggaaggaagggctggctacctggtgtgctctccgtgggtccccaagaaaggcagccctgctgggggcagtgaagcccttatccaggtcacgtgagtcttggaaggggaaggctgctgtgcttaacgattcaaaaacacaaatcaaacctcctttcccaaacaaattagaaggtgtggaggaagcttgaattcagagaggatttcccagagacccataggcaaaagtggcttaactgagcccagtgggtgtcccagaatgggccagagagaatgacactaaaaagtctttgaacaaatgagcaaatgaatacaggaatgctcatctgccataggcacaaacgtggtaaacgttccctgagagaactgacagcccaggggtgcagggagagaaacggtcccaactgcagactgggtcccaactgcagactcggtcccaactgcagactcaggaggagggaggctgttaaggggccgtctttccttctgttatgtgaggagaaaagcagggaagggacctcaaggccagcctctcccaggagctgctgttctcagccccgggatccagcgctacagggaagtgcaggggaggctccacagtcccggctggagacccggtcaggcctgggtggccactcttctttgtagtggccaccctcgtgtcaccagcaaatgcttttgtatctacacccttctcagtgctccccctcttttaaaaaatgtactttctttttttaaaaagagttgggtcttgccttgtcacctatgctggagtgcagtgttgctgtcacagctcactgcaaactccacctcctgggctcaacccatcctcccacctcagcctcccaggtagctgggaccacaggcacacaccaggacacctcgcccagtgctcactatttacctttatttcttccttattcggacaccccttgcttccaaagaagagtttcggaaggctcaagacggtgagacagacaccttatgcactgcttcactctcccccgcagctcccctccctcctcactgacccccggccacaaccctctctccttgcccctcaccagccggcacccttggcaaccctggcaccctttcgaggacaagactgccaaatgtggccaaggtctggcacaccatgtaccaatcgaaactccacttcccttgagtttcagtttccacgcctataaaattagcaaatgaaaagagcaaacacttggagacactgttctcaatgctttgcatatttttttcatttaattctcagtgccatgagacagtctattattattaaacctatgttatatatgaggaaactgaggcacagagggagtagtttccccaggtcacagtcaggatttgaactccatggtctggctctagtgtttcccaaccattcggggtgggagtgggagagaaaccagactgctctccctagaaaacagcatgtgtttgcatgtgtgccaaatttgcacaaaacatttggggttccaggtctctaaagcccatccatggaaccccggtttcccttctctcacgtgatcctaacaacctgccgaggatacacctcatcatgatcctcctttcacagctgagaacacaccagcttagagaaattaagaagtgtatccaagctcacacaatcttaagtggccagatcaggaccaaaatccaggtcctctggctgggcgcagtggctcatgcatgtaatcccagctctttgggtggccaaggcgggtggatcacctgaggtcaggagttcaagaccagcttggccaacatggtgaaaccccatctctactaaaaatacaaaaattagctgggcatggtggtgggcgcctgtaatcccagctactcaggaggctgaggcaggagaattgcttgaacccaggaagcagaggttgcagtgagctaagatggagccattgcactccagcctgggcaacagagtgagactctatctaaaaaaaaaaaaaaaaaaatttgtggtcttctaaccacaaatctagtgcccctccccaaccacctctggtccagcctcttagatctatctgggatgtctttccaccatactcctttctggtttgagaaccacctgaaggctcaacgtggctgtggggtgctccgtggagccatttggcctgtgcccagcagcgagggggacagccagcaaaggtacccccgcccctgccagcctgccacctacttgggacgtttcttttctttttttttttgagacggagtctcgatctgttgcccaggctggagtgaagtgacgtaatctcagctcactacaacccccacctcctggattcaagtgattctcctgcctcagcctccctagtagctgggactacaggcgcatgccaccatgctcagctaatttttgtatctttagtagtgacggggtttcactatgttggccaggctggtcttgaactcctgatctcgtgatctgcccaccttggtctcccaaagtgctgagattacagggtgagccaccgcacccagcctactcgggacctttcaccacccaagtgaccagcacccctgcccagagtgccccggttctgtccactaggccagcagggaccccgcctctgggattgtttgctggaggggtcctggacaacgtagaaagggcagcacacagccctgggcaggaagggaggcaggaagagagatcctcaggggctgggctggaggagcaaagccagccaaaggggagtgagagggcagtcaagcgcctagaagccaaggaaccccaggaggatggcatcgggcaggtgcctcctggtgcccagagacaaaaagatgtgtgggaaggtgacagaatcaagcggtaaggtcagtgctttgagggagcaggcaaccaccagcctccagtgacacttgcctttcacagggatcctggaggtccccatttgggaaggtggaaaatctcagttccaacctaaccaaaagatacaggggcaagtttggccttgaaaccctggaccatctgccctgggtgatttcctttcaacagtgctgggtccagactcccagaaccctacctctcccatcttccccagtaagcctgctttcagtccttttcacacgagagcatttaaatccaagggttcccttccccctgggtatttgcagcccatctgatctctaaatgtagagtgagagccacttgtagaaattaagtctaggctggtcacggtggctcacgcctgtaatcccaatacttcgggaggctgagtcaggaggatcacttgagaccaggagtttgagactagcctgggcaacatagcaagacacctctacaaaaaaagttttttaattagctgggcatggtggtatgtgcttgtaatcccagctacaaggtgaggtgggaggatcacttgagcccgggaggtcaaggctgcagtgagctgtgattgcaccactgcactctagcctgggtgacagagtgagaacctgtctcaaaaaaaaataaaaataagaataaagaaattaagaccagatgtaggggagatttgtggaggaagggacaggaggcccctaaaatcccatcctgtaggcagcccctgcttgactaagcataaggctcgtggggcacccaggtgggctttttctggagaggaagcaaggcagaaaacccctccattttccatccccagcctctcaggtctgtgccagttgagtgtcttccaggacagaagcatggctgggtatggaggcagcctggatatagggatggccggtctgtcaagcccgtggtcaggaccttcacggggcagcttaggaacctccaggcagggcctcatctgctgccgttagtaataaacatggccagcaacagccagggccctgctagcgggagatgtcatcggtagccaccttccttctctgcagagacaccgtctgtcccatggatgagcagagtcccctggggacccagctctgacacttgtccttgctcatgtccagggtgctggacagactgaggcaggtgtcaggctcctgggatgagaaaggcagatgagagatgggagtgggagctttacagtgacttaggcagaattgcttagtatttacatatgccttacctcattccacagagaatttaaggcctgaccaaaagagacggggcggggggtgggggggagagaatacaataacaccatgtactgtaaagaaaaacagtcagttctaaaagaaaaacaacccagaaagaagggaatgtgtcaaaaccgggagaggggaaaaaaaaaggcatgcatgctttcaaaagcaccttaggggctacagatgggccctatacttagtgttgacacccaacagccataaaagaatctcactgtgcccccaggggagcacagggaaggtctgattctagattttttctgtgccatttatttatctatatcctcatgcacaagttctatactgttttaattgctgtagctttttatgtgtttaaacatctaatagaggtagacttccttctcttagatttttttctagctatgcttcatatttaatttttaaataaacttatcagaatcagctaagttcaaaaacaatttttaatcttattacctttttttttcttttttgtgagacggggtcttgttctgtcacccaggctggagtacagtggtacaatcatagctcactgcagccttgacctcccaggttcaaagtgattctcctgcctcagcctcccaagttgctgggacgatagaagcatgacaccacacctggctaattttttaaaaataatttttatagagacagggtctcacagtatagtgagatttcagggtggtcttgaaatcctgagggctcaagaaatcctccagccctggcctcccaagagctagaattacaggcatgagccaccgtacctagccctattgctatttttattagcattacattaagtttataggctaacttaagaggacatggcatttttatgataatgagtttttgcagtcaagaacgcaggccagttttttttaaatggggtaaatgattgtccaagcgcctccaggcaggctcacgtgcacactctggagtcagtgaagaaggtgaacagctgacaggagcagcctcccagtcagagaagccctgcacactgttgcaaacagacagcttgcatctggagtcttctgtgatccgaggaggaagcgtggctgagtccttcccagaagagggtctggagctgtgagttggggacaattgtcagattctagcagtgaaagtggttcatgtgcaggtgcaacctgccccgcagtcacgggacacagccacatggagccgagccacgctctcagagaaggagccagggaagaaacaccctaactgcactcctcccttcttctggcccccagcagccataggccctgggcccccggtgagatacccatagagatcagctcccaggcagcaggatggagggtgtagactggacatgaagaggcagctggaatgtatcgggcactcagctccagctcaccacgatccaggcactcaagttcccaagacaatagtttctgctctcagataaatggaataattaaggatcaaaaggttatcaacaggtaaccaagcataaacagattttttttttttttttttttagacagagtctcactctgtgccccaggctggaatgcagtggtgcaatctgggctcactgcaacctccacctcccaggttcaagtgattctcatgcctcagcctctccagtagctgggactacaggcgcgtgccaacatgcctggctaatttttgtatttttagtaaagatggagtttcaccatgttggccaggctagtcttgaactcctgacctcatgtgatctgcccacctcggcctcccaaagtgatgggattacaggtgtgagtcaccatgcctggcccataagcagattttgtacctgagcaggaaggctaagagcttgtaacaactgaacattccccccggagaggaaggcaggagttttgcttgtgccaagtgcactgttcagacagtcctctgaggtacaccaaggtctgagtagccatcccaccctcccctctgccaaaatttttgtgtgactggagagcagagccctcctccaaaaataaaatgagcacaaggaaaatactatttgcagatacataatattaaaaccataggtctttctttttctagtcccatccatatggcaacattccaggagaggcctccgtcactggaaggcaccctcaggggctttcctggagctaaaaacagtttaagccaaaagttatttgtagcatctgagttaaactcttcgtctcacccttctcgagctagctggcttattttatccggaccaggatataacagctctaaacaggctttgccaggaagagacgtcatggacttcaaccagggcacctgaccaggaagaaatcactgcaggatgatctgaaagagttttcataaattattttacgtaaggtagattctgaccttgatggggacagccaaggttctggaccctcagctgggaaagatgggactaagtctacaactgctgaggttgtagaacaggcttcttgttgggaggaaccctcttgtggacatgggccgtcgaggtggagtgagagaacaccgtgccacctggacgctgaaacaccattgagtcacctctgtttgaaatgcttgttccctggtgccgtaaagaaatagcacttgaacataaatttaatttactcagcaaggacatttttatactttctgtgaaagggtacactcaccaggagttttgccacgagagtacaccaaacaaaggagacagggtcatttataacctgacgcgtccaccctactgctgtgtccagtttccattggctggaacaggacctcccattctgtatttgtcccgattggctaacaacttagaactttttaaaagaggcaaaggcagaggagaacaaaggaaggaggaagtaacttgtggaatgctgagaaaggtaaaaacacctttagataaggaagaggaacaggctatgacctaatgcttgcttggaccagtataagcatgccagggaaaatacttaggctaaattgtgggagctaagaacataaagtacattgatttctttatcatggctagcagatatttaagaatgttagcacaggtctttgaataaattttgcttctaagagaagttactatttattcctaattaaatggggaggaaggtctttgaagagaaacctttacacctcttaaggacaaaagtccccaagacctgtccaatttcgaattcaattaggtgaattcgaaattgacaccagcctctttgcagaggagactgttttggttatacatcaaaagcctgtgctttgcagatagacctgacagccactaattagctaggagcgttgggtgatccagtccacctccttaaacctcagtttcctcaactatgaaatagaatgaaaatagtacctaccttggaactgttctgtgacaaggaaatgagataacatgataatgtgcataaggcttttagctcggggcctggcacacctaagcctttgtgtaatcattgtgtagatcttgtcactgagaacgcttacacgagcagatattaaaataaaggaaagaagtcagttgggtaagggagcttcccagcttggttcaaaatattttgctgattggggtgagggaaagagtgaaggaaccagaagcaaaaaaagtaggatttcaaatgcttcccacctttttagaaatcaagacattctttagtggcctctacatctccttcaactccagaatttggaaaactgatgaaaaactttttgaatctttggctgtaaaatgtatatatatatataatgtgtatatatatatatatatatatatatatatttgagagggagtctcattcttgttgcccaggctggaatgcaatggcacaatctcggctcactgcaacctccgcttcctggattcaagcgattctcctgcctcagcctaccgaatagctgggattataggcgcatgccactatgcccagctaatttttgtatttttaatagagacgggatttcaccatgttggccaggctggtctcaaactcctgacctcaggctatctgcccgccttggcctcccaaagtgctgggattaagaggcatgagccaccatgcctggcctcttttatctttttcttttcttttcttttctttttggggggcacagagtctcactctgttgcccaggctggagtgcagtggcgtgatcttggctcactgcagactccatctcctgggtttaagcagttctcctgcctcagcctcccaagtagctgggattgcaggcgtgagctacaaggctaccaactgactgactcaggggatgtgtctccgcttaccatagatctgtcattagcgtatataggcctcaaagagctgtaagcaaccatgtctaagtgctaacaggacaagctaggtcaggaactctcaggatgctaagtcatcgactagaattcaaagaattcagtgagcttcagctggtcctgctggctcacgcctgtaataccagcactttgggagtctgaggcaggcgatcacctgaggtcaggagttaaagatcagcctggccaacatggggaaaccctgtctctactgaaaatacaaaaaattagccaagcatggtggcaggtgcctataatcccatctacttgggaggctgaggcaggagaatcacttgaacccaggaggcagaggttgcagtgagccaagatgacaccattgcactccagcctgggtgacaagagcgagactgtctcaaaaaacaaaacaaaaccaaagaattcagtgaacttcaataacatatatatatgttactgatatatataacaatattacatatattacatattttatatatatgtgtgtatatatatatatatatatatttttttttttttttttgagacagggtcttgctcttctgtcacccaggctgagtgcagtggcatgatcacatctcactgcagcctccacctcctgagctcaaatagtcctcccacctcagcctcccaagtagctgggactacaggtgtctaccaccacacctggcaaatttttgtatttttttgtcgagacaaagttttaccatgttgccgaggccagtgtcgagctcctgtgctcaaacaacccactgaccttggcctcccaaagtgttgggattacaggcgtgagccgctgcgcctagtcttcagtaacatttttaataaacctgtcaattggcgaaaataaatccaacagtgaattaaactcctttgaggctacttcccattattgtcatgggaaattgtaggaaagtgcacattccttaagaatggagtaaacttcctcatcctcttcccaggccccctcccctttgtttgtgttttgtggtgaagatgacccctccctgcaaaccatctgggtgctgttgctggcatcagcttgcttctaactgcatgaaatgattgtggtgcctgctgtgctgagaacctagcactggcaccaaatgggtgccgagtgcttacacacctgctctcattatgcctcacacttatccatgtcatgggggagggttctgaggctcagagagggaccaggctgcctggccagctgcccacctcgttgtgcccatccttgtctaccccttgaagtgacctctgcccctccgcacagaaacccttcgggacagtccagccttctgcctctgactcagggcttttccatctgcactgctccgtacttacttcctgcgactgtactccctgccagagcctcttttcctggctctgaccttcctcctaggaggcgtgcaacgtttgtccccttcccatctagcactacgttttctttctctcactcaaactcccctttatatatttgtttgtttatttatttagagatgagggtctccctctgttgcccaggctggagtgcagtggtgcaatcatggctcactgcagccttgaaatcctgggctcaagggatcctcctgccgcagcctcccaagtattcgtattatagctgggactccaggtgtacgccaccacacccagcccaaactcccattcaaagcctgtgtgctcagaagcctctgcagctgcgctggtttcattctctcactgtggagcatctgctgcgaatcaggtgcaaggctgggctctgagggcacagttcagccaccagagttctgggtctttcagggaatgaaatttcccatctctgcccaaccacaacacagcaaaaacatttctccctttgcatttccctcaaaatactaggttggtgcaaaaatcacaattacttttacaccaacctaatagcccccaaaccctctgacccaaccctcatatgggggactgcctgaaacttcactctgtctattcacaggttgtcttaggctttaagcccctggaggtggagacaagatttttaacatcctcctggttctaagaccctctgataagagctccttgtgctgtgttcacaggtgactgctggctgctggcagccattgcctccctcaccttgaatgaagaaatcctggctcgagtcgtccccctaaaccagagcttccaggaaaactatgcagggatctttcacttccaggtaacttaatggttggctcaggtggttcctcaacaggtccagggggctaggaacagtcttctggcttggctgggttcatcagtccctggtgtttgcagactcccaagaccaatactgttctacaaaggacattgggcgagagcaggaagcttcctggcttacccgtggccaggatgtgagacccggctgggatggccctgggtggtttcttgggacatgtaaaagggaggtagagcaaggtgttcaggaactaattcccaagtttaaaaaaaaaaactgtattatttgatgtttgagacaaaaacgttgaagttctcctccttttatgccggtaaatgagaaataatacttgaaaaagctggctgggcacggtagctcatgcccgtaatctcagcactttgggaggccgaggtgggcagatcatttgaggtcaggagttcgagaccagcctggccaacatgatgaaaccccatctctactaaaagtacaaaaatcagttgggcgtagtagtgcaggcctgtaatcccagctacttgggaggctgaggcaggagaatcactttaacctgggaggcagaggttgggaggccaaggtgggtggatcacttgagcccaggagttcgagaccagctggggcaacatgctgaaactccgtctctactaaaaacacaaaaaaaattagccgggtgtggtggcacgtgcccttaatcccagctactcgggaggctgaggcaagagaatcacttgcatccaggaggcagaggttgcagtgagccgagatcgtgccactgcactccagcctgggcagagcaagacttggtctcaaaaaaaaaaaaaaacagcctaaggtacagggcagaatgctaaagaggcgggtgtggatttgaaaggatggacatgcgcctctgtcttcgcttttttagtgaggacttggcctgcataggagagttaagggagcacctcctcccaggatgcgctcatggaacctatcccaggggatcagggcaaggggagccagaggcagctgaggctcagagtcccagtgctgccaccagctcctcctgcagcccacctctcttgttctgcagttctggcaatacggcgagtgggtggaggtggtggtggatgacaggctgcccaccaaggacggggagctgctctttgtgcattcagccgaagggagcgagttctggagcgccctgctggagaaggcatacgccaagtaagttgccatcctcccctggccccatggccttcccccaatgccctggattccaaaaaattcactcatgcctgtaatctcagcactttgggaggccgaggtgggtggatcatttgaggtcaggagttcgagaccagcctggccaacatgatgaaaccccgtctctactaaaaatataaaaatcagtagaactactccaggactactttgagtgggaagtccttttctatagaaggacttctttggccaaaattaggctctaaatgcaaggagatagtgcatgcagggtgcctggctgcactgtacgctgataaatgatgtctatcaccatctttaaccaaatgcacaggaacaagttatggtactgattgtgctggacttgagaaggagctctacttccttgacaggacacatttgtatcaacttaaaaaagcagaatttttgccaatgggcagaactattcattgcagaggtaggaaacttgcccagaatagatgatgtcactgattagcaatggcttccccatctccgcacagctgcttcccacccaggttgcccacagttgagtttgtccagtgctcagggctgcccactctcagtaagaagccccacaccagcccctctccacaatggccccatgttggctgtgccgcccggctccttccattaaagtgaccccactttagagcagcaagtggatttctgtttcttacagtcccaatccaggaaggaggagtcagctgtgagaacctggagcctgacggatgcttctaagtcccactgctcaatactggggtcagggaagccaccggactccagcatcagcagtcaggagcactaagcccttgccaacaccgtgcctgtttctcagagaaactgcttccattattgaatggttgtccttttttaagctatcaatgccaaacgacccattagtagacctcccctttcttgtcaggatgtagaaggaatcaatacaggaggttcatccagaaaatcactaaggtccttccgactctaaggttctacgagaatctttttttttttttttttttttaatacggagcctcattctgtcacccaggctggagtgagcggcatgatctcagctcactgcaatttccacgttctgagtttcagcaattcttttgcctcagcctcccaagtagctgggactacaggcatgcaccaccatgcccagctaatttttttgtatttttagtagagatggtgttttgccatgttggccaggctggtcttgaactcctgacctcaagtgatccgcccacctcggcctcccagagtgctgggattacaggcatgagctaccgcgcccggcctgagattttctttaaaacacaaaataccagggaaatggtaactgtggacattataccttgccttcctgagcaccccgagctgggaacaaggccaaggagaatgtgagcagggggtccctggagcatcaaatctagacggtactagggggtggctgtttgagagattatagcatcagtagtgtcaagggtagcggcagcgtctaatcccctcttgtaggatcaacggatgctatgaagcgctatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacgtaagtccaggctgccttccctagcctcaccccatctgctcttgctgaagggaggctcccacagtgcccaagggaacccactgctcctgtgtacaacgtaatgcagccctcgtccacgtaggggccaaaggaaaacctccctccaccctctgaaggtccgctgaaaatcaactggcaaaaggaagactaatacaagaaatggcatacaaatgtatgaatgtggacaggggagaatcacaagagatttccctaccacgcattgggatacagagggttatattcccttcctcttaggggaagggagatggggaggtgcggatgattttagggatgtcgtaaatgatttttaggggaattcattgggcttaaagaacataaatggtctgggataaagtctgttgggcctgcagagcagacagtggtttgtgacaagtctgtctagccatgttgacagacttgtctttcttcctgcaatatgagttcagttcataataactcatggaaaggaccagacgtcattgttttcatctttggcaggtccagactttaggcaggtgagggaacttcagagaatagcttcctcctgtgctttgggggagagtggatcgagagacagaaggaaaggggaggtcagagagatcttgaggcttcttcagtttagcatttcaaagtgccatctcttagaggtattggtttctgagcaccccagtgtctaccattattgctcatcacctggaagccaagggttgctaggcaaaagtcaagctgtctggggtgtaatggatggggtgatggtgcctccagcccttctgtcttcagtccacttcccactcttagcctgctctgaatcacccccacccctctgaccacaggttccctgggagcccctgccacctgctgcccctgccaccttcccctccatctgcagtgctgtgcagccttcccctgcactcttgcagagctaataggcccgtgggagacttcggaaggaagaggaggaaagatttcctcataatagccttgctggcaacgctcaccaggggatgggaggtgggcactgtgcccaggagccttggagcaaaggctgtgcccaacctctgagccctgtcccatccaggttctggtctctgcgggggacagagataagaagccctggcttttggagccaaaatctaggtcagactccctaggcaggaattctcaaagtttatcagcagaacacgttgaggcagaagaccctttctgctccagcccttcttcccaggctcaaccttcatcagaatagataggggaaaggagaggctgtgaggcgttcttaaaacagaagcaaattctgactcagaccggaataaacaaccgtcctagtataaaccctacagctgggctgggccagaccacggagcatgggctggtggtggggcgagggtgtgctcagtgtccctgggccactcaaggctgtctgggtatcagccctgcgccatcgaggaccccctccggccctctctcggccgtgcgccctttccctgcgccatcgaggaccccctccagccctctctcggccgtgcgccctttcccgcccttcccagcctgcagaaatccgtggatgcgctattcacacgggaatgcctgtgctcgttccgcgagagggttgcattccgccttttctctggtattctcggcgttcaagcatttgaacggggtaggaaaggttctccaagtgcaagaaagcgcagccctgagcctcccaccccaggcctcggccgctgcgctagtgcgtccggcggtcccgcccggcagtaggacagagggagcgagggagtccgggaggaagggagagcgggtgcggccagtctgacggttgctgtgtttgcagatcaccagcgccgcggactcggaggccatcacgtttcagaagctggtgaaggggcacgcgtactcggtcaccggagccgaggaggtaacggccggcgcggatgtgcaggggtcctgctgtcctgacacgatggccacaggcacagtttgtggtgatgcccaggggcccgcgcggccccacggtggtccagtttacactcgggccccgcactcctgaagttccgcgcgggaggagaagggcgtccctttcgcagctcgggcgccgggtgcgccgcgctgccacctggtggccgcagtggccggcgccaggggccctggttttacttgttttagatgttaccctgttttacagttacaaccttactattttgataagctaaaaataataaaacaatgcatcttcatagtgttttatactctataaggtgctttctcttttgatctcgtaaaagtattcgtgcccatgttcaaatctgactgcctcttaccagctgtgtggcctgggccaattactggaactctctgtcccttagtttcctcatttaaaaaatggaaataatgataatatccattggaaggtcgtggcgattcaatcaagttaatatatgtaaagtgctcagaggtgactcacacatcatatataaggaggtagctgtccttgctgttgtgatcactgttgttattgaaaatattatgggctgacatggtggctcacacctgaaatcccaacactttgggagaccgaggtgggaggatcactcgagcctaggagttcaagaccagcctgggcaacgtagcaagaacctgtctctacaaaaaaaagttagctgggcatggtggcatgccactgtcgtcccagctactcgggaggctgaggtgggaggatcacttgagcccaggaggtcgaggctgtagtgagccatgatcatgccattgcaccccagcctcagcgacaaagtaagaccatgtctcaaaaaaaaaattatcaagcaactcaagttcactgttaattacagaacccagtctagaccgcagatcttctgcatgtccagtgttctttttttaaccttgatttttttaactaccccctcacacacacacgtctttttatttgaaaattttcacgtatacagaaaagttgaaagactaacataataactatccaattgccactcccctagattcaccgattgctaacatttgccatgtctgctttatctatgtgtgcactttttttgagccatatgaaagtaagttgcagacgttatgacacttccctcctcaatacttcagcatttattccctatgaataaggacattctgttacataattcctctactgttgccacacctaagaaaataacattaattcagtagtgtcatctattataaagtctatactaacattttcccagttgcccaaaatgtcctttctggcgacccaccccaaccccatccaggactcaatccagattcactcactgcatgtgcctgttatcaccagtgatctttcaacaaatggtaaagcttctctgagctcctttaccaaaagcgcatcctgtcagttaagctgaagttcagagatgaagcaccaacagccccatcctcgagagccggatcctgggagctttaaatctcattttccaaagctaggcagcagtgagaggtctgggtgccaagccccctctagctcttgtgatcctccctcatacatggactcaacccccaaatcctccccaccgtcctcagccccatacctcctggctcatgcggaagggggttggaggcccaagccttcatagccctgacttgaactcaacctcttactcctcccttttatctaatcctgcaggttgaaagtaacggaagcctacagaaactgatccgcatccgaaatccctggggagaagtggagtggacagggcggtggaatgacaagtgaggagggcgcaggcctcggggccccaggcgggggtgcattgtgctgggaggctctgggaagagggcgagagaagaagacatgtgcattattctgagaaatatagccaggagagcccaggccacgtggacagggacccgtggacaggggcccctcaaagggtcttttaaccaggacactcctccagcagcctgagtgccttcttccaggccccaagctgctcgtgtgaagttcattcctgccactgcctccaggttcaccccttccctagctcaaatccacccttctatggggctttcagggaaaaaaatacaccccaccttcccccaggcacttctattacagggatgtgaactttgtaccaaaggccagagaaacatccctctgttgatttccagggcttactggtaggcatgttgaaccctcaactatttggggtaaacacttgtttgtacatctgctgtggcaacctcagcctacttgctctgcctcaggttggagaggtgggcagtacagaggcctgtgtgtaattccagccaaagctcaggcagtggttagtttaccctgtgcactgcccctgtgtacagggccaggtccttctgctccgtggacagagagacacctgctgaggcttcccaggcctcagccggaggctcctcatcagatcttcagttgtctctaaaagagctgccaggcccatctcaattgggcaactgctctgagctactccatctccctctaatgaactatgttcattttctggactcttccttgccactgtcttccagcacaactcacccgctcactttgctccctggtttgcatctgtatagtgttctatactctttaaagtgctgtaagagtattaaaatgcagctgttagccagatgtgggctactttccccctttctggagcctgagccctcagaggtgagagcagatgtccctcttcctcaactctggggcctttggggagaaatcatcgtacactaacgcctctctctttactttgttttccagctgcccaagctggaacactatagacccagaggagagggaaaggctgaccagacggcatgaagatggagaattctggtaagattagtggaggcttcagggaaagctctgtctgccccaatgttctttactagaaaactgctaattagaaagagtgtcggccaaagtgagtttaccatgtcgaggacacaagcgtgtgggatcctggttttgttattttaagttcactataagagcctgaataaagaaattcttaagccccttcaacggtccatcttgacaatggggtttataagctgagcagcttcagaaaaaggctaagaggaattcctttggtaatgttcagatcccaggaaacaagggaaagatggggcctttctcccccaggttccggagactcatcccagccccttaagaaactggtcccttagtgagcagcaatggacccacatgtctgtgtgtctgcgccactctataaccacctgcacctggacacaacatgctctttatcaaatggggcccatatattgtcacatttgatgggcacggctcccatttttgcaggtgagagttctgagcttcagagaagtttaagtaacctgctcaaagtcacccagctagaaagttgcagcgccaggactggaatctgggccttctgattctgaacctggtgcccatccactcagttctaatgagctgctctgcctggctttgggtggctcctggtctggtgttggtggaaagtcaaggcttaccagtgtgtcttcttatcacctgtgatgattgtctctgcttttgccaggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgagtaagggctgttgcatataagggctgttgcaatgcggggccaccaaaggccaaagctccccttaccccaccctgtgtaccacaccccagcctagcagccccaggaggcagctcctgctcactggaaccctctctgtcttctttctccctgagccttttcttttccctgagccttttctccccgagctctctttctcaatcccttacctcctgccctacccaggacaaacccaagagccactgtttctgtgatgtcctctccaggccctagattccccagcgcccatcatgaccttcagcctgaccttccgccatgctcacggaagcagtgctcaatcccacttcacggccatgagctgctctatgcaccccacacccaggcagccgagcctacaagggaaccttgtcccggcacccagggagccctccacatatcaggccctgtttgttgccccatactcacttcaatcagcaaatgttgactgggcgctgcccagatggggtgaagatttctcctctggtccagcctttgttgagccccttgattcttctgccttcatggcttagtccgtcagcagttgtctgaacatgatgacatctgccaattatggggcacaccttcagtgcttggaactatcctaagtgttttgtacacagggtgaggatccataatctgaaaatgtgaaatctgaaatgctccaaaatccaaaactttttcagccccaacatgataccacaggtggaaaattcgacacttgacctcaggtgacaggtcgcagtcaaaacacagtcaaaactttgtttcatgcacaaaattattttaaatatgctatagaattaccttcagcctatgtgtataaattatatatgaaacagaaatgagttttgtcattagacttgagttccatccctaagatatgttatgtatatacaaatattccaaaatccaaaaaaatccaaaataggaaacacttctggccccaggaatttcagataagggatattcagcctgcataacattctatctaaccttcccaacaaacttctgaggcaggcactttcttatcacctccatctctaagatgaggaaactgaggcttggagaggctagtgacttgctgaaggccacagagcgtgctgggatttgaacccaggccccctgactgaggagtcactgtgtaagtacagtggcagcagatcatggtcacatagtgattctctgtgacagatgaggaagctgagcctctaagtcgcataccagggccacagagcaagtagtcagactgcggctagctggcctacagttctggggctcggactccttcacctcaagtatgcagccaccaagtggcagtcccagaggcgctgggaaggccctctgccccccacaagggacccctcctacccactagatcaggagtcggaaaactccctctaaagggtcagatagtaaataattttggctttgtgggccactcagtctctataacaacaactctattgctataacccaaaggcagccatacttaagcgaatggccgtggctacgttccaataaaacgttatttacaaaaacaggcagcggccttcggagccatagctgccaacccctacacaagatggtgcctgtaatttcacagttagggttttatcccattaggtatggaaaggcaattagcataattccccttaaacatgaatgaatcttagattttttaaataaataggttttggaagtaaagagggcagagacatcaggagcagggcaagggaataggcctgagaggacaagggacgcagaacaagaaagagtctggaattatacacaggatgttcttggcctccgggctcaccgagggggcggcgaccggcaagtgcagggagcagatcccggagtcccccaggccagccgagccccgccccaggctccccatcagagcccagtgaagagaaggtaccatgaggggaagccacagctctaaccaccctgcgttccagagtgacagaccagtccccaagacaagccagcctggagccagagagagaactgcaagagaaagtttctaatttaggttcctgttagattcagacaagtgcaggtcatcctctctccacagctaccgtcacccgtctccagcctaacaaagcctgcagtccacactccaaccctggtgtctcccacctcctagcctctcccaacatcgcctgccgtctctgaccatcttctgccatcctctgccatctcccaccatctcccactgtctcccacagcctcccaccgcctcttgccaactcccaccatctcccgccattttctgacatctcccgctgtctcccaccatcttctgccatactctgccatctcccaccatcccccaccacctcttaccatctcccaccacctcccaccatctccctttatctccatccctctcagaagcctccaagcctgagaccagggccaccccccacccccatgcattcctgctcagggctgggctcctctgcccctttctggctgcagacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggtgcagagcgcaggggctcctgccctcccttccccatgtgttcatctcagcccctgcatggaaagctgaccccagaggcagaactggggatgggatcccagaccgggagcttggccaaggaaaaacaaaactaccagcctggccaggctcaggagtagcccccgtagggaggcccctgcagtggctctgggttgtggggccttctaagcccttcacgggccccccacagccagcctgcagggagttccactctcaaatggcctccacatcccttctcacatcctccaggcctggcattctggtcagcctacccatcttcaaagaacagaatatactgggccacatcaggcaatactgtgagggcaggactgagtccatgggtgcagctgctcagagctcggcaaagtcattggcctggatggtggagagcttggggacaggggaacattggtcatgatgctccccccagggctctgatggctggagcccagatccctacacagactcctgctgtatgcgtgttttcctttcactctgagccacagccagagggcagccgcattgcagtctcctctccgccctcaggctggggctggggcactgagaactcacccaacacgctgggcccctgggctctccccactcccttctgcaaaacaagaaagagctttcgtgggctgcaggtagccatgcgaggagagggatgaaaggaaggctttagggcactgactggggatgcatttcggtttgatgggctggagctggctcctcccggctcccaaagcccatctcttttctctgacccatgtctgctgaggtccttcagcagcctgaaaaatggccctggcagggacctgtttacaccatggaaagtggcaaatagtacaaatcagagcttccaccctctcccaagagccagtttcccagcacacccctgggagaatccagacgaggtgtcaggagaggaggctctgtgctcaccactggcaacgttgccacccatggaacactgacttctacctgctcacccacctgagaaaggcagctgggcaaataccatcagttgtaaaaatgcacataggcctaaacccctccgtctctgaaacaggagctgaggacttcggatctgggacagaatcgatccaaggacaatgcaaatggaattgtgatacacagcttccctcccaccggcttatgggcttggaaatgcagccacgggctttcagagttgggacggaccttggggatcactgggtcctatttttgagacaagaaaactgaggccagagaggagaggggacttgctcaaggaaatgcagaccggaccactggacctggctgacagaggccggcactgctggctcctagccccaggtgtatttcacctcgcctgctgcctcctccaacagggcccgcctggccctctttccctgcgtgggaggccgatatgggctttgccaccttagacaagtctcttcacatctccatgcctgagatttatactctaagttaggaagggaggtgagggcttatcaacataagaggattttcttcagtgttggagaggctttgagttccttggaaaacagttactcggttgaattagttgatattgctaatgctacagagaaaacgggggcagcggaagagaagagcacagtgatgcattttcttacactgcttttccggcatctgaattgcatctcctttattttgcaggttccagaggaggtacgtctggcccatgtcccggggtgctcaggtcaccaaaaaagcgagaggcttagactgctggagctcagggagcgtcgtgaagcccgggcaggggctggtggtcatgaaggatgagtcctggccacccctggggccctgctgaagttgcccaggctctagatcccactggtctaagctctgggcaaggtttctggaaagtccttgtgggacccgctgcctccctgtgacctggcagagcccatacagggtttggttctgggcagaaaatccatgatcctgagactgcaggaggcttttcacaaagttctttgtcactcttaggagaagactgagtcagggaaaaggtgaaccctgcagactgtactagaagacaacgcgggagcacagaggagaccaggacccaattcccaggctgtgtgaccttggacacgttacagctcctctctgcatttcagggttttgttttttttttttttgatttttggtttgtttgtttgttttttgtctcgctctttcacccaggatgaagtgcagtggcatgatctcgactcactgcaacctctacctcctgggttcaagtgattctcctgcttcagcctccccagtagctgggactacaggcacgcaccaggatgccaggccaatttttgtatttttagtagagacggggtttcaccatggtggccaggctggtcttgaactcctgacctcaggtgatccacccccttcagcctcccaaagtgctaggattacaggtgtagccaccgtgcctggctgcatttcagtttatttttcagtaaaactggtcaaccatccacctcactgcactaccgtggaatgacttaaattttgcgagagcatttgggcccacagtcaccgcttgctgaagcagatgggatgcctggtccaaggtcacgattattaaagtagacacacggggcactttgacccacctgtagtacatttctttcacagcaaggcagtgcaaccggtagcacatcgggctcttttagatgctgctccagccttggtccggtggatcatgcttggtttagaagctgggttgtctttctcctgcccccagtcctgtctttgcttttatagtgcatcatacaccacgtagaaccgagccaggttcctgccatgtggacgctgttcctgcctgagagtctcttagaggaaggctgggaacactgtggaaagactgggcatctctgcaggcggagctgaatggatgtgaaacccctgtgggcatgtgcttccgagttcctcagcaggcatttgtgttttttggtagaaagtttgctttttgttttttttttttttaagacaaggtctcattctgtcacccaggctagagtacagtggtgtgatcatagctcactgccgtccttgaactctcagactcacgtgagcctcctacctcagcctcctgagtagctgagactacaggcgcttgccgccacccctggctaatatttttattttttgcagagacaggggtctcactacattgcccaggctggtctcaaactcctggcctcgagcaatcctctcacagcctcccaaagtgctggtattacaggcgtgagccaccacacctaacaaaagtttgctttttatctaaaatgacccaggcattgtcactgtactgctatttttttaaaaaaattttgttgttttgttgttgttgtcgtcgttatatagatgagggcttcctgtgttgcccaggctggtttctgacgcctggcctcgcctccttatacaccaggacagcaggactgagccaccacactacccaactgcttttatctcagtgaatgaaaatgatacttgcctggaggcttcccctcatctacccccatgtttctctatttattcctcagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccagtaggcggtttggtcccttcctctccccacccttccctgtccctccccactggtctgttcctcggcccctagagggctctttcatcctctgaatgtcagttactttttctgtaacacctgcccacctcgaaggactagtgtggggatttgatgg

SEQ ID NO: 176 - DNA, 281110 bp, Homo sapiens
tccttcaattctgagaaaggttctataattctttaatttaaaaaaagtttttttgtttcatctttctcactttttttttttttttttttttttaagacacagtcttgctctgtcacccaggctggagtgcagtggtgcgatctcagctcactgcgcccttcgcctcctgggttcgagtgattctcctgcctcagcctcccaagcagctgggattacaggtgcccaccaccaccatgcccggctaattgttgtatttttagtagagacggagtttcaccatgttggccaggctggtttcaaactcctgacctcaggtgatccacctgctttggcctcccagagtgctgggattacaggcatgagccaccgtgcccagccctattctgatttcatagatgcagtgtcttttatgtctctgagaggttttgtcaagttttcttttgtttactttattatctgtttcttcaagattcctcctcttttctttttgccttaagctttttcatattggaagcttctctcaaatgtctggttattctggttgtccacttatattacgtggaacaataaaaaagttgattaggactctgtgctgtaagtaagtaaattgttgatagtgagagcccattaatcacaggatgatcaagcagcaagcctactgtttatttgggtttctccaaatggctatagctgtcagtcttttttttctggggttatttggcttctctagaaaagaattttctagtctcttgtttggagaatacaagcttgactattggtgttccagaaaatgggtgggaggagacgactttgttttctgttaggttgagccatgtgaaattactaggttttgttttgttttctgttttgttttgagacagagtctcactctgttgcccaggctggagtgccttagcatgatcttggctcactgcaacctctgcctcccaggttcaagcaattctcatgcctcagcctcccaagtagctgggattataggcatgcaccaccacgcctggctaatttttgtatttttagtagagacggggttttgccatgttgaccagtctagtctcgaactcctgacctcaggtgatccacctgccttggcctcccaaagtgctgggattacaggtatgagccaccacacctgggctgaaattactgtttttataggtcaaaaacagttgagggataggcatggtggctcccacctataatcccagcactttcagaggccaaggcaggaagattgcttgagtccaggagttcgacaccagcctgggcaatgtagtgaaaccccatctatatttaaaaaaaaaaaatagatgaatatctttgtttgcagataacatgattgcatatgtagaaaatcccaaagaaccaacaaaaagagctcctagaactaataagtgattatgacaaggtgtagaatacaaagttaatatacaaagtcaattgcttttttatctaccagcagtgaacaactggaatttgaaattaaaacacaatactgctgggtgcagtggctcacacctgtaatcccagcactttgggaggccgaggtgggcagatcacctgatgtcaggggttcaagaccagcctgaccaatatggtgaaaccccatctctactaaaaatacaaaaattagctgggcatggtggcgggtgcctgtaatctcagctactcaggaggctgaggcaggagaatcgcttgaacccaggaggcagaggttgcagtgagccaagatcgcgccattgcactccagcctgggggacagagcaagactccgtctcaaaaaaaaaaacacaatacctttcatattaacactaataaaatgaaatatgtgtagttctaacaaagtttgttgtagaagatctatatgagaagaattatagcactcatgaaagaaatcaaagatctaagtaaactgagagatattccatgtaaatggacagggagactaaatattattgagatgtcagttcttcccaagttcatatatcgattcagtgcagtcccagtcaaaccccagccagttattttgtggatactggcaaactaaagtttatatgaaaaggcaaaagacctagaacagccaacacagtattgaagaagaaaaaagtcagaggactgaaactacccaatttcaagacttactgtaaagctacattaatcaagacagcatgtcattggcaaaagaatagacaaataaatcagtagaattggacagagagcctagaaatcaacccacacagataaagtcaactgatctttggcaaagggacaaagacaattcagtggagaaaagatagccttttcaacaaatggtataggacaactggacatccacatgcaaaaaagttaatctagacacagacctgacaactttcacaaaaataaatggatcatagacctaaatgtaacatgcgaactgaaacttctagaggataacataggagaaaatctaggataacatgagaaaaatttttggtttggcagtgacttcttaggtacaataccaaaacatgatccttgaaaaaaaaaatcagtatgttgaactttgtttaaattataaacttctgctctgtgtaagatgctgttaggagaatgaaaagacatgcagcagagtgggagactttacaaaattcattatctgatgaaggaccagtatccaaaatatacaaagaacttttaaaactcaacaataagaaaatatacaacccagttaataaatgggcaaaatatctgaacagacacctcaccaaggaagatagatagatgacaacaagcatatgaatatatgctcaacatcatgtcgttagggaaattgcgcattaaaacaacaacaagataccctgccatccctattagaatggctgaaatctaaaacactgacaacaccaaattctggcagggatgtggagcagcagaaactttaattcattgctgatggaaatctaaaatggtagaaccattttggaaggtagttggacagttttttacagaactaaagacagtttgacagtttcttacaaaactcttaccatatggtccagcagtcttactccttagtatttacccaaataagtttaaaatgtacatccaataaaaaaaactgcacatgaatatttctagcagcattattcatagttgccaaaacttggaagcagtcaaggcatccataagtaggggaatggataaacagactttggtatatcatgtaatggagtattattcagcaataaaaagaaatgatctatcaagccacaaaaatatatggaggaaccataaatgcatattgctaaatgaaagaagccagtctgaagaggctacactataggattctgactatatgatgttttggaaaaggcaaaactatggaaacagtaaatagatcagtggttgccaagggagacagggagagatgaataggtggagcacagtggatttttaaggcagtgaaactgttctttatgataatccaatggtggatacatgtcattatacctttgtcaaaacccacagaatataaaacataagagtgaaccctaatgtaaaatatggacttcagttaataataatatatgaatattttttcattagttctaacaagtgtactacactaatacaagatattcagagtaggggaaattggaaaggaatgagaggttatatgggaactctgtactttctgctcaattttctgtaaacctaaaatcactaaaaaaaaagtttatttttatttttatttttttttaatttttaattttttgagatggagtttcactcttgttgcccaggctggaatacaatggcacgatctcggctcactgaaacctccgcctccagggttcaagcgattctcatgcctcaacctcccgagtagctgagattacaggcatgtgccaccacgcccagctaattttgcagttttagtagagacagggtttctccatgttggtcaggctggtcttgaactcctgatctcaggggatctgcccgcctcggcctcccaaagtgctgtgattataggcgtgagccactgcgcccagcaggtttttttttttaagttggatattagccatttcatatgattcaacttaaaagtacatacaccttcactgttattaaagtgtaggtgagatgttttcagtctggagctctacccttgattcctgccatgcctagtgtccctgaatctggagactctgacttatttctttagagaacgaaactcctgccttctgctttggtggtgattggtacctgcttgactgcctttggtggggagttcctcataccaactttcaatcagttcctgtgtttgtttgtttgtttgtttttgagacggagttttgctctgtcgcccgggttggagtgcagtggcgcaatcttggctcaatacacgctccgcctcccgggttcacgccattttcctgcctcagcctcctgagtagctgggacgacaggcacccgccaccacgcccggctaatttttttgtatttttagtagagacggggtttcatcgtgttagccaggatggtctcgatctcctgacctcgtgatccgcccgccttggcctcccaaagtgctgggattacaggcgtgagccactgtaagccaccgtgcccggccagttcctctgtttttgactgcctgccttactactgctttctgtggtgcctgataacatccaattcctgaaccttcctgggatttttgttcacgtcagcgtgcttcttgcatttaggtatcccttcacaagtaggcatttaggttttaagctctgctaagtgatttaccacactttatcagttctccattttgtggaattcattgtgttaatctccttttctatttttgtttggaagattcatatattttttattcatttagtattttttggtgggatttctaagtagagaaacatgcctatgttcaatatgtcttgtttaagcagtctgctttcatttttaccaccgaggagttggttttatttctttttttttttttttttttttttttttttgagacagggtctcactttgtcagccaggctggagtacagtggcacaatcaaagctcactgcacccttggcctcccaagctcaagtgatcctcccacctcagcctcctgaatagctgggagctcaggtgatccagcacacccagctaattttttttttttttaattttttgtagaagcagagttcccctatgttgcccaagctggtcttgaactcttgggctcatgtaatcctcctgtctttgccccctaaagtctgggattacaggtgtgagccaccacacccagctgtttttaattattacattaatttatgattatgtgtttcctttaaagctatgggcagctctgtttgggaagatgctactgaaaaaaggatgctttttagatggcaaagagtacttaaaatgtctctagaatcatagttgtaaactaaagtatatattttttagttgttcacagggcttagagctcctgccagagggctgttactctttggtccacctgggaatgggaagacaatgctggtaagggttctcttcaaatttgagttttctgttgagatatttgggataatatgaaaaaaagaaactttatcttgtccttgagtctattatttacgacttgctttttgctattgtacacttttgttttttttgtttgtttgttttgttttgttttgagtgatctgggctcaccgcaacctccgcctcctgggttcaagcgattttcatgcctcagcctcccaagtagctgggattacaggcacacgccaccacacctgtctaggttttttatttttggcagagacaggatttcgccatgttggccaggctggtgtcgaactcctgacctcaagcagtcctcctacctgggcctcctaaagtgatgggattacaggcatgagccactgcacctggctgatacacttttaagtttttcagctacttttcaatgtagaagtagatggaaaaccatgtacgttatcttcagtagtgtgtttttggttggttaaatttgacagtatgattgtcattattttttgtaaattaaatttttacctggaagagcttaccttactatattgagtatctttctaacccctgatttttgcttctactatcataataactttatttaagtaatcagtatgttatagcttttttttttttttaagtattcttttgccagaagtttttatcaggctctggatacctctttcctctgcatagtcctcctggatggaagaaacaaagagggaaagagtaacttttccttagatgtttgtctttctcaaagcagttatctttgtatatctaagaagagaggagaataacactgtctctctttttttttaaatctctctctactcattctctctcaggaggagagtagaaagaagcacagctcttcctataacctgtccttattactgagaaaggaacacattgattgccatgtattggggattgtattataccttacatttttatttttattttttattaatttttttttttagacagtcttactctatcacccaagctggagtgcagtgatgtgatctcggctcactaccatctcttccttctgggttcaagcaattctgccacgtcagcttcctgagtagctgggattacaggcatgcgccaccacgcctgactaatttttgtatttttattagagatgggatttcaccatgttggccaggctggtctcaaactcttggcctcaagtgatgcgcctgcctcggcctccgaaagtgctgggattacaggcatgagccaccacacctggcctcatagcttacatttttagagaatcttttctagtacttaaatcggtaaatatggttatcttttaaatgtaatatattgaactaatttaatatttgctcttgtgatttttaaaggctaaagcagtagctgcagaatcgaatgcaaccttctttaatataagtgctgcaagtttaacttcaaaatacgtgagtgctctgtttccaatattgtcgtattttaagttactgtctaaatgttactgtgttaactgtaaatggtaatatttcatgaaaatatttttctaggagcttatctattgtatctattatttacatatgatgaatatctatcttcagagtagaaagttatgtacatttgtgttgtcaaatactgtattagtttactggggccatgtaataaaataccgtaaactggctggcttaaacatcagcaatttattgtctcacagttgtggaaggtagaagtctaagatcagtcaaaatgttggcagggttgcttcctcctgagggctgtgagggaaaatgtatgttgtgtgcctctctcctggcttctggtggcttgctggcaatcttttgtattccttggcttgtagatgcatccctcctatctctgtctttatctttatgtggcattctccctgtgtctgtcaccatgtccaaatttcccctgtggattaggacccaccctaatgatctcaatttaagtttgtcatcagcaacaattctatgtccaaataatgtcacattcataggtactagggataggacttcaacacgtttttggagaacacagttcaacccattaacaaatactatcactttccacttaagcttcaagtaaagtggattttatctcaaggagccaccagataggaacacagatctgatggcataaactgagtatttctggccttctgattctgatctaaaatatgacagaagattttccctgttttaattttttttttttttttataatagagacacagtctcgctatgttgccaggctactttcaaattcctgggcttaagcaatcctcctgcctcggactctcaaagtgctggaattacaagtgtgagccaccacacctggccagtagattttccctgctttcttttgattgtttataattttgttttctttttccattcaccctctgctgaccctatagtattattcaaagaagtgttcagtctagttttggggtagggcaagcataactacagtgcttaaagagagtaatttgtctggtgtgcagaactagtgtgtaaatataactggtgcattgcaaaactgtgaagtagtttctgtcaaaccttacactgctttgtctttctccctctctccctttctcttggttgccccctccccctcccaatgataccttagtctctgcttgcctttatcaaaacctttatgattggccgggcacagtggcccatgcctataatcctagcattttgggaggctgaggcaggaagatcacctgagcccagaagttggagaccagcctaggcaacatggtgaaaccccatctcttccaaaaataaaaaatagagccaggtgtggtggcatgcacctgtagtcccagctactcaggaagctgaggcgagaggatctcttgagcctgagaggttgaggctgcagtgaactgtgatcatgccactgcactccagcctgagtgacagtgtgagaccctgtctcaaagaaacaaaacaagggggggcatggtggctaactcctgtaatcccagtactttgggagactgaggcaggaggattgcttgaggccaggagttcaataccaccctgggcaacatagtgagacccccatctctacaaaaaataaaaaatttagctggacatgccagcgaatacgtggtcccagcaaatcaggaggctgaggtgggaggatcacttgagtcaaggaggttgaggttgcagtgagccacgatcatgccaatgcattccaacctgggcgtcagagcaagaccacgtctcaaaaacaaaacaaaacaaacttttatggttgaaagtgttttggcaaacatacttaaactgaaatgtgaatctctgatgaaagaacatgttacctgtaaaagtttgaagtgtcagcatttgttgcaccgaaatccagaggtgaggccaggtgtggtggctcacgcctgtaatcccagcactttgggaagccaaggctggcagatcacctgaggtcaggagttcaaaaccagcctggccaacattgcaaaaccccgtctcgactaaaaatacaaaaattagccagacttggtggtgtgcgcctgtaatcccagctattcgggaggctgagacacgagaattgctcgaacccaggaggcagaggttgcagtgagccgagatggcaccactgcactccagcctgggcaactgagtgagactctgtctcaaaaaaaaaaaaaaaaaaaaatccagaggtgaatccagaggtgatcaccacatgatatccagatagcctctttccatgagaggctcaaaggataattttactgtctacagttttgcagcgagagaaacttgattttatcagtacaccaagagcagatctatgtcttcggaacagacatgagatcagaattgtctagctgctatgaacagcatgttctctccctgtacctatagacatgtatgggaaacttatttgtaaggttgtataatgagcagtgagttaaagcaaacttgacatgttgaccatagttgttatggcattggactaaagtagcctccatcactatgatagagatagccttggtgttggacccatagtttttgaagtctgtttgctaagactccctcttccttaggcagttcttcaaatattattatgctttttcctgtcatgggattcctcttcatggagtttcctttctcaggaacactatcttctcctggttaatttgtacttattcttcagataccagttgaaatgttacaaccttccctgaccctccaaactattccccgttattattctcctagcaccacttgcacctcattttcatactcactggagttgcaattcatattcattgataggattattttaattgtatctgatatcactgtcacctccactagaagatggtctccatgcgggcagagactatcaccatgtgttcttcacttcaattttcagtagttggctgtgagtaggtattgaataaatatttgtggagtaatcataatgaggtatagatattattctcatagctctattttattaattagggaattacagaattcagtgatctgctcaggatctcataaccaggaagtgggaaactaggatttgagctccagtgagtgtggcctttcattaaaaatattacagcaaccattctctttttttttttttttttttttgagatggagtcttgctctggagtgcagtggcgtgatctcggctcactgcagcctctgcctcccgggttcaagtgatccccctgccttagcctgctgagtagctgggactacaggcacccgccacgacacttggctaatttttgtattttagtagagacggggtttcaccatgttggccaggatggtctcgatctcctgaccttgtgatccgcccgcatctacctcccaaagtgctggattataggcgtaagccaccacacccggcctacagcaaccattctcttttatccatacttttttcaagagtactgtttcatcttcatgttttcagaaacaacatagcattcatgatcttaacccccaattctgatactgcctgaatatcttgaagtaagtttacttttaagaaagttgaggctaggtgtggtggctcatgcctgtaatcccagcactttgggaggccaaggcaggtggatcacttgagctcaggagttcaagaccaggctgggcaacatggcgaaaccctgtctctaccagaaatacaaaaaattagtcgggcgtggtggcgtgtgcctgtggtcccagccacttgggagactgaagtgggaggatttcttgagcttgggaggtggagtttgctgtgagccgagagatcatgccactgtactccagcctgggtggcagagtgagatcccatctcaaaaaaagaaaagaaaaagaaaattgaaatgtctagtctatcattttgtcagttctatctaatacaattttttccttatgtctaactgaaatctgctttttctaatttttacatacttgatttaacaaaactcaatctttttttttttttatgagacagcctttcaaatatataggaacttaatgttatatctgcttccctccagtccccagaatagttactattttagttgtctttctatggtctcatgccagtttgtcagtatgcctagataagaactgaatattttacctcagatgtgacctgactttgaagacttaaaaaggaagcattgtgccaggcgcagtggctcacacctgtgatcccagcactttgggaggccgaggtgggcaggtcaggagtttgagaccagcctgattaacatggagaaaccccatgtttctctactaaatacaaatctctactaaatactaaatactaaatctctactaaaaatacaaaagatgagctgggcattgtggcacatgcctgtaatcccagctactcgggaggctgaggcaggagaatcacttgagcccaggaggcggaggttgcggtgagccgagattgcgccattccactccagcctgggcaacaaaagtgaaactccatctcaaaaaaaaaaagcagcagcattgtgtaatattatgtagatgttgtgtctcatgatctatcctgagaaagcttttgggaggaactgcatcatagtcatggacaacatttgtgttattaaaatatctagattattttccacaaaaaatcagttacatatgtatcttaacatgttgtattattgtttaaccttgtttattgaataactaacatgtagaaaagtatttatagcataagtatacagctgtatacagctcagtggattaccacaaagcgaatatactttcataatcaccacccaggtcaagaaataaattgttacctgtggccctaaaatccctccaggcactccaccatctttatccactcactcctctccctcaaaaccactagactactaacatcatagacaaagctagcatgcctttgaactttatataaatctaatgatgtaggattttgtgtgtatgtgtatttggcttctttcatcagcattgtatttgtgagatttatccagattgttgcaagtagttgtagttgtgcttttttacacagatttaatttttatatttttcttatatgttcgaacagttaacctgcttatctattattaaaaaaaaaaaaacgaacattcacatagttcttaccagtttacagtgttttttccacaccgtcttcaaaatgtaaagtttggtcttcaatacatcagtatgctgctagatttaaatactagggaaaaaaaaatcagagaagttaataatattaactgtcacctccactagaagatggtctccatgtggacagtaatatttctcttgtattatctgtgctaagtaaaatcttctgtaagtttctttaaatattttaataaatcatagtacttaaaatgttctcaatattctaaagtagttaaaagtaactataaaatagtacctgtttttctgatcacattttacttcctatgtgaaattttacaagtcgttactctatttatttattgatttattttttaagacagggtctgttctgtcgcccaggctggagtacagtggcgtgatcatggctcactgcagcctcagcctcctgggctcaagtgatcctcccaccttagcatcccaagtagctgggactataggcacatgccaccatgcccagctaattttaaaaaattctggggggccgaatgcggtggctcacacctgtaatcccagcactttgggaggccgaggcaggcgaatcacaaggtcaggagttcgagaccagcctggctaacatggtgaaaccctgtctctactaaaaatacaaaaaattagcggggtgtggtggcaggcgcctgtaatcccacttactcaggaggctgaggcaggagagttgcttgaacctgggaggcagagattgcagtgagccgagactccatctcaaaaaaaaaaaatttttttttgtagtgacaaggtgtcactgtgttgccagggctggtctcaaacttctgggctcaagtgatcctcccatttcggcctcccaaagtgctaggatcacaggcatgagtcactgtgcctggtcttcaagttgttattaaagcatgtttacccacattatgcacatggtataatggaaagtattgttgtggaagttaggagatagggattctagcctagctttttatttttttgggacaaggtctcactttttcgccccaggccgaagtgcagttgtgcgatctcggctcactgcaacctccaactctcaggttcaagcaattctcccacgtcagcctcccgagtagctgggattacaggcatgcgccaccacgcccggctaatttttgtagttttagtagacacagggtttcaccatgttggccaggctggtcttgaactcccgacctcaggtgatccacccaccttggcctcccaaagtgctgggattacaggcatgagccaccgcacccggcctctagcgtaacttttacatcctgaactgaccttaagaaagtataactttaggcctgtttcatctgtaaaatgttaatgtcataggagatgatcttttgagatttctttcagctctgataattttgtgtgtgtgtgtgtgtgtgtgtgtgtgtgagatggagtcttgctctgtcgcccgggctggagtgcagtggtaccatctcggctcactgcaagctccacctcctgggttcacgccattctcctgcctcagcctcccgagtagctgggactacaggcgcctgccaccacgcctggctaattttttgtatttttagtagagacgaggtttcaccgtgttagccaggatggtctcgatctcctgacctcgtgatccgcccgcctcagcctcccaaagtgctgggattacaggtctgagccgccgcgcccggcctagaatatttgtttcgattattctaaatctggtgacatttcttttgtttttaagttaaatcttcagtaaaaagaataaatgccacctagaggacagaaaaatttttacagtagattatcacagacctcatgactcattactttggtgtataaaatggcctttgtatggtgtcagcacctgggaatgtctcaaggggtgttcattgaccttctggactatctggaaatattttgatatttattggctgggcgcggtggctcatgcctgtaattccagcacctcgggaggccaagttaggtggatcacttgaggtcaggagtttgagatcagcctggccaactaagttagttgactatttgtgaaatttccctctccaaataggaaagataggattggaaacattattcagaaggaagaagttttaaagaagggcaggcttaaagactatctaatgaatttaccaatatggtaaaaccccatctttactaaaaatacaaaaattagccaggcgtggtggtgggcgcctgtaatcccagctacctgggatgttgagggatgagaatcacttgaacccaggaggcaaaagtcacagtgagccgagattgcaccactgcactccagactgggctatagagcaaaactctgtctcaaaaaaaaaaaggaaaaaaaaaaaagaaattttgatatttatgtgagaatgacttttcacggtgttcttaatagcgcaagttttgtttaggagagcacattccaacttacttgcttctataaatataccgtgtaatctagggcttaaagaatatgtacaatgtctttttctctcccctagtcttccccttttctcactagttatatccttgactgaagagctatttcattctcaagtcttaggaatgcagggtgaagcaaaacagatgaatttttaaagcacttaaccaggctgtatgaaatcacagtctgttgtctaaaattgtaagggacggttagtagtactctcccctttctcaaaccaaatctttggttgttttaaggaagggaaattaaattcctgtgtgctagattttcaacataaaatttaaaaaactggaataatgttgcattttatgtgtataacagtataatgctttgttttaggtgggagaaggagagaaattggtgagggctctttttgctgtggctcgagaacttcaaccttctataatttttataggtaagaacatattttccaactaagttattgactatttgtgaaatttccctctccaaataggaaagatacgattggaaacattattcagaaggaagaagttttaaagaagggcaagcttaaagactatctaatgaatttagtaggacccactatattaataagtagtaaactagattaatctcagatgactcacatagcttggtctttaattaaagtcttatacttgtatttcctctagatgaagttgatagccttttgtgtgaaagaagagaaggggagcacgatgctagtagacgcctaaaaactgaatttctaatagaatttgatggtgtaagtgttgattatgatatttttaatgtggcagcattttagtatattttcctattaaatggccaaggttaaaaatacaaatatctttatatttgttattacttttctaaatgaattgaaaaaagattttttgcttgtaggtacagtctgctggagatgacagagtacttgtaatgggtgcaactaataggccacaagagcttgatgaggctgttctcaggtagggagatttatatggaaatacatgcatttattacagacaatatttactcatgtgtccatcttacatattatttccttactctcagttttaagactaaattcactattttcttccagtactatctctagcctcttgttaccaactacataaggattttgaggtcaacagcttgatatcaggagaattagtctagtaaaggtttagttacggttttaggcaaattggtcagttcttctgggttgcattaaattatctttaaacttgaaaattgattcttaccgtcttttattgggcttcatgagaaaataatcaaatcagggttcatggaaaatgtgttttctgttcttgtgtgtttgagcagtttattcccttcatactggaaggacggtttgggtcagcataaaattcttgggcatcctttcccaaggaatttacaatattgctccattgtttctagattggctgtagtagtgtaaaagtctgaatccaaattgattttttcaaatttgtaaaataacttgatttttttctctctttactggatgggttacgtgggtatattgcacccaggtagtgagcatagggtgcagtaggtagtttttcaacccacacctcactgctttcttcccccatgtagtagtccgcagtgtgtattgttcccatgtttatgtccatgtgtactcaatttttagctccccacttatgagaacatgagctatttggtttactgttcccacattaattggcgtagtattaaggcctccacctccatccatgttgctgcaaaggacattatttcattcttttttatggctgcgtagtacatagtattccatggtgtgtacgtaccacattttctttatccagtccaccattgatggacacttagattgattctatgtctgctgtcatgaatagtacagcaataaacatgaaatgcatgtctttttggtataatgatctattttcctttgggtatatacccagtaatgggatttcagggtcaaaggtagatttgttttatgttttttgagaaatcttcaaactgctttctacaatgactgaactttacattcctaccagcagtacatacgctccacaacctcaccaacatctgttatttttttactttttcccgccaatctgtagacaatatgggattttttttgccattttattaatagccattctgactggtgtgagatatctcattgtgattttgatttgcatttttctgatggttagtgatgatgagcattttttcatgtttgttgtcccctcgtatgtcttttgagaagtgtctattcatttcctttttacccattttttaatagggttgtgtgtttttagcttgttcaattgtttgaattccttatagattctggatatcagaccattgttagatgcagttctgtagattgtctgtttactctgttgatggttctttttgctgtgcagaagctctttagtttaattaggtcccacttgtcaatttttatttttgttgcaattgtgtttggggacttagccaaaatttctttctgaggctgatgtcaagaagtgtatttcctagttttcttctagcatttttatactttgagatcttacatttaaatctttaatccaccttgagttaatttttgtatatggtgaaaagtaagggtccagtttcatttttctacatatggctagccagtaatccccatgccatttattgaatagggagtccttttcctcattgcttgtttttgtcagtcttatcaaagatcagatggttataggtgtgtggctttatttctcaattttctgtcctgttcctttggtttgtgtgtctgtttttataccagaattatgctgtttgggctgctgtgtagttcggtttaaagtcaggtaacgtgatacttacagctttgttctttttgcttaggattgctttgtctatttggactctttttttgcttccatatgaattttagaatatttttttctaattttgtgaaaaacaacattgatagtttgatagaaataccattgaatctgtaaattgctttgggcagtatagtcattttacgaccagataaatcaggcaagagaaggaaacaaaaggcatccaaataggaaaagaagtcatcatactctcactcttcactggcaatatgattctatactttgaaaaccctaaaaattccgtcaaaaggctactagaactgataaatgattttaccccaagattcaggatacaaaatcagtgtacaaaaaattagtaccatttctatacgctaataatgtccaggctaagagtcaaatcaagaacacagtcccatttacaatagccacaaagaaaatgaaataatggctgggcacagtggctcatgcctgtaatcccagcactttgggaggctgaggcaggtggatcacctgaggtcaggagttcgagaccagcctgaccaacatggtgaaaccccgtctctactaaaaatacaaaaaattagccaggcgtggtggtgggcgcctgtaatcccatctgctcgggaggctgaggcaggagaattgcttgaacccaggaggcataggttgcagtgagccgagatcgtgccactgcactgcagcctgggtgtgaaagagcaagaatccgtttccaaaattaaaaaaaaaaaaagaaaaaaaaaaagacaatggagtacctaggaatacggctgatgaaggaggtgaaagaatctgtatgaggagaagtgtaaagcactgctaaaataaatcagaggtgacacaaataaatggaaaaacactccatgctcatggattggaagaatcaatatcgttaaaatgggaaatttatcttaatttttttccctagttcatttttctgttttcttttgcacataaattatgtgttatgttgcgtccttttgttttccctatctgtaattttcttcttcatccttttaaactcttaggtctttttgttttgttctgttttcccaagcctgttgcctttatttcttactgggttagtatctaatctcctttctgctatatcttttgtaactcttctttccttggtggttttttattcattactttcctgacatctgttattctacttttcatcttctgttttatttctttgagcatctgtatgttatttccataagctcttacatttcactgggctcttgtttcatagaaaacaattttttggcaaggacagaccacttgaggccaggagtttgagaccagcctggccaacatagtacaaccctgtctctgctaaaaatacaaaaaattagctgggtgtggtcacacacacctgtaatcccagctactcaggaggctgataatcgcttgaacccaggaggcagaggttgcagtgagccaagacggcggcactgtactctagcctgggggacagagcaaggctctgtctcaaaaaaaaaaagaaaaaattttttggtcaggcgtcatggtgggtcacacctgtaatcccagcactttgggaggccagatcacttgaggccgggaattccagaccagcctcgccaacgtggcaaaaccccatatctataaaaaaaacttaaggataaaaaaaattaaatttttaaaaaattaaattattttatttcgtggaaagatacttggtcataattttagtttgctctatggcaaaatcttctcatgcatgttcttcattttatctagtttatgtttattgtgttttgtttgctcttttttgggggcaggttttgttgttgttgtttttttttttttttttttaaatgagccctgtcctggtttttccttttttgcttattatttttctttgaataaaaggagttttcttggaaaacctagttttggaaggatattgtaggggaagggataggtatcttgagtagtccatgtatacactaaactagcatgcagcctccctcacttacagtgaagccctacctaataatgaagtatatgtgtatgtaaataagagatagggttgatttattcttctactaaaaaatattggtcactgcaagacattgtcttcccgccagactgttagatgccttcttataaagataattcgtcttagagtttctttgttcattctcaccttccttgccattcctatgctatcaattagggtttatatggtctgcagagccaggcttcatatgcttgtttaaatgtggagggactggccttattaccctttagggtgtgctatctctttttgggaggaaaactgtactctgacagtcatgtccatgatctttagcggcagatcctttgtgtgtcttcctttgtcagtgtaattttcactgccctaggcagttcacctttatgtattttagttccataaatgttacctagtttgttgatgaagtgtatgtttctgtttctattatccttgctgattttagtttttttcagattcaagaagacagatctacttatatcagatattttgtttgttttaaagcattactgctattaaaaacatatacatacataaatgattaattctaacaataccgaattaaggattttaaacattaactagagttttaaaagagtaacaaaaatatttttacattgataactaccaaaatgcattccagtgccttgaatattatattttaaaagcttttcctgtcatttgctgtttcagctttaaattcaaaattatatttctaaaagtgctggatttttttttttaggcgtttcatcaaacgggtatatgtgtctttaccaaatgaggaggtatgtatctgtgtttgaattttttttgttttagagcagaaacaagaactaccatcttgacaatattaagtcttccaatccatggtacagctactttggaaaacagtttagtggtttcttaaaaagatgtacataagcttactgtcagagccagcaatttcactcctaagaatttaccccagagaaacaaaaatgtatgtccacacaaagacttgtacaagaatttttatagcagcaatattaataatagccagaactacaaatgatctaaaatgtttattttggtgaataaacaaatgtggtatattcatttaatggatactgttatccattatacatgctgcatactcacttcatatattaagttttatgaatgaaactccaaaacattataagtgaaagaagcaagatgatatatgtcgcatatcataggattctgtttatatgcagaaaacgcaaatttattttttatttatttatttttttgagatggagtcttgctctgtcgctcaggctggagtgcagtggcgtgatctcggctcactgcaaccttcacctcctgggttcaagtgattctcctgcctcagcctcctgagtagctgggactgcaggcatgtgccaccaggcctggctaattttttgtgtttttagtagagacgggtttcactgtgttagccaggatggtgtgatccgccctcctcagcctcccaaagtgctgggattacaggcatgagtcaccgtgcccggccagaaatcgaaaatttctagaaacgtaaagcagatcagtgggttgtcagggtgagagttgggaatgaggattaactgcaaacaggtatgagtgaactaaaaagtgttctaaaactggattgtggtgatgattgcacatctataaatgtattaaaactcattgaattatatacttacaatgggtgaaattcatagtagatgaattcatacctctataaaactggttttttgcagcaaaatatttattgctatgtttttattcaagtgtggtgaattattgctatgtttttatccaggtgtggtgtctcacgcctataatcccaacactttgggaggctgaggtgggaggatcgcttgagccaggaattcaagaccagcctgggcaacatagggagaccctgtctctacaaaaacttttttagaaattaaccaggcatggtggcacgtgcctttggtcccagttactcgggaggctgagatgggaggattgcttgaacccaggatatcgaggctatagtgagctatgattgtgccctgcactccagcctgggtaacagcacaagaccctgtctcaatataaaaaaagaaaagaatcattaattctgaaattagactgaatgatcattttttaatatttttcagacaagactacttttgcttaaaaatctgttatgtaaacaaggaagtccattgacccaaaaagaactagcacaacttgctaggtgagtaatttggatttggtttatcttacagcttttatttattttttgtaaataattctttttttagttatttaaagtaatcttaagtatgaaatgagtaattcattgatcagaagactttctctcatcctctacctcctttgcctttttcttacctcttgttcttatatatatatgtggaatctaaatttcactggctatgtcctttgcaagacgtgatctaatgatgatagtatattctttttataaatttattaaaacctgtaagtggtattaaagtaatttaaacatttacaccttaggcaacatggtaaaaccccatctctacaaaaaataaaatgagtcaggaatggtggcacatacctgtagtcccagctacttgggaggttgatgtgggaggatcgcttcagcccgggaggtggaggttgagcaacagagtgagaccctgtctcaaaaaaaattttaaacatttcatattgcacactaacacagatatttttatataaacttgttcttggcatatgctgaatacttttcagctcttttaataattttaattatttgataattttaataattttaatttcagctatttgaataatcttaaactttatgaacagtgtgaagtagaaactgagtataggagatgcgctcatgaattttattccctgaaaaatgtcataaagtaatataaagtattcaatgagtatgtgagtattgaataattttaacaagaactctgagttcccagatacctatgacaaaagaacaaattacttggaagtctcttctactccagacctttctgtctatccccttatttaaaaaaatgtacattgattgtcccttatcccatcaagagagtgttctttgccaagataaacgctaattagagaagtaattgtgtttatgtgtcagttggccaccagtagtttgtagatgttacctttccaggtgacatgtttacaatttaatgaagcctctggagatagtatgccttaatctaaaggaatggttctaatgattaaaatttgaggcattactacatttgttttcagcaaatgggcctttctattcccttaaaatcaaaccctcataactatgggtttgctgacaaagggaaactagtttttactcttattatatggagattttaaatctgcagagatgaaaataatttgctgtttcagctgggtgcggtggctcatgcctgtaatctcactactttgggaggctgtggcgggtggatcacctgaggtcaggagttcgagaccagcctgaccaacatggcgaaacgccatctatactaaatacaaaaaaaaaattagccaggtgcggtggcgcatgcctataatcccagctacctgagaggctgaggtaggagaatcgctccaggaggtggagatcacagtgagctgagatcatgccattgcactccagcctgggcaacaagagcaaaactccatctcaaaaaaaagcgggaggggaaataatttgctgtttcttccttcccttcctcagaatgactgatggatactcaggaagtgacctaacagctttggcaaaagatgcagcactgggtcctatccgaggtaggtatacaagagcttaaaacatttagaactatttattataccaccttagaagtttaagaagtccaaaaaaatctaccaagagattttttttttcttttggagacagggtctcactctgttgcccaggctgtagtgcagtggcacaatcatagttcactgcagcctcgaaccccccaggctcaggtgattctcccacccagccttcccagtagctgggactacaggcatgcaccatcatgcccagataattattttattttatttcttgtagagacagggtttcaccatgttgcccaagctggtcttgaactcccgggctcaagtgagcagcctgccttggcctcccaaagtgctgggattacaggcatgagccaccatgcccagccttaaaaccattcttagctcacagatcatacaaaaacagtctatgagccagtagactgtgacccctgttctaggcaagaggtttcatttcttgatagtaagtaagcagcagaaaactcaaaaagaaaactttaaacaaaaaagaataatgtaaggaaaatgttcttatctgttttctggctcttttcagtattctgacatcatttgaaattaatgtgtctaaaggaaattctataagagaagttttcacttttttaattatatcttttgagggattgcagcaaaatatttattgctatgtttttattcaggttacttggttgattctgaaataccacgaccaattctttttaggttaggttaggataaactcacacagatattttcagctacatttccacagccagcatcggtagtggatggttgatgctctcaggtatgcactcagattattagctatgatgataaagtaatcataatagctccatccctttctctcattcaagaaagtacaattgaatgtagttgtacgagaaagatgttatcatagtgtctactgtaatttgcattaaaagcctacattatacaaacctttttgttttactagttaaaaattaccagtaacacctcccgtagtgaaatagggtgctgattaagaactgctactttgcaaaataaaaaatgtaatcttgagagtatattttgaaactctggatgaacaaattttcttgctgctggagcttaaatcttgttcagttagtggatttagaaacagtagctaatgcataaatgagttgtattttcttagaacgttttggctattctaaggtagacaaaatttgggtttaaaaaaagattcgcatccattaaagtacagaaaatggccgggtgcagtggctcacacctataatcccagcactttgggaggccaaggtgggaggatcgtgtgggcctaatagtttgagactagactgggcaacatagggagatcctgtctctacaaaaaaatataataaattaaccaggcccgttggcatgagcctgtaatcccagctactcgggagtctgaagtaggaggatcacttgagcctggaaggtgcaggcagcagtgagccatggtcatgccactcactgcactccagcctgggtgggtgacatagtgaggtgctgtcttaaaaagtaaataaataggccaggcacggtggctcacgcctgtaatcccagcactttgggaggccaagatgggtggatcatgaggtcaggagttcgagaccagcttggccaatatggtgaaaccgcatctctactgaaaatacaaaaattagccaggcgtggttgtgcgcacctgtaatcccagctactcaggaggctgaggcaggagtatcgcttgaacctgggaggtgaggttgcagtaagccgagcactgcagcctgggcaacagagcaagactctgtctcaaaaaaaaaaaaaaaaaaaaaaaaaaaaagtaaatacataaagtgcagagtaaaaacaaaaaaagactaatgcattttgtaaagaacaagttgcattcttttaagttccctttcaaatttgtgaactattgtttttgggcagtatgcaagaaattgaacactttccagttattccaaagaaggaatattctcttctcagcatttataaattgtatttgctctcaaagttaacatgtgtctcttttttttaatataatgatttgtactgaatagatacatgtagatcattgtacttggttttgcccttcaacaatttcaactgcaaaatgtatgtatttttaagtgcctgacttttatgttttacagaactaaaaccagaacaggtgaagaatatgtctgccagtgaggtatagtattttacaatgatattttctttgtcttctatattgtaagacatatataagacatacatatatgaatgtgtgtgtgtgtggtttttttttttttttttttttttttgagacagtctggcatgatatcggctcactgcaacctccacctcctggattcaagctattctcctgcctcagcctcccaagtagctacaggcatgtaccaccaagcccagctaatttttgtatttttagtagagagggcatttcaccatgttggccagtctggcctcagactcctgacctcaagtgatccacccaactcggcctcccaaagtgctgggattacaggcttgagccgctgcatctggctgttttgtttgtttgtttgtttgtttgtttgtttgagacggagtctcactctgtcgcccagactggagtgcagtggtgcgatctcagctcactgcaagctctgcctcccgggttcacgccattctcctgcctcagcctccctagtagctgggactacaggcgcccaccaccacgcctggctaattttttgtacttttagtagagacggggtttcaccgtgttagccaggatggtctctgtctcctgatctcgtgatctgcctgcctcagcctcccaaagtgctgggattacaggcgtgagccactgcgcccggcctttttttttttttttttttgagacacagggtcttgctctgttctcaggctggagtgcagtggtgcaatcgtggctgactgtagccttgacctcttggtctcaagcagtcctcttgtctcaaactttttagtagctgggactacaggcaagtgccacaacgccccactaattttttaattttctgtagagatggtgtctctccctgttgcccagggtggtctcagactcttggcctcaagtaatcctcctgcctcagtctctcagagtgcttgggactaattttttttaatggatttttctagttgattagaagctagaaaaaattaactttgcttcatttcaaaatatggaaacctatgaaatagtcaaaattttttttggtaatagacaaaacatatatacataaagtcattttctatcaaatcatattacataaataccaaacagaagaaaattacaggccgggtgcggtggctcacgcctgtaatcccagcactttgggaggccgaggtgggcagatcacttgaggtcaggagttcaagaccagcctggccaacatggtgaaaccctgtctctatcaaaaatacaaaaaaattaggccgggggcggtggctcacacctgtaatcccagcactttgggaggccgaggcgggcggatcacgaggtcaggagatcgagaccatgctggctaacatggtgaaaccctgtctccactaaaaaatacaaaaaaattaccggggcgtggtggcgggcacctgtagtcccagctacttgggaggctgaggcaggagaatggcgtgaacctgggaagtggagcttgcagtgagccgagatcgtgccactgcactccagcctgggcgacagagcaagactccatctcaaaaaaaaaaaaaaatagctgggcatggtggcacgtgcctgtggtcctggctacttgggaagctgaggcaggagaatcacttgaacttgggaggcagaggttgcagtgagccaagattgccccattgcactctagcctgggcgacagagtgagacccagtctcaaaaaaaaaaaaattacatgaaacttgtgggggtttatacaataaaaataacctataactatacgttaatcctttaataatgttctattttgtttttcaataacctttatttttttaattaatttcttttttttgagaaggactctggctctgtcacccaggctgcagtgcagtggcaccatcttggctcactgcagcctccacctcccaggttcaagcgattctcctgcctcagcctcctgcgtagctgagattacaggcatgggccaccacgcccagctaattttttttttttttgtatttttagtagagatggggtttcactatgttggccaggtgggtctcgaactcctgacctcaggcgatcgccagcctcggcctccctaagtgcaaggattacaggcgtgagccaccatgcctggccaatttattaccgtttcttaatatggaagacctccttatgagatgctgaagcatttcatttgaaaaaagttgcatgtaaaatataaaattgggtatgcagaatggtcataactctgtgagcaaaattttgaaatcaggcttgaattacagtcagccttttctatccgtggattctgcattcatggattcaaccaactgcagatcaaaaatacttgggggaaaaaagcatctgtgttgaacatgtacagacttttattcttgttattattccctaaacaatatagtataaaaactatttacattgcatttacattgtattaggtgttataagtaatctagagatgatttaaagtatacaggaggattgtgtaggttgtatgcaaatactgcaccattttacataagggactttaagcgtttgcggattttgctatctatgggggaaccaatttccgagagatactgagggacagctgtatatttgtaacttattttttatttccctaattgcagcagctgttgaggggacagtgaactgttaacacagataacaagtgtattcaagtacattttggagtttgtttgtttttttttttcaggcttttattcgcctgtcggatgaggcaccatacttgaatttttttttttaagaaagcttttagttttctttctttctttttttttttttgtgagatggagtcttgctctgtttctaggctggagtggagtgcagtggtgtgatctcagctcactgcaacctccgcctactgggttcaagtgattctcctgcctcagcctcccgagtagctgggactacaggtgcacgccaccacgcccagctaattttttttttttttttttttttttgtatttgtagtagagacagagtttcaccatgttggccaggatggtctcgatctcctgaccttgggatccgcccaccttggcctcccaaagtgctagggattacaggcatgagccaccacgcccggctgaaagcttttagttttctaacttatttaatttaatttaatttaatttatttttattttattttttgggacagtgtctcacttggttgcccaggctggagtgcagtggtacaatcatggctcactgcaccctctagctcctgggctcaggcaatcctcctgcctcagccttttgagttgctgggactacgggcatgtaccaccacactcagctaaatttttaattttttgtagagatggggtctcactatgttgcctaggctggtctcagattcctcaagcattcctcccacttgcacctcccaaaatgctgggattacaggtgtgacaccgtgccagacttgaaatttttaatcccacacctaaaaatataattttatccaccattttttaaaagtcataacattatttattaaaaatttagatggtaaaactaaaaattaaagcttaataaaactactgagtgatttacaaggaagaatattactggtcccttttgtgagcatcccattaattatatatattcaggttatattgttacaatatttggttctactgtatacttttttttttgagactgagtttcgctgttgttgcccaggctggagtgcaatggtgcaatctcggctcactgcaacctccgcctcctgggttcaagtgattctcctgcctcagcctcctgagtagctgggattacaggcatgcgccactatgcctggctaattttgtgtttttgtagagacggggtttcactatgttggtcaggctgatctggaactcccaacctcaggagatccgcccacctcggcctcccaaagtgctgggattgcaggtgtgagccaccatgcctggctctactatatactttcattcagttgtttctttttaatctagtggttttggtattaataatttgataatgacctttagctgttattgcttacttatgagttaatatttataaagcacttaaagtagctggcacgtagtaaacactatgtaaagatccattaaataactttaaaaaatataaaactgatagtggcattttattatagagattaaggtaatccattctctcatttccatttatgggatgagacgtaaacacaagtagtttgctctctaaaactgtatactagaattttatatacccattatttgatgcaactttaataccaaagtgtattgtcagttaccggtgaatatatataaatttaggtaaggaaaacccaacttggtcgcacacagtggctcacgcctgtaatcctaccactttgggaggccgaggcagttggatcacctgaggtcttgagttcgagaccagcctggccaacgtggcgaaaccccgtctccactaaaaatacaaaaattagccgggcgtggtggcacatgcctgtaatcccagctgctcgggaggctgaggaaggagaattgcttgaacctggggaggtggaggttgcagtgagctgagatcgtaccactgcactccagtctgtgcgacaggagcgagactccatctccaaaaaaaaaaaaaagaaaaacccaacttatcttttacagtttataatagtagaagttcaaataattggtttggaatttctgtatttttaaggttagtactaaaattgttggttataaattggggtacaatatactttgttttttaagtaccttgtgtatctaatttaactttaagtcctttattattttggtttgataagacaacttttctacttatttccccccttaactgaaccagctaccatctgcctttttcctgttgtatacattagtctcttacgttaaaatatcatataagtttcatatatatacacatatcaaactatagacttaaagtacaattacatcaacatcttttaaaaccttaatttctggccaggcgtggttgttcatgcctataatcccagcactttgggaggctcaggccattggatcccttgagctcaggaattcgagaccagcctggataacatggtgaaatcctcatctctacaaaaattacaaaaagttagctgggcgtggtggcgcacacctatagtcctagctacttgggaggatctcttaagcctgggaggcagaggttgcagtgagccgagatcatgccactgcactccagcctgggtaacagtgagaccctgtctcaaaacaaaaatattaatttctataacaaataaattttatttagtaatatcatgtttaatacccatgttacattcattattcttctacactttggcctttaggaagaggcagtgtgtgtgttacagttaaataggaaacaagtagggttcatatagtgcttatggggttttctttggtggggggttgctgggtttttggggtttttttttttgagacagggtatcactctgtctcccaggctgaaatacattggcatgctcatggctcactgcagcctcaacctcccagactcaagtgatcctcccacctcagcttccctagtagctgagactacaggcgtgcgccaccatgcctagctaaattttgtacattttgtagagatgaggctttgccatgttgcccaggctggtctctaactcctgggctcaagtgatccacttgcttcagcctcccaaagttctgggattaacaggtgcgagccactgcagccagcctatattttaactatatgtttttttctttttggctaaaatttttcagattagtttacaagttacaagtgtaggtgatatctcatggagatatcaaagatgatatgaagttagattgggtttttaagagtagtttttaaaatacggataaataccagttgttggagttttgtttaaagttctttaacttcttatttttgggccaaaatacaggtatacgctagaaatgatttttaacacaggtcatttatgccaaactgcattttgccttaatttttttttttttttttttttttgagagggagtctcactcattgcccaagctggagtgcaatggcacgatctcggctcacttacaacctccacctcccaggttcaagcgattctcctgcctcagcctcctgagtagctgggattacaggcacctgcctggctaatttttgtatttttagtggagacggggtttcaccatgttggccaggctggtctcgaactgctgacctcaggtgatccacccgccttggcctcccaaagtgcggggattacaggtgtgagccaccgtgcttggccaaaatttttattaatttttctattgcctggactctgtgaacctatccattttgccttttaaaaatacttaggtgtaaatatagatattcattaactcagcattgttttaatctatatttccaaaggcaatttaaaagatcagaaaataagaccaaattaatataaaaatgcatactttaggctgggcaaagtggctcacgtctgtaatcccagcactttgggaggccaaggtgggcggatcacctgaggttaggagttcaggaccaacctggccatcatggcgaaaccctgtctctactaaaaatacaaaaattagctgggcatggaggcatgtgcctgtaatcccagctactcgggaggctgagacagaagaattgcttgaaccttggagggggaggttgcatatctgagtggtgaaattgtgattctttttttctctttgtctgtatttttgaacttttctataaatgattgtgttttgtttttatattggaaaaatattatgctttcaaatgttaatacctatgaaactaaacacaagtaataaatatattagtatagcatttattaaggtttcttgtgtagcagatcaacatagaaaatatatttaaatggctgacataattttctaagaatacatacacgtatattttttataacattaagaaacagcagcatcattactttaatccatcatttcgttaaccaccatatacctgttgatcatttgtattgtcatgtgctttttaaaaatctagatgagaaatattcgattatctgacttcactgaatccttgaaaaaaataaaacgcagcgtcagccctcaaactttagaagcgtacatacgttggaacaaggactttggagataccactgtttaaggaaatacctttgtaaacctgcagaacattttacttaaaagaggaaacacaagatcttcaatgaacgtcatcggctacagaaacagcctaagtttacaggactttttagagtcttacatatttgtgcaccaaacttgaagatgaaccagaaaacagacttaaacaaaatatacaatgcaaatgtaattttttgttgtttaaggccttgccttgatggtcacagttatcccaatggacactaagttagagcacaacaaaacctgattctggtcttctttaccaatataatcataatgtaaataataatttgtatattgtgttgcagatgaaagtattccaggaacagtgaatggtagaagacacaagaacatttgtttgtttgtcttctgatgttttttcttaaaatagtaatttctcctacttttcttttctactgttgtcttaactacaggtgattggaatgccaaacactcttaagtttattttcttttttcgttttataaattcagtgtgccaaatgaaacttttttcctaagtaactgtaataggaaaaagtttattttgagagtttcttcttcataaatctacagacattaaacaattgttgtgttctttttaccttttatttttctattaccttgctaccaaacagtttagatagcaatataatagcaaaaaagcaaatatggtaaaatagagaaggtttgaaggtttgagttactctgtcatataacatgtagatcagtcttcatgtgacctgcagtatttttttttctaatgtatttgtcagaaatctgttgtagactgttaacttcttcctgatggaatttattttctgcaagaattattctgatatttaagagagccaattttaactgctgtgaaaatgtttccagtgcaagagaagggaaatactaggaactaagacatttctaatttattgcttattactttcttaattttacaggataattataagcaagtggaactaccatcttttattcttaataattattaatcccttcaatgaaactttaaaaaaactgaatttttatacatggcatacatttttctagttccttctgcttgctttattaactcaaaagttctagttctagtctgttgatctgccttttgttctcccaaaatgtacagtaattccatttgtttgtataaatatgcctggattttcattataaaaatgtcattgtagggagtagagactcatatcatggccttttaaatattgtaataaaggcaaatagatatttgcccttagtttactggttaaaagtttgtttacagaacttttctctggtgcttaaatgatgctatgtaaaatgtcatgagtggaaagaatatttgtagtagtaacaagaatttttcatttaggaaagatttcttaggttttgaaagaatacattaaaataaaaaacttgcccctactaggtaagaactttataatgaagacatacattcttcttaattttactcttgctcttgttaaagatttgtttgaatatagaagatgcatgatttctgggtttttttttttttttgagacagagtttcgctcttgttgcccaggctggagtgcaatggcgcaatctcgactcaccacaacctccgcctcccaggttcaagcaattctcctgcctcagcctcccgagtagctgggattacaggcatgcgccactaccccagctaattttgtatttttagtagagatggggtttctccatgttggtcaggctggtcttgaactcctgacctcaggtgatccgcctgcctcggcctcccaaagtgctgggattacaggcataagccactgcgcccagccagaagatgcatgatttcttaggatcatatgctgtttgtagccataaggtaaatcatgtctcttccaatcatgactttggaactccctgaataataaaaatgagagttgagataaataggggaaaaaaaatttttttcaagccagagctatgcatatgttaggtgatgggtagtatccctttaaggtctcaaacattacaacatcaattatgaaatactgataacgaaaggtagtaatgaaatatatatgatgaaaagaattgagaagttctaaattaagacatttcagttaagctcataaaatttcattgttttcatttaaaagattaacgttattgatacttggataactggctaatcatattaaaggactatgtggttccagctcaacttttaatatattgtctcctttaaaactatcatggttataattctattgggaaagacttttagataacaaagatttcaaatgttaaaagagataaaagtcaggttaatactatcttaaacactgagtcagaaaatcattactgtatagaagttgctttcctgatcaagtctgaacttcagctagtgctagagaactattttctatgacttaactctaaccaagttttattttaagctgtttctttgatagaagggccatgaaaatagagtaatgatatagtaggagataagggattggtttggtctttttcaataaagatagaagttgctgaagttttctgaattaataatgacttagattgtgaccttttagattcggtgttgagctctgtgttgtattacttcctaaaagataatgcttaaacattaagcattagtgtgctcttcatgttaatatggcagagttttgtaaactaaattaaaacttactgatatattggactttgagccaagggaaagaatgagtactatctttccagatatcttaagggtaaaagcttattctaagacagtctgtccattgagaatattagatttctgacttgcaaatatgtttgtactccagaagaattagaggaaaagcagatactagaattctaatttaattacatatacagccgtctttgtttatagtgtagaattctttatattttgtacaaaaactaattcttttggtaaaatgaaccatttacagttcggttttggactctgagtcaaaggattttcctttaaatgcttgtctcaattttagtctggtcttttgtacttttcttcagaagaaatgaattaaagggtacagttgcataaagtgggtttttatcctaatgtattggaaataaatgataaactttattttgtctttacttttttactttaaaactttttgatattttaggggttggagtctgataatgaaggagttgtgtgtattggactcttagtaacaattataaacgcttaacaaaatatagaaagcaatgattgggtggctctgcagagcaatcaaaacaaggtagaaactgcaaagtcctataatggaagagattcaggctgggtgtggtggctcatgcctgtttgggaggccagtatgggagaatcgcttacactcaggaattcaagaccagcctggggaatatagggagaccctgtttctgccaaaaaaaaaaaaaaaaaaaaaactaaactaaaaattagccaggtttggtggcctacacctgtagtcccggttactcaagaggctgaggttagaggatcgcttaagcccgggaggaggaggttgcagtgagccaagatcacaccaccacactccagcccaggttacagagaacctgtctcaaaaaataaaaagtaaacgagattcaccttaaccagcttttacccatagggcaatttccagtttgtgcagttcacttggatatagaattcaggtagaatgtgacagttttgacaggctgaggaatcatttgggacttctagaacacctgaaaattagaagagaaattttgggaaggagagtgcctcagaaagtaagctctaaaatctgcctacatattcctttcaaatccttggtggattccaaaattgtgctggtgcagtgtgattatttaaaggaacccaggagaaagcaagttaaagtctaaaaaactcagcagcgattgcagctgcccaaggacagagagtttgaaattcaagttccactaagaaggactgagtaaatacttggtgtttcccattgaacccccaaaatgccacgccttaaggaagaatgacagcatcctagaactaaaggctgtgcttcagcactaaggacaaaatggaaataaacttactgtaatgaagcttaaaatcaaatctcacagcatcaaggttatccattagtaatttaaaaccagaacaaaacacagcattcttgagaagaaaacaattcagtcatcacagcatatatccaaagctcagtacataataaacagttactaagcatgcaaagaaaaattatgtgatccttttgactcaacttccctgatggaaaaaaaaaagtggtccataccatactcaacagaaaatatacagaagcagatgcacaagtgacctctatgagagtgattttaaaatagcgttaaaatatgttaaaagaatttacaagaagagataatgggtgaatagatagggagtttcagcagaaaaataagaattgaaaacccaacagaggccaggcaccgtgcctcacgcccgtaatcacagcactttgggaggccaaggcaggtggatcacctaaggtcaggagttcaagaccagcctgaccaacatggtgaaacccggtctctactaaaaatacaaaactagccgggcatgggtgatgcatgcccataatcctagctacttgggaggctgaagcaggagaattgcttgaacctgggaggtagaggttgcagtgaaccaagatcatgccattgcactccagcctgggcaagaagagcaaaactccatctcaaaaaataataataataattggctgggcgcggtggctcacgcctgtaatcccagcactttgggaggccgagacaggcagatcacaaggtcaggagattgagaccatcctggctaacatggtgaaaccccgtctctactaaaaatacaaaaaattagcctggcatggtggcgggcacctgtagtcccagctactcgggaggctgaagcaggagaatggcatgaccccaggaggcggaacttgcaatgagcccagatcgcgccactgcactccagcctgggcaaccgtctcaaaaataataataataataattagaaaataataaaaaataacccactggaaagtcttgtaatgaaaactacagtatctgaaattaaaaatttaaatggatggacttaacagtaaactaggcacaacaggaaagactgaaaaagacaagtaagtatcaaaccaaagcagagagagaaagaaaaaagaaatagcagaggtttgagacctttggaacattatcagttcctgtaatttgaagtaaagaaggaaaggaagagaatggggcaagagaaatctttgaagcaatgatgcgtgaaattttccccaaagtgttgaaagacatcaacgtacagatctaagaagttcactgaatccccaagcagaataaatacaacaaagactacatctgggtacatcacattgccaaaaaaaaaaaaaaaaaaaatcttaaaagcaatcaaggtggggagtgggaaggagtagcattacattcagataaacaagagtgatggctaacctcatcagaaatgatggaattaagaaaatgatggaatgacatctttaaggtgcaaagatgaaacaaaggttaacttaaaactctgtatccagttaaaatatccttcaagatgttaaggcaatggccaggctcagtggcttatgcctgtaatcccaacactttggggggctgagacaggagaatcccttgaggccatgagtgaccagcctgggcaacctagtgagaaccccatcaaaaaataaaattagctgggcatgggctgtggtcgtgctactgcactccagcctgggggacagagtccctatctcttgaaaaacttaagacaaaatcttttccagatgaaaacagaatttgttgctggcagactgactttatacggaatgctttaagaaattcttcaggctgaaggaaaatataaatctggagtgaaaaacgtagtatctgaaattaaaattttccttggatggacttatcagtaaatggatttcccaatgggaacctgtatctccaggatggaattaagaattttgaaatgataaacatgttggtaaataagaaagacatttttcttttttatttttctaaatatcattgctgtttaaagcaaacaaaaatagtattgcagtgtttataatatatgtataagtaaaatataggacagaaatagcatgaagggtcagagagggcaataaatgtaattatattgagataatattactatattgtacacaaagtgagatagcattagtgtaaggtagattgtgataagaatgcattttgtaatctctcaccccatcactggggtgcagtagatctaaaaagccattagagaagataaaatgggtcactaagaattatgtgattagtcaaatgaaatcaaggaaagaaaaacagagcaaagaagtgtaagataaaacagtgggatggaagagctgaaattaataatgtcactaaattgcttaccttcctccttcctgaactgttgtggattttttttttttcagggggttgaggtttttttttagagacagagtctctattgccccaggctggacagcagtggcgtaatcagtctcaaaatccctgcagtctcaaactcctgggctcaagtgatcctcctgcctcggcctcccaaaatgctgggattacaggcaggcagagccaccacaccctgccagaactattgttttaaagtcattaggtggttaagccctcgagactatgtgcaagtttgatgattcgttaggagcactcacaggactcagcatatagtcttattcccaacaatgatttattagagcaaaaggatatgaagcaaattcagcaaagggaaaaaaggaattaagtgaagtccagaggaaaccaagcaccagcttctaagggttctctcctaatgaagtcacacaggatgtcactccagcaacaagtgacagcatgtgaaagtgttaagcctcactgttagacatagtaagcttgttagggaatagagggaatctcccctcaaattcaagttcccagatgcctggcaagggccaaccttgccagcaggactttctggggatagcagtcccaggcacgtgtttgcacagtggttcagatcaatgtgcttacattgggtagaggggacctatggaagtccaaatttgggtgtcagagacctaatagggtgaagacagtgtctacaatgatggacagctaggtatgaggtgtcagggacagattgaggcagttattcacatggtggataggggcaacctggaatgaggaataagctcaagcacagaaaggggtgtccatatggggtaagggtgtcagcagagatggtagattggttgcacaccaaagacttgatggaataaagtgaatatactaaccacagagaaggtaattataaatacagaaaggggggaaactagaatgaaacctggagttcagcttgaattgggtttaagaaagtgaattcatggtttaaaatctataaaaatagatgaaatatcggctgggcacagtggctcacgcatataatcccagcactttgggaggccgaggcgggcagatcgcttgagatcaggagtttgagaccagcctggccaacactgcgaaaccccatctctagtaaaaatacaaaaattagccaggtgtggtggtacacacctgtagtcccagctacttgggaggctgaggcacgagaatcacttgaacctgggaggcagaggttgcagtgggctgagatcgcaccactgcactccagcctgggcaacagagcgagatcctgcctcaaataaaaatagaggacatataagcatataaatatacacgtgtgtatgtgtccaaatatgtatattccctagtctgtccaccaaggtggccttggagcagttatgctccaataataatgagcacataaagtacccatatcttgccttccaaattcttcactgtcttagtctgcttgggctgcattacaaaataccatagactgggcagcttaaataacagaaatttatcctcacagttctagaagcttggaagtccaagattaaagtaccagccagtttggtttctagtgagggctttcttcctggcttgcagatggccaccttctcaccgtgtccttgtatggcagacagcacaagctctctggtgtccctttttaaaagggcattaatcccatcatgacagtcccatcctcattatctcatctaaccctaggtacttcccaaaggctgaatcaccaaagaccatcacattgctggtgaaggcttcaacatatgaatttgagggacacgaatattcagtccataacatcaactaaaggaaccaagactctttgataaaatggctaaattcagggctggggcagagaaaatacatgagtgtggaacttcttgtgccagagagaaaaagtgcccaaagattgatgaggatgaatcattgaaatgacacacagattaaaagggttcccactggacaaatttgagcatcaaaataagtaatagtagtaattaattataacccatcagaagaaataaaccatgagctcatgtgaatatatgaatacaaacataaacaaattacaagcataatgaggaatgtgatatttatatggtttaaaggtacctctccaggccgggtgcagtggctcatgcctgtaatcccagcactttgggaggccaaggcaggtagatcacctgaggtcaggcatttgagaccagcctgcacaacatggtgaaaccctgactctactaaaaatacaaaaattagccgggcgtggtggcacgtgtctataatctgccactgattaggtgtgtgattttcccaagcaggggataatagtagtacctatgtcaaaggctgttatgaggattaaatgagctaacacataatcgtgctttttttttttttttttttttttgagacagagtcttgcactgtcgcctgggctggagtgcaatggcacgatctcggcccactgcaacctctgcctcccaggttcaagtgattctcctgcctcagcctcctgagtagctgggattacaggctcctgccaccacacctggctattttcaatagagacggggtttcactatgttggccaggctagtctcaaaaacctgacctcgtgatccacccgctttggcctcccaaagtgctgggattacaggcatgagccactgcacccggctttttttttttttttttgagatggaatctctctcacccaggcttcatctcagctcagtgcaacctccgcctcctgggttcaagcaattctcctgcctcagcctcccgagtagctgagattacaggtgcctgccaccacacccggctaagttttatatttttagtagagacggggttttgccatgttggccaggctgatctcaaactcttgacctcaagtgatctgcctgcctcagcctcccaaagtgctgggattacaggcatgaggcactgtgcctggcctcaaattcttagaatactgcctaccacatattgaatgttcattaaatcctaggtataggacaggggtgttggctcatgcctgtaatgctagcatcttgggaggctgaggcaggaggatcacttgagcccaggagttccagaccagcctgcgcaacatagcaagacctctcctctactaaaaaagattactgtggctgcagtgtggagaacagattgtcgatagatgataatacctacgattttatttattttttacttcttatttatttttttgagatgaagtgttgcactgttgcccaggctggagagcaggggcacgatctcgcctcactgcaacctctgcctcccgggttcaagcaattctcctgcctcagccttcttagcagctgggattacaggcacccgccactacgcccagctaattttttttatctttagtacagacagggtttcaccatgttggccaggctggtctcaaactcctgacctcgtgattcgcccgcctaggcctcccaaagtgctgggattacagacgtgagcaccacacctactcagttgttctgtataccattacatgttcagcaaccctaatccaaccatctgaaattaaaatgctccaaaatcaaaactttttgatcatcaacacgatgccacagtggaaaattccacacctgaccgcatgtaaaaagctgtagtcaaaattttgtttgatacacacacaatttttaaaattgcataaaattaccctgaggctatgtgcataaggtgtatacgaaacataaatgaatttcaagtttagcctctggccccatccccaagataaagagccacaatctgaaacagttctggtcttaagcatttgggatgaaggatactcaacctatacccagttttctacacgacactacttatgaatatcttttaaaaatttctttatccctacttgttttctgtcttccctaccagaatataattttcacgagaccagtatctgacaaacacacgtgctacatattcaatctttatcgaatgaatttaatattttccaagttttctataattaacattacttctatattattaattttatagagaatccaaatagcattttattaagtagaccattagtcggtccgagttcaaattctgctactacagcaaactatatgtaggactcaaggcaagtttcttttttttgagacggagtctcgcgctgtcgcccaggctggagtgtagtggcgcgatctcggctcactgcaacctccgcctcctaggttcaagcgattctcctgcctcagcctccagagtagctgggattacaggcgcgtgccactacgcccggctaatttttgcatttttagtagagccggggtttcaccatgttggccaggctggtctcgaactcctgacctcaagtgatccgcctgcctcgccgccgaaagtgctgggattacaggagtgaaccaccacgcctggcggaggcaagtttcttaatcttctttcctcacttgtaaaactggaatactgtccattttcataaggttaaatcatacaacacaggtaaaagcgcttcagcacgcaacgaaatttttctaacgtaacgaaaaactcctcgttgctccttgccttgcccttaacctcaacgcttcaggtcccgaccaatctctcggagagctcagagggagccgctctagccgccttccgccacggagtgcagggacagccgggaaggggacggaagccggaggccagagcacgcacttcctcccacgctttcctcacagccaatcgcccactggtgccccaccccttccgttctgggaaaactcgagcacccagaacggcttccggcgggagctgtgcagctccttatcatggtgagttggctgttggggtgagggtttcggctgtagctgattcggtttatcttatttggtcccgaagcgaccttgaaatccctcagccacccagaggaggggtcattggagttgaagtcgggccccttggcaggagcggctgtctcccaaaatgttccccttcagagttctggtccctttcggtccctcacctgttccgcaggcgctcacgatctaggccccgctgcaggcagagctttcagctcctggcgagtttctgacttccctctgccgagatttctttaaggtaataaaagtttttgccagcgtcaacaactaggccaccaacaaaagatctgaaaacaagtccacagcaacaactgtaatagtgattcttagagcagtggcgataacgccagcggaaaaaaaaaaaaaaggttagtaatagggttttagggcagacgtctcactctgcaacttggctttactaaatattaagtagcctgattacggcagcaaatttcataagcgcagtaactacagaaagtcaaggtgttggtaggacattttattgctgctttatttctgggtttgtagaaactaatggaagacccagtagacgttatggttgttgggatatggtgttttctctcaaatttgttagaattagtcattctttgcctttagagctcaaatatatagctctgaactttaaagataagcagttggttgggatttgaagtgtccaagtggcgtgtgccttttgaaaatgcatttattagaaaaatttatggagtacttattgatagcctacgtatgagaaagagaccacatttctgtgcctaagcttttgtcactgtactaagttttttacttaagtggatatggtcgggaaaatgcctcattcacacactttatgttttgtaaattttctgtaatccttttgcacacagaaaatgggtaaaagtttacactttttggctaatgatcaaatagccttcagttacgctcttcttcaaaacattcaccattgtgaagcctgtagccagagttatatttctaaaatttgaccacatcactcccttactcaaattttctccttttttttttttctgtagcactcaagataaagtcctgtttagcatggcatacaaagccactcattatcaagcttcttacttttacagcctctttttttgttgttgttttcgagacggagttccactcttgttgcccaggctggagtgcaatggcgcgatcgcggctcaccacaacttccgcctcccgggttcaagcgattctcctgcctcaccttcccgagcagctgggattacaggaatgcgccaccacgcctggctaattttgtatttttagtagagacggggtttctccatgttggtcaggctgatcgcgaactcctgacctcaggtgatcctcccgcctctgcctcccaaagtgctgggattacaggcgtgagccaccgtgccaggccacaaactctttttttttttttttttttaatgcatacatgtatgcaacatccgtatttcagccacagtgaatagcttgcaaatcatgctgtattaattgagcctttgtacctaatttgcatatgctcttccatccccagaattgttctctgttctctatcggctgtccttatcagaataacccttatatatccttaattatttttcatgaacctttccctcatgttccagtatcctcttagttgcttctcctttgtgctctggtggtaccttgtgcttttatatgcacaaacacacacacacacacaccagttttgttacataaagctgcacaaaacgaatacatacaatagaaacttaacttgcctataatactgatgatttgaagggagttgaagataaagggataagagacttaaaattcagaggtctttcagattatacaccttcattaactcacagccctaatttaagaaagtaaaacttgaatctcttgtgttttttaccagtaacatctgtaatccttacagacgatgttaaagttgtgtacttatttgtctttctcactttctagactgtaagctcattgagagcaggacctatgtatttcaccctaattcccagagctttgtagcgtgcctggcccagaggaagttttcaataaacatctgttttataagacactgaaaacttatggcactatatctttatgcttgaaacattagtattagtcatgcagggaaacagtatttaaggtttattttaaaggatattgagaaaaggttttgcgtttattaagaacatgctatgtgaaaacagtactttcttagaaaatataaagaaaaatacaaataaaacgtctgttttataaagcactgaaaacctatggcactatatctttatgcttgaaacatcagtattagtcatgcagggaaacagtatttaaggtttattttttaaaataaatattttaaaataaaatattgagaaaaaggttttgtgtttattaacatgctgtgtgaaaacagtgccttcttagaaaatataaataatataaatatataatattaaaaatataagtatataaaaacaaaatataaaggaaaatagcccttgtcattagtgaagttactaaaattacaaagcaatgtaacaagttgaaggctttactttggttaatgcaaaataagtggcataaaaaacactatagtttggaatgatctaggaagacttcatttaagaagtgaaacatgaaactaagtactttgtgccccactctaatactcttaatctaatacttgtttgtcattatatgaataagagcttgggttagacagatctggccttttcacgcaagagtggtcatgagacaaaagagtagaccagtttaactgaagttgagggtttctatctggagtaagagataagactggaaagaaacaggctaagtcattgaaaacctggaaattcaggttgtaaaatttgtagtttattctgatagcaatggcgagccaatataattttgggaagagtgatatgacattaggatttttgttttattttcattgtcaggatggcatcagaagtggctttctgcctcttagaaaccttgttgattctcttaacctgaaacttaaagttggctagggttaaacagaagatgtccaaaataacagtattaaggagaattttttaaatctttggaaccaaaataactcacacataattctttaagaaaagaatatatatacatatgtacatacacatatatataatatttatacatatgtacatttatttatgtatttatttatttatttcgagatggggtctcgctctgttgcccaggcttgagtaaagtgtgaacctggctcactgcttgacttcccgggctcatgcgatccttccaccttggtgtcctgagtagctgggactacaggcatgtaccactatgcctggctaatttttttcttttcaatttttttgtagagacagggtctcagtatatttcctaggctggtcttgaactcctgggctcaactgatcctcctgactcagtcacccaaagtggtggaattacaggcatgagccaccatggccagccaagaaaaagatatatttattggctgggtgcggtggctcacgcctgtaatcccagcactttgggaggccaaggcgggcggatcacgaggtcaggagatcaagaccatcctggctaacacggtgaaaccccgtctctactaaaggtaaaaaaaaattagccgggcgtggtggtgggtacctgtagtcccagctactccttcaccgcagaatggggctgcgacagagtgaatatcctgtttgccgtgtagcctatatttaaaatcagactgtcctcctcaaaagcagctggaactgaggttcaagagatggatgtgactgtgtatagggagaggcataccatttttatttttaaagtatcaagagaaatcatgatttcacattaacaatacaaagttgcaaaagcaaatgtgaataatgagcaggtactgatttggccagctttataaatgtgtaacttttaaaactgggttattcatctttttaaaaatagtttgtggaagctcattgtgtatagagaaaattggcctattgtctgttgtgaattatagttttttttcagtttgaccttcttaaagtttttttcccccttaagggtattacattcgcccatgaaattatatagtaaaatcaatcaatttttttcctttagagcttcttgggttttatgccctattaagaaaggcttcccccaactcccagattataaaataatacatctagactttcttcagtcaagtactctataaatctgtattttatttttaaaaataacaacagagtaaggagtaacggtaagggtgaaacattaccttgatcaaaataccatttattgactggcttatattttctcccagtgatattggatactgcttttctcataagttaatttctcatatgtgtttgaactctctgttctgctaaggctttcccatgtgatttcctaaacttgggtggttaatcccctctagttgccacttggtctcctctctcattggtgagccctatctttactatccccaaactaactatacactagcaggggccagggagactagccaggatgtcagatactttgactgaatgcctaagagagaatctcaggggttttactataatagttgcctgaacttactttctttttgagacagagtctcactctgtcaccgaggccagagtgcagtggcacaatcttgactcactgcaaactccacctcccaggctcaagagattctcacgcctcagcctcctgagtagctggtattacaggtgtgcaccaccacacccagttcatttctatatttttagtagagacagggttttgccatgttggccaggctggtctcaaactcctggcctcaagttatccctctgcctcggcctcccaaagtgctggcattacaggcatgagccccaagcacaaccacatatatagctttaattaggtgaattttcagtagaaatttccagtagagctatttggcaaactatttctttttcagttcaagttgccttatccatttaaaaataaagagtgtggtctggagctaaaaagcctgggtttgaatttctgctcagccatttactagctctgtgactttggatgacttactaaaagttgtctccaccacataggtttattgtgaatattaaatccataaatacacataaagtgtctagaataagtgcttgatgtatattgagtacttaataaatattggttatttatatcataggaaccactatatcatatcataggaactctgaagatgattaaatatctaaatgctgatttgtatatgtttgtttgaaaggggacaattcatctctttcgaaaaccacaaagatccttttttggcaagttgttacgggaatttagacttgtagcagctgaccgaagggtaagttattccttaaccccaattttaattattgcacaaacaacattataacattgaagaaagataatttttaaggccaatagaaatcactcctgatcctgccacactgttttcatttttctatgttggaaaagtatttttttagtgtaaaattgcagttgtttggtgttaagttgttttactttggtaggaagcttctgttaaagttttgattctaattctgaagtgttttaaagaaaaatggttttgtggttgctttttgttattaagttttcaaaaaattaaatggatccagtctaaagccatgttttctcttttatttatttttttttttttgagatgaagttacactcttgttgcctaagctggagtgcaatggcatgatcttggctcaccgcaacctctgcctcccgggttcaagcgattctcctgcctcagcctcccaagtagctgggattacaggcatgggccaccacgcccggctaattttttgtatttttagtagagatggggtttcaccatgttggtcaggctgatctcgaactcccgacctcaggtgatccgcccacctcggcctcccaaagtgctgggattacaggcgtgaaccaccgtgcctggcccatgttttctcatttttaatgtagggcaagaaaaatatgttttgagactgtaaataaaaagatgtaattgccatccttttaggccaccaatgtaaaccttctagttactgtgtttcatgcttctcattgttgtctaaatgataaactctctgagggaagtgactgtctctattttgctcacctttttatagaagtacaatataaacattcagtaaatatttgatgacttttaagtaaagccagcttcaatgaaacaataataagcagtaccaatgggcactccaattgaaactctgccatattttcactatttttcaactccgttatcctcatttgcttccttatccaacttagattctatgctccatcattatcatttccctcctttttgttcttttttttttgagatggaatcttgctaaattatccaggctggtcttgaactcctgggctcaagggatcctccttcctcagcctcttgagtagctgggattacaggggtacaccaccactcccagctagtatcattttcttttatatgttctcaactcttttgtgctccccttccctctgtcttaattcctggaaaatccctaaccttcattaagttcactttctttctactctacttgcatctaagcaactgaatgtaacctgagagaaacaaaaccatgcgactggtctcactttgaattcatgatcagacagaccattagtgctgcctattaagtgctgcctattagtgctctttcattttatatttcctttgttcattcaattttccaatttcctagatggctgtttcatacgatgttctttcgtttctatcctcaagcttctaataccttcttcatcctcaccctaacctgatgatcttgcttcctgtttcaccaagggaaaagaagtaatcagaagaaaacttctacatcctatcattagcacatcagccatcactccgccttccctcctatttctctggacaagctttcagttcttctctataaaggcaatcctttcacttgttgcctactgaaagatgatgtccctataattgttctgtttcttacatcattgtttttcttgcatcatgcatcattctcctctttcttgcatcgtaattacatgttataagttccactctcagggctgcttcatttctcagcttccttttgtagcaaacctacttgaaagaattatcagtacattgtgttcaccttctcttctcctcatctttattaaacacataccagttaggtacttgtgcccactaattcacataaacagcttttacaaggtaaccaaaaatctctgtgttgccaaaatgaagatttttccttatttctcaccttacttggttgatgttgaacagccaaagtcagtacttttttttttttttttgagacagagtctcgctctgtcgcccaggctggagtgcagtggcacaatctcatcttactgcaacctctgcttccctggttcaagcgattctcctgcctcagcctcccaagtagctggaaatagaggtgcctgccaccacacctggttgattttttgttttagtagagacggggtttcaccatgttggctaggctgatcttgaactcctgacctccacccaccttggcctcccaaagtgctgggattgcaggagtgagccattgcacctggacaagattactaacttttaggaacatcatcatgccctttattcagattcaccagttgcttacatttggccccatttgcttcatcgttgtctctataatatgtacttatagagacaaaacgatatgcatatgtatgtgtatttttctcaactatttgagaatttctatgtcagaatttattttctcttgaacaactctccttctggaactattcttttaaacttgtatactgtaataacttagccgatgacaattttggtagatgtagaaagtgtgacacagactttttgaaggaagttatgtttattcctttgaatatcagagtataaattgtagcaacttgaacagaccccgtgaaatttatcacttctgtacacataagagtgatttttattttcacagtcctggaagatactgctctttggtgtaataaacttgatatgtactggcttcctgcttatgtggtgcagttctactaatagtataggtatgtcacctttgtatttttatggagttgttatttttacttttatttttctcattggaaataaaggtatatcttacatagaatatattattctgaaatgtatataactcaaatgatttaaataagggactatatttaaaacttccctgtaaactgtaaacttttgttcatttgttaggattgtaatttttttttaagtttttttccttttaaaatatattttaaaacagaaatggggtttcgccatgttgcccaggctggtctcaaaatcctgagctcaaacgatctacccaccttggcctcccagagtgctgggattacaggcgtaagccacaatgcctggccattttcattttaaataagctgttattttttgaaaaatcattaaatctatctggagattttttttttttttttttttttttgagacggagtctcactctgttgccaggctgtagtgcagtggtgtgatcttggcccactgcatcctccacctccctggttcaagcgattctcctgcctcagcctcccaagtagctgggattacaggcacgtaccaccacgcctggctaatttgtgtagttttggtagagatggggtttcaccatgttggccaggatggtctcgatctcctgaccttatgatccacccgcctcagcctcccaaagtgctgggattacaggcgtgagccaccgtgcctggctggagatttgtttttaatataatagattaaaactttaatttatgcagtttgtaagttagattttgaggtttgttggcttttccttaaaaagggaattctgtaatttttttcttatatctttttatgttttttattgcattgttcttttgttcagttattcaaacaatacatttgaaatagcgctgagattacagaagcaggcagaaaaatggtaacagggcttttgaacattcattgcttcatttttcctaatggagaaatcaggttgggaagtaagcttttctaccaacgaactttggctacatatatttatcagatttactagataactgccaatatatgaggttggcccgtgactcaaaagtttttttgataatggatacccctggtagaaataattttggtaacttgctgtatttttttagaggggtcagtaatacttttaatcatttttttgttgttttgcagctttaactgcctatacttacctgaccatttttgatctttttaggtaagtttttaggaaatcttaatgttttggagctaataaggaacttggtagaaatgtggtatagccatacaattcagcaataaaaacagcaactactgatatcttacaagaaaacaataaaaacattatgctttgaagacagtcataaaggaccacatattttatgatttcatttatatgaaatgtccaaaacaggcaaatctatggagagaaaaagtagattatgaagaagttttctttgcttaaaggaaagtaatctactaaataagtaaaattatcaacatagaacaaacacacaaacaacaataattagagacataacagtaattagagagcaggtggggcggctcatgcctgcaattccagcactttgggaggccgaggcgggtggatcacttgaggtcaggagtttacgaccagcctggccaacatggtgaaaccccgtctctactaaaaatacaaatagccaggcatggtggtgtatgcctgtagtcccagctacttgggagggtgaggcataagacttgcttggacccaggaggcggaggttgcagtgagccgagattgtgccaccacactccagcctgggcaacgagcgaaactcagtctcaaaaaacaaaatatttataaatttgattatattaaagttaaaaactctaggtagcaaatgtcaccataaacagagaataacctgagaagatatttgtaattcatacctcagagggctaattttgctaacatttgaagggccctacaatttaagacaaagaccaagaaaaagaaaaggaagaaaaaaattataattcatacagagagtttacagaaaaggaaatataaatgacacttatgaaaagttgcttatcttcactaacagtaagagaaatgcaaattaaaattactctgagatgctgttttgcctgtcacgttgggaaagcttaagaaatttgagtatacctgtgtcgctgagtgtattagggaaacgtgctcttttgtttttttaaaaatggctttatttggccaggcttagtggctcacgcctgtaatcccagcactttgggaagctgaggagggtggatcacaaagtcaggagttcgagaccagcctggccaatatggtgaaaccccgtctctactaaaaataacaaaaattagccaggcatggtggtgggcatctgtagtcccagctactcgggaggctgaggcaggacaattgcttgaacctgggaggcagaggttgcagtgagctgagatcgcagcactgcactccagcctgggcgacagagtgagattccatctcaaaaaaaaaaaaggctttattgagatactataattcatatgccttaaaatgacttttagtctcttcatacatagagttgtgcattcatcaccataattaactttacaatattttctttcttttttttttctttgagacggaatcttactctgtcacccaggctggagagcagtggcatgatctcagctcactgcaaccttcgcctcccagtttcaagctattctcttgcctcagcctcccaagtagctgggaatacagacatgcaccaccacgcctggcaaatttttgtacttttagtggagacggggtgtcgccatgttggccaggctggtctcgaactcctgacctcaagtgatctgcccaccttggcctcccaaagtgttgggattacaggtgtgagccaccacgcctgacctacaatattttccttgtctcaaaaagagaccactcgccttagctattactctccagtcattccgttctcccactcattccattctcttctccagccctaggcaaccactgatcagttttttctcgcgatagatttacctactctggacatgtcatataagtggaatcatacaatatacagtcctttatgactgtcttcttagcacaatgcttttctgttttgttgtagcatatatcaatagttactctttcttttttttttgagttagggtcttactctgtcacctaggctggagtgcagtggcgtgatcttggctcaagtgattcttttgcctcagcctcccaagtagctgggattacaggcatgtaccaccaggcacggctaattttttgtatttttattagagacggggtttcaccattttggctgggctggtctcaaactcctgacctcaagtggtccacccacctcggcctaccaaagtgctgggataacaggcgtgagctaccgtgcctgagcaataggtatgttttcttctaagagttttatagtttttgctcttacaattaggtctttgattttttttgttgttgtttttgttttttttagatggagtctcactctgtcaccccgggtggaatgcattggcatgatcttggctcactgcagcctcagcctcccaaagtgctgggattacaggcatgagccaccatgcccaattagtttttgtatttttagtagagacagggttttcccatattgaacaggctggtctcgaactcccaaactcaagtcatctgcctgcctccgcctcccaaagtgctaagattatgggcgtgagccactgtgccctttgatccattttgagttaatttttttttttttttttttttgagatggagtctcgctctgtcgcccaggctggagtgcagtggcgcgatcttggctcactgcaatctccgcctcccaggttcatgccattctcctgcctcagcctcctgagtagctgggactacaggcacccgccaccacgcttggctaatttttggtatttttagtagagacagggtttcaccgtgttagccaggatggtctcaatctcctgaccttgtgatccgcccgcctcggcttcccaaagtgctgggattacagacgtgagccaccgcacccggccaagttatttttttttaatggtgtgagattgggggttcagattcattcttttgcatgtggataaccagttgtcctatcatcatttgttgaaaagactactttccccattgaattgccttggtacccttgtcaaaaaccagttcacgggccaagtgtggtggctgatgcctgtaatcccagcactttgggaggccaaggcaggtggaccacctgaggtcaagagtttgagaccagcctgactaatatgacaaaactccatctctactaaaatacaaaaatgagccgggcatggtgccatacacctgtagtcccagctactcaggaggctgaggcaggagaatcgcttgaacctggtgggacagagattgcagtaagtgagccggaatcgcaccattgcactccagcctggacaacagagtgagactccatctcaaaaaacaaaacaacaacaacaaacaccagttcactgtaactgtgaatgtttatttttggattctcaggtctgtcccattgatctgtatgtctgtcctttatgccagtaccatcagtcttgattactgcagctctgtagtaagttttgaaattggaaagtgtggatattccagctttgttctttttcaagattgttttggctaaacaggcattcttttttctcaggctggagtgcagtgggttgacctcggctcactgcagcctcagcctttaccgcctgagctcaaatgatccagctcagcctcctgagtgagtggtaccacaggcttgtgccaccacacctgcctaattttttgatattttgtagaaatgaggtcttcttatgttgcccaggcaagtcacaaatttctgggctcaagtgatcctcctgcctttccctcccaaagcgttgggattacaagcatgaactacctgtcctggctggaaacaggcacttttatacattgctggtgggaatataaattggtgcagcatctcgagggcaatttggcaatatcaattaaatttataaatgcccataaccttaaacgtagcagttccttttctagtaatttatgctgcagatatattcctgtggttaaaaatgagttgcatatgagattattcagtacaaaagattggaaacaatcagtatatgaatgatgaaataatggggcatgtataccccatattttggtatgtatatatcatagaattctcaaacttgaccatacagcagaattacttggaaggtcttgttaaaatacatattgcttcatttccagagttactgattcaggaggcctagggtaggacccaagaatttgcatttctagcaacagatgaaaccgatcctgctgggtatagggaacccacttatctgtgtaattaaatattatgtagccttagacaataaaatcaaagcattttatggttttgaggtcctaatgaggggaaaaagcaagatacacaacagtgtatatagtatgctgcaatttgtattaaaaagggggaaagaataagaatacgtacatgtatacacatccacacactacactcattcatttgcttgtatttgcgtaaatatacataggaaagataaacaaactgataataataggtgtctttgaagaggaagactctggcagggagacaagtttaaaatcttcccactatatatctgttgtaaattttgaattttatttatataaataaaacgccaatttaaaaataaataaaaagcagtttaaatatgttaccgccaagagtggtgtctcatgcctgtaatcctagtgctttgggaggctgaggcaggaggacatttgagcccaggagtttgaggctgcagagagctatgatcttagcactgtactccagcctcagtgacagagagataccctatagaccaggcacagtggctcatgcctgtaatcccagcactttgagaagccaaggtgaaaggactgcttgagcccaggagttcaagaccagcctgggcaatacagtgaaacctcttctctacaaaaaattttaaaaattagccaagtttggtggtacacacctgtaatcccagctactcactgaatagtaggcagtaggatcacttgagcccaaaaggtcaaggctgcagtgagctatgattgcaccactgtaatccagtcttgggtcttggtgacacactgataccctgtctcaaaaaaaaaaaaaaaggattttatttatttatttttgagacagggcctcatcctgtcacccaagctagagtacagtggcacgatcttggctcactgcatgcagcctccacctcccggtctcaagcgattctcctgtcttagccgcccgagtagctgggattacaggcacccaccaccatgcccggctaatttttgtatttttagtggagatggggtttcaccatgttggccaggctggtcttgaactcctgacctcaggtggacctcccgcctcagcctgccaaagtgctgggattacaggcgtgaaccaccgcgctcagcccatgcatgtactttaaaaagttactttggggaatagttactaatgttaccaaccatatttgataacaaactaacggtaataaaaatagtcaaattttaaaactaaagtaataatgtttcccttatgtcttaaggttcataaggaaaatcttttcatttaatttgaggaagtttctttctttagaggctcacaatctgccatatgagttagctatcgctacataacgtttcagatgaaaggtgtgatttagattcatttagagcttcactaatatccaaacacagaagaaagtggttatctgattttagaattttaagtgttaataaatgctactgttttacaaagaggtgtagaaatatattttattggagaacattaataccaaagtggtgttactaaactatggaaattaaaatgatttacacatataaataaaatcaaacatattgaatgatttgttaataaatgggtactgattttttagatttatgtagtaatgggaagtaaattcgatcagtgtaccatatttcatcaaatattagatgccaacagttttaagacaaatacttattttatgtgtccccaagaaaaatgctgctaattcaactgtgatgtactgtaagttgtaagactaaccctgatttgaggattattaagatgtgaaaaaacatgtacttcttaaaattgatgaattatagaaaaattttcagagatttttatccatttttaagggtaaaattttcaaaagttaatatttagacactgaatttttcagatttcttattattaacaaatcttatctatagagtattatttacaaagaaaaattttacaattaataattgaagctttggccgggcgaggtggctcacgcctgtaatcccagcactttgggagtccgaggctggcagattccctgagctcaggagttcgaaaccaccctgggcaacatggtaaaaacccatctctactaaaataccaaaaaatgaggtgggcatggtggcgcacttttgtaatcccagctgcttggaaagctgaggtgggagaatcgcttgagcctgggaggtggaggttgcagtgagccaggattgtgccactgcactccaacctgggcgacagagtgagactccgtctcaaaaaaaaaaccataaataataaattaatgattgaagcttcaattgtatatttcgtttttcttttctttttttttttttttttttgagacagggtattactctgtcacccaggctgagtacagtgacatagtcatggctcactgcagctgcaatctcctgggcttaggcgatcctcctaccctagcctctggggtagctgggactacaggtgttcaccaccacacctggctaatttttgtgtatttttgtggtgatggggtctcgacatgttgcctaggctggtcttgtactcttgggctctcaagtgatccacctgccctgacctcccaaagtgctaggtttacaggcatgagccaccacgcccagcctaattgtatatttctgactgcagaaactcatttggctgcctttatccgatgcaatttcaaaaatcattcatccattcaaaaccaacctagattatttgctgaacttcaatgtaaataccatattcttgctgcttacatgaattggaagtgagattagcacactatatgaaccctgtcatgatgagtgtgaagtactctcaaggagttagccagggctcttttgattgcagccatcagacttccactggagctctattgggggagcaaaggtgtaggatacttaattctacagattcaggggtgttaatggaatctgagggcagaggtttaactgggccccattgtaagaatcaaacttctctttatctctcatctctgttccctgtacatggacaccgttgagctattttcttcctgtaggtcagcgttccctactcgcaaatccagggatagaaatacaaatactactccaaattttcaaatgtgcatttccatcattcaggaaagcagccaaattaagcctggaatgccttggttgcagttccaaatcctacttccaaatccagagcagcattttgacgcagcttaggttacatgtgtcaggtgcctatctgtggatgagtcagctgtggccagggagtagggtcatgttaagaacataccagttctcagccaggcacggtgcctcacacctgtaatcccagccctttgggaggccgaggtgggtggatcacaaggtcaggagttcctgaccagcctggccaacgtggtgaaagcccatctctactaaaaatacaaaaattagccgggcatggtggtgcatgcctgtaatcccagctactcaggaggctgaggcaggagaatcacttgaacctgggaggcggaggttgcagtgagccgagatcgcgccattgcactccagcctgggcgatagagtgagactccatctaaaaaaagaacatatatcagttcctgctgtaatatagatggagaaaaaaatgaaggatagttaataactgagaattgaggaattgtgagctagggagacagactcttgtctccctgcttcatggagcctttcatatttccatttaaggattacaaaatactttgatgtcttcaagatccatgagataggagtatattataaggatggcttttcggccaggcgcggtggctcacgcctgtaatcccagcactttggggtggccaaggcaggtggatcacttgagaccaggagttcaagaccagcctggccaacatgacgaaacctcgtctctactaaaaaaaaatatataaaaattagccgggcatggtggtgcatgcctgtaattacagctacttgggaggctgaggcaggacaatcacttgaacctggaaggaagaggtttcagtgagccgagatggcactactgcactccagcctgggcaacagagcgagactctgtctcaaaaaaaaaaaaaaaaagcatgccttttattaatcaggtaactaacatatttaactgggtctaacgcagatagttgttacctcaatttcatattgtagtaacttgttttacagtgaatctactatagttggaaaatgaacataattttatctcactcaaaatgttgtcaaggtattattaatatttatgttaacttttaacaaagatgaagcgtatcaaagttaaaattgatcatatgtgtcattttttagcattttcagttacagaaaccatttagggtgaataacattgtgtagtggaagtatgaatttaggttctactttactgacttgatgtattataactttattctgttccttcacatgttaaaatcttccaagtataccacatgttcagatgctcactgtgattagatggtaaactactagaattaattatcttaataaattattagaataatttattattaatttagtctgtgcaaacacagataactttcaaccacttaggaattctgaaaacttaatttatcttcacatgttctcttctagttctaatactaaatttatttttctttttacttagtttaatgacatgtttaataagttactgggtaacattgaggaaacctagccctgtctattcatttgggtaagttcaaattattttattttctgctaacttatgactactaaaatattatttatagtagacgataaagagctagctagagtatttctggaaaataaatgctgcgtacttagtgaaatgatgatcagatagtgaaaatagataggctgggcacagtggctcacgcctgtaatcccagcactttgggaggctgaggcaggcagagcaccttaggtcaggagtttgagaccagcctggccaacatggcagacccctatctctactaaaaatacaaaaattagccaggcgtggtggcatgcacctgtaattccagctacttgagaggctgagacaggagaatcgctggaacccaggagacggaggttgcagtgagccgagatcatgccattgcactccagcctgggcaacagagcaagactccttctcaaaagaaaatagaaaagcatcttccaagaaacataaatatttaaggtataaatcatattaaaataaaatgttcacattaagttttttatattttataaagcaaatattttaaaaagttcacgttaagttctttaatattttggggatttattttagcaagagcaagtacaaaggattttcatgttagtgtatcttctagatgttaaataaatgtgatatagtttaataataggcagtggtaaagatggattttcatctgaaactggatttgtgatagcaatagatcaacaaataatttgagatttgtttccataattactgaggccaggtgtggtggctcatgcctgtaaccctagcactttggtaggttgaggcaggaggattgcttgagttagaagccagcctgggcaacatagtgagatctgtcgctgcaaaaaatgtttttaattagctgcacatggtggtgtacacctgtggtcccagctgcttgggaagctgaggtgggaggattgcttaagccaggagtttgaggctgcagtgagctataattgcatcactgcattacagatggcaagagtaagaccctgtctcaaaaaaaaaaaaaaatttactgaaagttgaaaggaaataatcttttatattaaaggtttaaaaatgtatttaaacatgagttccttttagatgctaggaaacaacttgaaagaattttactttattaatttttttttacctgaagaggcatatcgaccaaggaatttcactttagtaaagaaacttttggaccaaacttagtcttcttttccaccataccattcattgggactatattcttttgaacaaaattaggttttatttacttaaacaatgggaagaagtaaacaaaaattttaatgcaaaataaggattttcataaatcaatcataaatcaaaatgaatttttaaaaaatattatttttaattttatttattttttgagacggattctcactctgtcacccaggctggagtgcagtggcatgatctgggctcactgcaggctctgccttccgggttccagcgattcttctgcctcagcctcccgagtacctgggattacaggtgtgtgccaccacgcctggctcagtttttttttttttttgtatttttagtagagatggggtttcaccatgttggccaggctggtcttgaactcctgacctcaaatgatccacctatctctgcctcccaaagtgctgggattacaggtgtgatccaccacacccagactttttttcttttgtgtgtgtgtgtgtgacagttttgctgtgtcacccaggctgaagtgaagtggtgtgatcttggctcattgcaacctccacctaccagattcgatcaattcttatgcctcaacctccagggtatctgggattacaggtgtgcaccaccacacccagttaatttttatagttttagtagagatggagtgtcgccatgttggtcaacctggtgtccagctcctggcctcaaagtgccaggcccagcctgtgtcactgaaacttgagagagttgcattatcactatgataatcagttgtaaggtatagatatatccatataaggaaatctgccactgcaagtgacagaaatctaacttagtttggggcctggtgcggtggcttacgcctataatcccgggacttcgggaggccaaggtgggtggatcacctgaggtcaggagtttgagaccaggctggccaacatggcaaaaccccatctctactaaaaacacacacacaaaaattagctgggcatggtggcaggcacctgtaatcccagctacttgggaggctgaggcaggagaatcacttgaacctgggaggcagaggttgcagtgagtcgagattgtgccactgcacaccagcctgggtgacagagcgagactctgtctcaaaaaaaaaaaaattagtttggggagtcagatgcagtggctcatgcctgtaatcccagcattttgggaggcccaggtggtcgatcacttgagtttaggagtttgagaccatcctgagcaaagagcgagaccccgtctctacaaaaaaatacaaaaatatgctgggtgtggtggggcgtgcctgcattcccagctactcatgagactgaattgggaaaatggcttgaacctgggaggcagaggtttcagtgagtgagatggtgccactgcactcctgcctgggagacagagctagacgctgtctccaaaaaaaaaaaaaaaaaaagaaagaaaaagaaaaatgagttcgggggaaaaaatgggaggacttttacaatttatgtaaccaaactactgtgggaagacagtaactggcgcaggcactagaccactgaggacattgtcatttttttgcctcccaggcctgcttttctctgcatgtcctgttcagtctctcagaccacttttctccaccaatccgaaatgatgctcctatcaagaccttaattcacaccttctcaccttcatccgagagaggaaataataaattactactgttaaaataatatttatggtaggcaataaagagctagctagagtatttctggaaaataaatgctgcctagttcagaaaatcatgagaaagaactgttgcttgggccagcttggaacaggcatcagtctttatagatcagttactgtggatagaagacaaggtcgtgtaaggacatgacagctcccattttggctcacttgcttagagtgaacaggaaagaaaggagcagctaagcaataaagttaaacactcaaatatatttgcaatcgatcacatagctgaagtatcacatatatctggagacttcaaaatccagttctctaggcctgagaactatctagaatttcagactaccttcttgacagcttcacacggatgtctaattggtgtcttaaacttaggaaaaaattcttggtttcttcctcaaaaacctattcctttgtagttttccccgtctcagtaaataccatcagcactctgttgctcaaacaaaaaattctgggaatttctgttgattactgtctctcatcacccacatttaatctattagcagattaattatgtcaaggtaacctacaaacacatccagaattaccccccaatcccatttctgtctccactactgccagcccagaccaagctactttcatttacagccagtgtttttctttttaaacctgtatcatattatccctctccccttaaaaccatctagttgtttcccgtaatacttagaataaaatcctaactcctttttctaatttacaaagcccttatatgatcaggaccctgcctacttttcttcaacttaatcttctcatggcctctataggatactgactttctttttgttgtttgaacgctactaactcattcccattttaggtcctttatataagatctgcctgatatgctcttcacctgatctttgcaaggctggcttcatcgtgttactcatatcttaatatcactaaatgctaatttccattaagtgactgaatggcccaatcaaaaatagtcatctggttaatctcttgtcacatcagactactataattctctgtacagaacttaccaaacaaggtatttgtttttctgtccctaccctttaaaaggtaaatttcagagctgggtgtggtggcttatgcctataatcccagcgctttgggaggccgaggtgggaggatcacctgaggtcaggagtttgagaccagcctaaccaacatggtgaaacctcatctctactaaaaatacaaaaattcgccaggtgtggtggtgcgagcctgtcgtcccacctactcatgagatcgaggcaggagaatcacttgagaccgggaggcggagactgcagtgagccaagattgtgccactgtactccatcctccgtctcaaaaaataaaaaataaaaagcaaatttcatagaagtagggaccctgtcttgttttctgtaatatctttgtgcaatttgatgaattttaagaaatgaatacatttgtatagttactatctggatcatgatatagaacattacaagtcccccaaaacctcccttcgtgtccattcagaccctaccagaagtaactggtaatctgacctctaacattgcatattagttttgcctgtttctgaaaatcctgtagatggaatatagtatgtactatcttgttcattcttgttcattgctctcatattccattatatgaatatgtcacaaattgcttaattgttaaggacatttagatgactttcactttttagctattataaataaaactacttctgaacattcttgtatatatcttttagtgcacatgtgtacccatttatgttgggtatgtgtatctttgagtggaattagtttggatttgcatgttcattattaaaagataagataataccaaaccgttttccagagcagttttaccaatttatactcccactggtagtgtttgagagttgcatttgcttcctgtccttgacaacagttgatactgtctttttttttttttttttttcttttttttgaggcagcatctcgcttggtcgcccaggctggagtgcagtggtgcgaccttggctcactgcaacctccacctcccggatttaagcgattcttgtgcctcagcctcctgagtagctgggactacaggcatgcaccaacatgcctaattttttttatttttttatttttagtagaaatggggttccaccatgttggccaggctggtcttgaactcctgacctcaagtaatccacccaccttggcctcccaaagtgctgggattataagcatgagccaccgcacccggccttttttttttttttttttttttttttttttgaggcagaatctaactctgtagcccatgttggagtacagtggcatgatcatagctcattgcagccttcaacacctgggctcaagtggctctcctgcctcagcctcctgagttgctaggactacaggcacatcccaccatgcctggctaatttttaaaatatttttggagtcaggggtctcaccatattgcccaggctggtttgaactggtttcaagcgatcctcccacaccccgagtagctgaaattacaggtgtggagccaccgtgcccagctgttattgtcttttttcataaaggccattctatggtatgcagtggtatttcattgtggttttaagttattttccttatgactaattgagcacctttgcctatgttgattaaccattcagatcacctcttttttaaaatgcttgtaaaaatcttttaaccatttcctgtttttctgtattaatctgtaacagttctttatatataagtatcttctccttcttagttgcccttctttctcttaatggtatcttctgatgaataaaagttttaaattttaggccgggcgcggtggctcacgcatgtaatcctagcactttgggagggtgaggtgggcagatcatttgaggtcaggagttggaaaccagcctgaccaacatggtgaaaccccatctctactaaaaatactaaaattagccacacatggtggtgggtgcctgtaatcccagctacttgggaggctgaggcaggagaatcacttgagcccaggaagcagaggttgcagtgagccaatatcgtgtcattgctctccagcctgggcgacagagtgagactccgtctcaaaaaaaaaaaaaaaagttttaaattaaatttatttttttgggttggtccttttgtgtacttgttaagaaatcttggcatacccccaggtcagaaagacactttgttctgttatcacctagaagccttactgtttgatttttcatatttaatcctacaatccagttggaatagatttttttggtatggtgtgaagcaggagtaaaggcatattctggactgcagtggcgcaattcggctcacttcaacctccatctcccaggttcaagcaattctcgtgcctcagcctcccaggcagctgggattacaggcccgcaccaccacgcccagctaattttttgtatttttagtagagactgggtttcgccatgttagccaggctggtcttgaactggcctcaagtgatgtgcctgcctcggcctcacaaagtgctgggattgcatgtgtgagtcaccgcgcctggctctttactgcttttatgtgccacatttttcacaaatcagtggactatatatgtgtaggtctgtttctagattctcttttctgtacaatttggtgtatttgtacttggattagtactgcactatgtcaattattgcagctttgaaatacctattgatatctggtagtataaatcttccagcttcgttcttcttcaaggttatctttgccttccttcacattttgcagttccatatgcattttaatatcagcttctcaccttccacaaataacattggtgcatttgcatactgttttttcctgttcttttttattttttcagtagctggaaaacaacacttaatttgtattctatcataacctacttttttcactcacctttttccatgtcaataaatactttttttgtttaacaatatataatgttctattgttgattccagcatttttcctttacaaataacaatgtgatgtacagtcttaatttttttgtcttttctgtgcctccgtgattattttcttgaaaaattttaagcatttatacttaccataaatattgaataccattagaccatgtgttgcaggaaaaactaaaacaacagttcctggcctctggcttatagtctagggattataaaatatattcataattcactgtaattatgtatagaaatgagaggcagtataataagtggttaaaatctgaattctagtgtcagagtgtttgagtttgaaaaccttctacttgctatctatatgactctaaacagttacttttcttcttcgtgtcctaaacttcttatctgtttgggaaaaaaaaatgagccaagtgtggtggcacatgcctgtagtcccatctactcgggaggctgagcagctgggaggattacttgagcctgggagttcagggtccagcctgggcaacatagtgagacccccatctcttgaaaaaaagaaaaaagtggataaagtaattctaataaggggttgggaggtttagatgaggtaatatgttaagcactctggtgtctaacgcacagtgggtcaattaagtgttattattatgattgtgattatttctagaaaataaggactataattgggtcctggtaattgtcttttttttttttttaatcattttaaagtttttctggaaagagaaagcctctgacatgggctgaaggtgctctctcttctgagtcctaggaattgtacaaataggtactccttggaatctgtgattttcattgtttattattattctagaaaccctaatctgctctaacagtgttgggctcatagtagacagcacatatgtatattaagtgagcaaataaatgaatgtaaatgtgttctagagagactggtttgtgaattgaaagaattgtgatgatctaattaatgttttggtttcaggtttgaaagattagaagtcctggctgtatttgcctccacagtcttggcacagttgggagctctctttatattaaaagaaaggtacatttgtataggatattattctaaatccccccatgacacctttgggaacatgaaagaaacccgtcagacacatttgctttcaagggtatgaaaacttagatgagcagggctggagttttgatagtacactttctttatgtttcagactttttcttctgtttcattttttttacttccttccttaatgctactaaattgaatcagaagtggttgtgaatgaaacagagattcagtcaggcatgtttgatgcttattacaaacccattgaaataggcttggcagagaaagatagacattacatattaaggataatttgtgaaaaaagaaaacaactaaaaaggataatttatgagtctccttgcctcatcactgctaatagttaatagttataatattaaaagattttgtgaactttaaggtgggtgaatgatatatttaataaagctttttaactttataatttataggacttatttaatatatttttatttcttatagtgcagaacgctttttggaacagcccgagatacacacgtgagattttattttcaatatataatttactattgattcttaattattaattgatgtattattaaacagttggccaatgtcagatttcagactgtggcaacataacgtttttgctggtatttcacaaacaaaattccctaatactaagactccgtttctttactcttaacagttcccaagttctaaatatttttatactacacaggaaggcctttctatcttggcttcaggcttctcattatttccaggcctaggaaacactaacccagcttcccctagtcttctgtaatttcaaatttgaccttcaaaatctttgcatagcacctgtagaaaagagaattggacgaggctcagggattcagtgtaatcccagcactttgggaggctaaggcaggaggatcgcttgagttcaggagttcaagaccaacctggacaacagagtgagaccctgtctccaaaaaaaagaaacgtatatatgtttcatatatattgcaactatgtgattttcatatatatatgaaaagagaattgtatgtatcatatatatgaaaaaacaattgtatttctcaaccacagagctgccaactatatggaccttatctattctgatcagtttaattccacaaagtctgacttgtccagtatatcgtaaaacaaataccattgatatttatacagatttataacagcgtttacctgtagcaagatactgttaatgctaaaagtccttacttatcctttgtaagatggagcaacagtagatgggacatgggtgatggggctagtaactaagttcagattctgtatctggaaacaccaaatcattaaagcagaccactttaccttcccacctcttagtccctctacgtattgaaattacatactgataataccaagaacaaattaaaggtgaatgttatcgttgttctttttaggggaagattattagttggtacttttgtggctctttgtttcaacctgttcacgatgctttctattcggaataaaccttttgcttatgtctcagaaggtatgttttttatttactattaatttaaaaatccaactaatctctcataaaaacaagccttttgtttgtttcgttcactcagatcaatgaagaagtatattctgaagacaagagagaactagcccaaatgttctcaagtcttttttaagtggaaaattataaaacaaaatctcattagttcaagctttaaaataacaaattattttaaaacaggcaggagtgacctgtaaattaaatcatgtggtgatgaaaaattacatttaccaaataatgtgagattctaaatgtgtaatctatctaagaaaagtctattgtaagcattttagaagtatcagtatacttagaattcttagttgatatgctaattgaaaataattgtattctgttaataaagtaagttcccaggaacttctctttggcaatggtggatgggcatatatgtttgcaagtagccaaactttatttctttggaaatattcttttattttgaagtatttacaacttcagactgatttttcacttttgcagtctaaattattttcttttttcaataatttcagtgttttggaatcccactaacccacaaaagagttagccactaagagatggagaagtgaggtgaaaatagaagtgggatgtgtgcacagacccacactttgaagtatagagaagcacagataggtgtggatctttttagatctcactctaggatagtcaagagaagaaagttttctgaaatgcccattcaagtttaaacaacttcatgaatgttatgaagataaattgtgtttgtatgagttaaagaagtactgcatgaattagaaaattaaataatgataattaagatcactagaatttcttgaaaaaaattcataatttataaaatactataacacttactctagaaatttttaagatggtgcaaagatttagaaacactgtttccctgtaaagatcagggagatacaagaaggaaataagactactgataatcttatgacccacagataatatgttaacatttctatgttattccttccacttttttgtatgcacacgtacatataattttatgtgcttacttagaattgtatatattacagttttatgcctggcttttttttttttttttttgaaacggagtctcactctcttgcccaggctggagtgcagtggcgcaatcttggctcactgcaacctctgcctccttggttcaaggggttacaggaatgtgccaccatgcctggctgatttttgtatttttagcagagacggggtttccccatgttggccaggctggtctcactcctgacctcaggtgatctgtccaccttggcctcccaaagtgccgggattacaggtgtgagccactgcgtccggccatgtctggctttttgattagcattatgtcttcagtattgcttctcattaaatactctttgaatgtaaatgattttttaatgtttgcataatattgttatgaatattttaaaatattttatacatttctaacttttccttttataaataactctataatcagcctctttagatcaacttcgtctgcattttttattctttctgtaggataaattccccgagaaggaattatttactggattaaaaatacagtatttttcaaaggctttgttgtatattgccaaatttatttccagaaaagttatctagtttatatttttattatattatattatatttatttatttatttattttttaatagagacaaagtctacctgtgttacccaggctggtctcaaactcctgggctcaagcagtcctctcacatcagcctcccaaagtgctgggacgacaggcgtgagccactgctcccagcctactttatattttcattagctggaaatggaggttcccagaaacatcaagatttgtgacattagctgggcttggtagcatgtgcctctagtcccagctactcaggaggctgaggtggttgtattgcttgagttcaggagtttgagttcagcctgggaaacatagcaagactctggctttaaaaaaaaatgaaggctgggtctggtggctcacacctgtaatcccagcagtttgggagaccaagtcaggcggatcacaaggtcagcagtttgagaccggcctggccaacatggcaaaaccctgtctctactaaaaaattataaaaattagccgggcatggtggcaggcgcctgtgatcccagctacttgggaggctgaggcaggagaatcccttgaacccggtaggcggaggttgcagtgagccgagatcacgtcattgcactcctgcctgggtgacaaaagtgaaactccatctcaaaacaaaaaaaaaagaaaaaagatttgtgaaattacttgaaatttgagtgggaaataatattaagtactttctatatgccaagcactgctaaatactttacatagaataacctatttaattctagccaggtaggtacccaggttctcacctggcttttttgagagttgagggaattaatttgtatgtagtttgaatatcccttatctgaaatgcttggggccagaagtgtttcacattttagattgtcttagatttcggagtgtttgcattatatgtatgggttgagcatcccaaacctgaaaatttaaaattcgaaacgctcctatgagcatttcctttgagtatcatgttggtgctcaaagttgtggatttttggttttcagatttgggatcctcagcctgtacctatggcccgttctcagcacactagttaggaagctctgcttaaaagtataaagaactgctgggcatggtggctcacacctgtaatcccagcactttgggaggccgaggcaggtggatcacctgaggtcaggagttcaagaccagcctgaccaacatggtgaaaccccgtctctactaaaaataaaaaattagccaggtgtggtggcacgtgcctgtaatcccagccacatgggaggctgaggcaggagaattgcttgaacgcgggagacagaggttgcagtgagccgagatggcaccactgcactccagcctgggcagaaagagcaaaactccatctcaaaagaaaaagtgtaaagaacctttaaaaccttaaattaatagtaacaatgacataaattccttcaggtcaactgtatattgtataatagttgaaactgcttttgaattagtggcataagggcataaaagaggaaacatttatagatttgaggagtagcatgttcttttgtaatgttattcagtcactgccaaatttattttttaaaattaaagaactcaaatatttcaggtagtggtttttttttcttctatatagataatttaagtattttcttcttaaagctgctagtacgagctggcttcaagagcatgttgcagatcttagtcgaaggtaagatgttatggagtttcatgatatgcataatttaaaggaatacacaagaaatgcatctatcatgggaacttaaattattcgttgctgaggttactacgtgaatcacacaggtcagattgttattctccctttactttttaattgatacaaaagagaactttataaatgaaagggctttgttcacaaatcctctttgctttctttaagaagtacactatgtggtaccaaaatacaagttatcttttacaaggttgtcaccagttttatgtgagttctgctaatggatactctttctgtttgttttttcttagcttgtgtggaattattccgggacttagcagtatcttccttccccgaatgaatccatttgttttgattgatcttgctggagcatttgctctttgtattacatatatgctcattgaaattaagtgagtattttttattgttgtcaagtatgttttgatttctggggacttacttttaagggcatcagcaggatggatagtggtcaagcttctagcagtttcgcttatgtcctgtgtaacttagatcacatcttttccttaggtgtcttcatctgaaaaattaaggggattgggttcaataagtatttcttaccacaatgtataatgcagactggaaaacaatttaaattccctactgctgacctgatgagtgaaacagaaaagagaacagtaagaaagagatctgagccaccactgctattgccgagagagggaggagaagaggacgtaggcgtgaaacaattttttaaaaataaagccttttaggaaataggctttacagctgctttaagcttaacatgttatggcatatgattctttggctacccaccttttaaatattagtctttactagaatttgtccttattgttcttgctgttttatgtattttccttaaaaatcacatgcaagtatttgtttttgtttgctacttctgtgggattcctagatttttatttctagcccacatctctattgaattccaaaaggcgtatcttcctgacttctataggtgtctactttaactgaacctattttcccttaactctgaaactgttttttcttctatctcccatctcagtgaatgggagatacaagaaaaatactgtcatttatgccaatgcattcttattttaaattgcattaaaatatacataatatagagttggcttttttctgagatggagtttcgctcttggtgcccaggctggagtgcaatggcatgatctcagctcactgcaacctccacctcccgagttcaagcaattctcctgcctcagcctcctgagtagctgggattagaggcacctgccaccacacctggctaatttttgtatttttaatagagatgaggttttgccatgttggccaggctggtcttgaactcctgaccttaggtgatccacctgcctcggtggctcatgactgtaatcccaacatagagttttttatttacattgagtgtacaatttggtgacattgcatgcagccattaccaccatccatctccagaacctttttcctcctgccttccttaaattccatgctcattaagcagctttccttttcctcctcctcacagcccctggaaaccaccattctagtttctgtctctaggaatttgacttctctaagtacttcacagaaatgaaatcatataatatttgttcttttgtgtctgcttatttcacttagcataatgtcctcaaggttcatctatgttgtaacatgtcagaatttccttcctttttaattggaatgctgaatcacattttccaatgcataatgggtaaacaatgcattttgtttacccatttatccatcagtggatatttgaattggttgcatttctttgactattgtgaataataccactgtgaacacgagtgtacaaatatctgagtccttcctttcagttcgtgtgggtatatacccagaagtgaaattactgggtcatgtgatatgataattctgtatttatctaatttatttaattttttatttttgtaggcacatagtaggtatatatatttatggggtacatgagatattttgatacaggcatacagtgcataataatcacatcagggtaaatggggtatccatcacctcaaggatgtattttttctttgtgttctaattatgctcttgtttattttaaaatgtacaataaattattgttgactgtagtaaccctgttttgctatcaaatagtagattttatttattctaactatatttttatatccattaaccatcccccacatccccccaatattttagttttttgaggaactccagtgcatcattaatacccacttttcctccctcctcctctctcaccactccccaagccatttctaattcgtctccaagccttgtgtaattgtttattaatatttatttatttggctgggtgcggtggcttacacctgtagtcccagcactttgggaagccgaggcggctgggtcgcctgaggtcaggagttcaagaccagcctggccaacatggcaaaaccccgtctctgctaaaaatacaaaaattagctgggcgtggtgatgcacacctgtaatcccaaccacctgggaggctgaagcaggagaatcgcttgaacccaggaagtggaggaggttatatatatatgagacatatatacacacacacacacacacaaatataaaatatgtgttgatatatatatataaacatatatatatgtttatttgtcccctctttcccattctcattgctgctgtccctattaagacctttatcatcatttctttggcctaattagaatagcctctggtcttctagttttcattcttatccattgctagttaccttttattttgtcactaatgtgatcattcaaaattgctagtttggagataatatattcctgtttcaaaaccctccccttgaggtgtacccaacagctcattgagaacgggccacgatgacaatggcggttttgtggaatagaaaagggggaaaggtggggaaaagattgagaaatcggatggttgctgtgtctgtgtagaaagaagtagacatgggagacttttcattttgttctgtactaagaaaaattcttctgccttgggatcctgttgatctatgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactctgcctaggaaaaccagagacctttgttcacttgtttgtctgttgaccttccctccactgttgtcctgtgaccctgccaagtccccctctgcgagaaacacccaagaatgatcaataaagaaaaaaataataataataataataaaaccctcccctttgcatagttgcaaaaattgaagttgtcagcacagagtcctgagtaatcaggcccctaccaaccttactaaccatccatctatctattcctgaccatttgtggttttattgctgggtcagggttttcatgcccctgcacatgctgctttcacttgcctatctttgaagtctctgcccaaatgtcaccttctggattatctccaccccaggagccttgtcactcaatcttttgtgcggccatggtactctgtagacatttctgccttagtgcccaaagtgcttcattatgtttttcacatgtgtatctcctgttatttctagggcaaggattgtgtctcattcacatttctatttctagcatgtggggaaaagtagaaaagagtgcacaatcagcttgtaattattggcattttggtctgtattgttggtagaacttcagccagtttgaattgttgatgttgactacagtgttaccataaaaaattcctggagaatcttacctggtgaaattcctggggaatttgaagtcttattagaaataattatcgctcactggaaacttgatataattactgatagattccattagtctttctgtatcaaaaattactagttgaatgacacacagccacggctgagtggctgccctgcccctgtttcctttcacgtttttgctgcatgtaggtggttgtggccactgtgcccggagggaggcagcagtggccagtaatgcctgggaaactcctctgggggtacattatggaactggaagcacccttggaggagtccgagagccagaagaaggagaggcagaagagctttatggatatcacagtttcggctaatggattatggacctgtacttcccttatatggtttttatgaagatttaaacaagataagctgaaaatacattacacagtgctggagtgacagaaggaagtcaagccaccattatgactcagatgagaaatcagaaacaagagaaaatggtgttacagattacctggatgctcccaagaccaaaaaaattaaaatgaaagagaagctaaatggagacactgaagaaggatttaatagactttcagatgaattctctaaatctcataagtcaagaagaaaagatctactgaatgagatattgatgaatatgaaaaaaaaaaagcaagtatcatccttagatagttctactcatgaatcaagtgataagaagctagaggagaccttaacacatgaacagaaagaaggaaccttctccaatcttcctatttctgaagagactataaagcttctgaaaggttgaggggtaacatctctctttcctgttcaagttaagacctttggtcctgtatatgaaggaaaagatttaatagctcaagcacagacgggaacaggaaagaaagacattctattttgcgatccctttgattgaaagactccaaagagatcaagaaacagttttttgtttgtttgtttgtttgtttgttttttgagacagaatctcgctctgtcgcccaggctggatctcggctcactgcaagctccgccgcccgggttcacaccattttcctgcctcagcctcccaagtagctgggactacaggcacccgccaccacccccgactatttttttttgtatttttagtagagacgggatttcaccgtgttagccaggatggtctcaatctcctgaccttgtgatctgcccatctcggcctcccaaagtgctgggattgcaggcgtgaaccactgtgcccagctctgattggatctttctaaactgtgccatgttgtgcttgatgaagtggatcaaatgttagagttaggttttgctgaacaagttgaagatattattcatgaattctacaaaactgattctgaagacagtcctcagactttacttttttctgcagctcgcccacagtgggtatgcaaagttgcaaaaaaatgagtgaaatccagatacgaacagattgatgtttttggaaaaatgactcaaaaggctgcagcttctgtggaacatttggccatccggtgtcattggtctcagaggccagcagttactggagatgtccttcaagtctacagtgggtctgaagggacggctattattttctgtgagacccagaggagtgtaactgaaatagccatgaatccacacataaaacagaatgcccagtgtttacatggggacattgcacagtcacaaagagaatttacactaaaagacttcagagaaggtagttttaaagttttggtggcaaccaacgtggctgcctgtggtttggacattcctgaagttgacctggtgattcatggttctcctcctcaggatgttgagtctatatccatcgttctggacgcacaggtagagctggacagacagggatttgtatatgtttttatcaaccaagagaaagaggtcaactaagatatgtggaacaaaaagtaggaattacttttaaatgtgtaggtattccttctacaatggatttagttaaatctaaaagcacggatgccataaggtctctggcttctgtttcttatgctgctgttgattttttccaaccatcagctcagatactgacagaagagaaaggggcagtggatgcattggctgcagctttagcccacatttctggtgcatcaggctttgaaccacgatctttgatcacctctgatagggatttgtgaccatgactctggaaagcctagaggaaatacaggatgtcagctgtgcttggaaagaacttaacagaaagctgagtagtaatgcagtgtctcagattaccagaatgtgcctcctgaaaggaaatgtgcgtgtttgctttgatgttcctacaactaagtcagaaaggttacaggcagagtggcatgattccgactggatattctcagtgccagccaaattacctgaaattgaagaatattatgatagaaacacatcttctaattccagacagaggagtggttggtcaagtggccagtcgggccgatcaggtggtcgatctggcagccggtcagttagacagagtccacaagggagtcgctcaggaagttgacaagatggtagaagatgaagagggaatagaaatcgatcaagaagtgggagccacaaacggagttttgactatttgatagttaatctaccagtatgaggttgcctatttctgcctaatcatgtatattatgcaccaaaaattaggtcatcatagttgaggtatgtgtctgctatttgcaaataaattggtcatatttttttaaaaagtatttcacaagaatgattgtaaacagatctacttaccagttatacctttgaattaaaaaacctctttttattgtctctttttaaaaaaaaattactagttgaagttttttgtctgtctcaagcaaataaacatatttcagctctttctagttgacagatagtttgacaaaaaaatgcctgacggggaaatgtccacattttttttcatcatacctcttcctactaattaacataattattagttatttttccactaaactttgaaaggaaagaattctaaaaactggagtatttttctttgaaatgtttctttgcaagtagtggccaattgtgataaaattgtgtcctgttgctcagtcctgttgctttagataattaatgttcaggagatttaattgtaatatgcccagtgagatataaatttaaaatttagaattgttttttccttttagtaattattttgccgtagacactgcctctgctatagctattgccttgatgacatttggcactatgtatcccatgagtgtgtacagtgggaaagtcttactccaggtaaggtgcttcttccaatgcacgtgcttaatattagccatgttcttctaccagattaaaaagttgtatgtgttgttctacaagattgtgaaatttttatttttattttttaattttaatttttttttttttttttttagagacaggtccttgctctgtcacctagactggagtacagtggtgggatctcggctcactgccgccttgacctcccaggctcaaaggaccctcccacctcagtctcctgagtaacaaactacaggcacacaccaccacacccagctaatttttaaaaatatttgtagagatgggctctcactatgttgcccaggctgatctcaaactcctgggctcaaatgatcctcttgctgcggcctcccaaagtgttgggactatacgcgagagccatcgtgcccagtcataatttttaattacaaaagttttttggccaggagaggtggctcacgcttgtaatcccagcactttgggaggccaaggcgggcagatcacaatgtcagtagttcgagaccagcctggccaacatggtgaaaccctgtctctactaaaaaaatacaaaaattagctgggcgtggtggcgtgcacctgtaatcccagctactcgggagactgaggcaggagaattgcctgaacccgggaggcggaggttgcagtgagctgacattgtaccactgcatccagcctgggtgacagagcaagactccatctcaaaaaaacaaaacaacattttttttaatgccctccctttaacagtacagattgtgaaatttttagttactggaagcccctgctagaaatgaagtcaaacaataatctctgacattcatatagtcagaacctgatgaaagtccattagcaagtaaaatagtcacaaatcttcctatatttatattgtgacaaaatcacaaatttaaagctattattatttttcaagtgaaaagaatgttacttcttttttttttttttttttttttgagacagagtctctctctcttgaccaggctggagtgcagtggcgctacactcaggtcactgcaacctttgcttcctgggttcaagcgattctcctacctcagcatcccgagtagctgggactacagccatgtgccaccacgcctggctaatttttgtatttttagtagagctggggtttcactacattgaccaggatggtctcaaattcctgacctcaggtgagccacccgccttgaacctcctaaagtgctgggattacaggcgtgagccactgcacccggcctgaaattttttttagatatttattttccctcagtaaatgtgctttggcttttgtgtaatctgcttatgactattttattatttcctgccactgaatcagtgagactttaaaatttcaaacttaaaatcttaaatgacacattgctacttactgaaatgataggaacaccctgaatatgaatagaaaggcagtttccggccgggcgcggtggctcatgcctgtaatcccagcactttgggaggccgaggtggttagatgacgaggtcaggagatcaagaccatcctggctaacacggtgaaaccccatctctactaaaaatgcaaaaaattagccgggcatggtggcgagtgcctgtagtcccagctactcaggaggctgaggcaggggagtggcttgaacccgggaggcggagcttgcagtgagccaagattgcgccactgcattccagcctgggcgacagagcgagattccaaaaaaaaaaaaggcagtttcccagggccggatgtgcgtgtaagcactgtggttccttctgtcttaccctatgccttttccaagacttagggcagtagttccatctccagaaaaaataaaaataagataatagttgcatagtgctatgccctatacaaaatacgacctttgtaaccatttcccaaagattttttgttggttggttggttgtttaagtgttatttatctttttatcttatcttcaagataaaaaaacaggtgtgggccagttgatgatgttgttccactagtggggccagttgaaacctctcttctctaaatcatgataggacagctgtcaaagcaaaggctggcttaaaatccttttggggagggggttcaggaccattgttggcaaacttttttccttcccccattattcatattttattgtatttttccccagacaacaccaccccatgttattggtcagttggacaaactcatcagagaggtaagatggaatagtaaataaaatcattttattttatatcagggaattgaaaaggtggatacttttaatactttattcaactctacctagaattttatttgagggaagttcatgttcttcacaataacatactaggagccataatatagtggcaaacgtggaaaaatatgaggaattgttcaatttggaaatcaaattcacttgaagtgaatgtggaaggtaatggcctaatgaccaccctattataaatgctatgatttttatttattttatttagttatttagttattttttttttgagacagtcttgctctgttgccaggctgtagtgcagtggcgcaatctcagctcactgcaacctccacctcccaggctcaagcaattctccttcctcggcctcctgagtaggtgagactacaggcgcgtgccaccatgcccagctaactttttcttttttttttgagacagagtcttgctctgtcgcccaggctggagtgcaatggtgccgtcttggctcactgcaacctccgtctcccaggttcaagtgattctcctgcctcagcctcctgagtagccgggactacagatgcaagccaccatacccagctaatttttgtatttttagtggagacagggtttcgctgtgttggccaggctggtcttgaactcctgaccttgtgatccacccgcctcggcctcccaaagtgctgggattacaggcatgtccacagcgcctggcccgcccaactaacttctgtattttttttttttttttttttttttctgagatggagtctcgctctgtcgcccaggctggagtgcagtggcacaatctcggctcactgcaacctccgcctcctgagttcaagtgattcttctgcctcagcctcccaagcagctgggattataggcgcccaccacatgcctggctaatttttgtatttttagtagagacagggtttcaccatctcgaccaggctggtcttgaactcctgacctcgtgatccacccacctcgacctcccaaagtgctggggttacaggcatgagccaccaggcccggcctaacttttgtatttttagtagagacggggtttcaccatgttggccaagatggtctcaatctcttgacctcgtgatccacccgcctcggcctcccaaagtgctgggattataggtgtgagccaccgtgcccagcctgttttttgttttttttgagactgagtcttgctctatcacccaggctggggtgcagtggcatgatcttggttcactgcaacctccgcctcctgagttcaagcgattctcctgcttcaacctcctgagtagctgggattacaggctcccaccaccatgcctggctaatttttgtatttttagtagagacgaggtttcaccatgttggccaggctggtctcgaactcctgacctcaaatgatccgccccttgtgacctcccaaaatgctgggattacaggcatgagccactgtgcccagccttttgttgtttttttaaaatatatatataaaaagagatggggtcttgctatgttgaccaggctggtcttgaactcctgctctcaagccatcctcccatcttggccttccaaagtgctgggattacaggcatgagccactgtgcccggtcaaatgctgtgattttttttttttttccagggggtacagggtcttactctgccacccagtctggagtgcagtgccgtgttctctgcttcccaccggctaattgttgtacttttttagtagagacagggtttcgccatgttggcctggctggactcgaactcctggcctcaagtgatctgcctacctcagcctcccaaagtactggaattgcagacatgagccaccatgcccagcctagactttcttttaagttgttacaaatttccacctactaactaatgaagaaataaaataatgaactattttgatgttgaaactattttaaacctttgattgtcagtgtgacagaggccacttttaccagtataactggctactactctcaactagtgaagcctggccttgagtatgtgtcctgtgcaactgtaccagtgggctacacactatatatctggccttggaatttcttctagactcacatccaaacaacatcctgtgttgtgcagagatttgttataagggatttcagagaaagaagtgattgagaaaacaaaaaaattaagtaaaaaatctgataccacaaagtgctagatataaatatattccatattgatatgaaaagaaccatacactgttgaagaaattggttggggtaggggtttaaaactgagcagtggggacctgattctaaaagaattggggcaagcaagaaacgaggaaagcaaggtcttgggtcagtatggaacaaacaggaatggtatcttgagtggtctgagacttctcttagctaatgagtgtccttgtgcaggatttggctgtcattcttaagtttaaactaagtccataatgtgactaaactgcattggatatgttaagtacagacaactctgatcacctctttctgtttttggtaggtatctaccttagatggagttttagaagtccgaaatgaacatttttggaccctaggttttggctcattggtatgttcttttacatatgactttagttataatttaaaatatagtcttccatttttaaaactgaaaaaaaatatttccttaaaatttttatagagcctttgattcctagttatgttaagcagagtctaaaatgtacatgaattcaattacctaattgagggattttttggtgtttagagacagggtctcactctgttgcccaggctggtgttgaactcctggcctcaagcagtcctcccgccttaatctcccaaacaatagaggaatgtttttattttttttccatcaaacatgttaatgataataatacaggagtgtccagataagacaaatttgtagtcagtgtaatttccaaataagaaaatgttaaaaaaaattaaaagtgcaattgctttcttttttaactgtagttctcattttggagagtttgctgaatattttgaagaactacagtaacacaacttgcttcagcataaaatttcgtattttctaattcagtttgaacctcaataccagagagactttattatgacacggttttactcgtacgttaggaatgatgaggaaaatacagaaaatgtaaagcactataatcttatcatctaaagaaaactgctgttgatattttggtgtttatacatttattttccttagaaaatgagatcacgggctgggcgtggtagctcacgcctgtaataccagcactttgggaagccgaggcgggcagatcacctgaggttgagagtttgagaccaacttggctaacatggtgaaaccccatctctgctaaaaatacaaaattagctgggcgtggggtgtggcacacgcctgtaattccagttactcgggaggctgaggcaggagaatctcttgaacccgggaggcagaggttgcagtgagccgagatcacgccattgcactctagcctgggtgacagagtgagactctgtctccaaaaaaaaaaaaaaaaaaaaaaacaacagaaaatgagatcatgctgttttataattagctctttttgtttaattaatttatcatgaacagttttctatgtcattaaatactcttctacagtatcattaaaaaaaacagatagggtttgatttttctaatataacacaaattttatagataaacagatcaaagctggtctagcagttcaatgatattacccactttgcagtctttagtttcaggctatgcttttgtagtgggaaaatggttgcttcacctccaccttccccaactctttccctctctcattattttggatgtctaaaacttattacaagaaaaacttgagactgtaacatcccctccctccttactgggaaggtgccaaatgaccagagtgtcaagagaccaaagaatgacttggacaggtccagcatggccagtaggtgagtttgttaggagttacctatggggcactcctgggaagcaggacagctttagagatctacccacctcccatttctaagctgcttttaagctaattttctcgctctttgcctgctgtatgtgtgtaatgagactgttttccttggtagggtctcagatgctctctaaaatctttggttctcagggtcgcttgctcctcgactgtacaccatggctttggctcattgcctggccttcagagttcgggcagcggacatacatcatcgaataacctagtgggggacccaccacactacacttctttaaattctttagaaggggccgttgggaacaatattctctaaattcttgaatgttgaaagcagcttgtggacattataattaaaaattagtttgattggatataaactcttcagtacacatttgtttcaagtttcttaaaaacacattatcccttttatttctggcatgaagcatttctgagacaatgcctaatgatagtcttaatttttttccttttatatgtcacttggtctttttgcctggatgcccaaaagatttttttttaagttcagtacctttactagaatatgtcttggcattggtcattctgcatgagttatttcaggtatgcagtgcaccctttcttctttttttttttatttttatttttgagacggagtcttgctctgtcgcccaggtgggcgtgcagtagtgcaatctcggctcactgcagcctctgcctccagggttcaagcgattctcctgcctcagcctcccgagtagctgggattacaggcacgcaccaccacgcccagctaatttttgtttttttttagtagagatggggttttaccatgttgaccaagctagtctcagactcctgacctcaagtgatcctccctccttggcctcccaaagtgttgggattacaggcatgagctactgcgctcggcccacagtgcacgcttttgataatgctgtttcaaaaataattttttaaaacatctaattgtattttgtaatatttgttctattctctttctttggttttcttttgtggaaacttctgttatgtgcatgttaaatatgttggatctttgcctttcttactgttattttctttcaaattcttatcttttaatttccttttgattttttttaaccttttgtgtctcttaaagtatacctgtatgtttccttatgtttgtgtttgttctgagtaagtcttcatttctaaagtgatctttttttcttgtattacaattgtcatctcatttctaaggttttctaattctgatttatggtcttgttttatatcttttgattggtttttaaaaagtaggttatagtttttatctgacatgtagttttatctgtctggtgatcttttataatctgttttatagtctctttttcttacataactttgtgtgggatttgaccctctcttcttttctgttgctcatttttatgtgaaattagttttcctgaacattaaaattaggagtggtttagggtagtgtgtacaaattcatgggtctagagctccatcttctgatgattttgtgaacgaagaaagatttttgttctggctttcttcctctctgccatttttaccttttttttttttttttttttttttttttgagacagggtctcactctgtcgccaggctagactgagtgcaatggcttgatctcggctcactgcaacctccgcctcccaggttcaagcgatcctttcacctcagcctccccagtagctgggactacaggtgcatgccaccatgcctagctaatttttgaattttttggtagaaacagggtttcaccatgttggccaggctggtctcaaacttctgacctcaggtgatctgctcttggcctcccaaagtgctaagattacaggagtgagccactgtgtccagcatttttttttttttttttttttttttttaaggagacagcgtcctgccctgtcacctaggctggagtgagtggtacagatatagctcactgcagtctcaaatgtctgggctcagatgatcctcctacctcagccttcccagtagctgggattacaggtacacgccaccatgcccagctgatctttttaattttttttgtagagacagtcttgctgtgttgcctaggctggtcttgaactcttggccttaagcactcctactgccttggcctcccaaagtgttgggattacaggcacgagccactgtgcctggccctgccttacatttttatctgaacttcttctgtcctttgtctcaactgtactactcagtttggattctcttgccaatgtttctttttgatatggagctttttttttttttttttggaggggagctttgcctggttactttcgagactcatagggctcagactattccagcccttattgcagacccagtgtatttgcccactgttgtaatgtgcaaaactcctcccagttgcagctgcttttctcatattggctgtcctagatttccattaagtcttgttagccgctttggggtttttaggtcagtcagatgtgctgttgcttcctgctgcacagattgtgttaccttgaaggtcttacaccttttatttgggttttcataagggtactaggttactttctttgttttaatggaaatatttgaggcatttcaaacactgccaccactgctgccatcttgcaagaatcccaacataatttttagttttcttagttttacattatctaaatatgccataatttatttcataagtcccttagtgaatatttagattctcttctatttttcctatattaacaggtctaggataaacttttttttttttttgtttttgttttgagacggagtctcacactgtcacctgggctggagtgcaatggcatgatcttggctcactgcaacctccgcctcctgagttcaagcaactctcctgcctcagcctcccaagtagataaaaactagaaagaagctatctgtgaaactgctttgtgatgtgtagattcatctcacagagttaaacctttttattgattcaggaggttggaatctctctttttgtagaatctgcgaagagacagccgggattacagatgccccaccatgccccacgtctggctaattttttgtatttttagtagagatagggtttcactgtgttggccaggctggtctcgaactcctgatcttgtgatctgcccgcctcggcctcccaaagtgctgggattataggaatgaggcaccatgcccagcctgggataaacatttttatgggataatctttgtaaatatccatgattatttcttaagattaatttttagaagtttttgtaaatctgaaaatattcacatttttatggcttttgatgcaaattcccaaattgccttctagaatgccttttagaactacacaccttgagtcttatgttcatttttaaccattctttcctttatttttttaattaattaattttttaaaatatggaacgcttcatgaatttgcatgtcatctttgcacagaggccatactaatcttctctgtatcgttccaatttgagtatatgtgctgccgaagtgaccacttaaccattcttttaattgcgttaatgacattggatggcttataaacacaaagaatatagtcatcaactcagaacttggcatctagaaaccacacctatgaagtccctggttaagacccaggaatttaataaaacaagcttttgagctgctaaaagttaatatcacaaaagccatagattaacgcatgcactgtaattataggagacttttcaagttcatactctgaaaacagagtttccttattttaattactttgatttccatatcagactgaaagaggatatggcatctttaatacttaggtagtgacaactgtgaatggtagtggcaaaagaaaagggaaaaatcaaagatgacttgatttcaagacgtggcttgtcttagctaaaagtaataaactggaagtcaaattcaaggaatatagatattttctctgtctcatgattgacagtagctctcttactatttttctgtattttgtatttcaagtcatagattcagatacagtgttactaaacaatttggctaatttatgtgcagtttatgttttgtaagaatttttttcttttttgaaaatctgtgtttatttagagaccaacatggagtgtctgctggacattttatttaattttatttactctctttttttgagactgggtctggctctgttgcccagcctggagtgtagcgacatgatcttggctcactgcaacatctgcctcatgggctcaagccatcctcacacctcagcctcccaagtagctgtgactataggcgcgcaccaccacgcctggctaatttttgtattttttgtagagatggggttttgccatgttgtccagtctggtctcaaactcctgagctcaagtgatccatctacctcagcctcccaaagtgctgggattacaggcatgagctaccatgcctggccatctattatatatatatatatattttttttttttttttaagttcttattaggcaaatagtacccaattgttaagaaaataaaaacttgtaactaagtcataaaaaagagagtaaatatccttaataattctgccatctagagataaatattgtcatccttgatacttgtctctgttcttctgttttttatttttctttatttatatcttattttattttttatttattgagacagggtcttgctctgtcacccaggctagagtgcaggggtatagtcatggctcactgcagcctcaaccctctaggctcaagcagtcttcctgcctcagccttcctcgtagctgggactgcatatgtgtgcctggctaatttattttttataacgatagagtcttgctatgtggtccaggctggtctcaaactcttccttaagcaatccaacctaggtgcccatcaatcctaggtgttattgggcacctaggttgatgccatgcctttgctgtgtgaatagtgctgcagtgaacatccaagtacatgtgtctttttggtagaaagattattttcttttggatatatacccagttatgggattgctgggtcaaatggtagttctgttttaagttctttgagaaatcttcaaactgctttttagagtggctgaactgatttacatccccaccaacagtgtataaacactcccttttctctgcagcctcaccagcatctgttgttttttcactttttaataataaccattctggctgggcgcggtggctcatgcctgtaatcccagcactttgggaggccgaggcaggcagatcacctgaggtcaggagttcaagaccagcctggccaacatagcgaaatcctatctctactaaaaatactaaaattagctgggcatggtggcgtgggcctataatcccagctacttgggaggctgaggcaggagaattgtttgaacccaggaggtggaggttgctgtgagctgacattgcgccactgcactccagcctgggcaagagagcaagactctctcaaaataaataaataaataaataaataaataaataaataaataaataaataataataatgatagtagccattctgagtagtgtaggatggtatctcattgtggttttgatttgcatttctctgctgattagtgatgatgagcatttttttcatgcttcttggccacttgtatgacttcttttgagatgtatcttcatgtttttttcccattttttaatggggttgttttttgcttgttcagtttttaagttctgtatagattctgatatcagatctttgtctgatgcatagtttgcaaatattttctcccattctgtaggtgtttcttggttgtctcgcaagattcttacagttttgaggtctgtttttttttttagacgaagtctagctctgtcacccaggctggagtgcagtggcatgatctcagctcactgcaacctctgcctcctgggttcaagtgatttttccttctcagcctcccaagtagctgaaactgcaggcatttgccaccacgcccggcaaatttttttttttttttccatttttgtagaaacagggtttcaccatgttggtcaggctggtcttgaactcctgacctcaggtgatctgcctacctcggccacccaaagtgctgggattacagggcatgagccatagcaccctgctgaggtcttaaatttaaatctttaatccatcttgagttaatctttttatatggtgaaagtgaaggtccagcttcattcttctgcatatggctagctagctatcctagtaccatttattgaataggtagtcctttccccactgcctatttttgttgactttgtcaaagatcagatggctgtaggtatgtggctttatttctgggttctttattctgttccattggtctatgtgtttgtctttttaccagtaccatgctgttttggttactgtagccttatagtttgaattcaggtaatgtgatgcttccagctttgttctttctgcttagaatttctttggctatttgggctcttttttggttccatatgtattttaaaatatttttttctacttctatgaaaaatgacattggtagtttgatagtaatagcatggaatctatagattgctttggacaatatggccattttaatgatactgatcttccaatccatgagcgtggaatgtttttccatttgtttgtatcatctgtgatttctttgagcagtgtttcatagttctccttgtagagatctttcacctctttggttagatgtatttctaggtattttatttcttttgtggatattgtaaatgggattgaattctttttttttttttcttgatacaaggtctctctttgtcacccaggctggcgtgcagtggtgcagccactgcagcctcgacctctaaggttcaatcaattctcccacctcagcctcctgcgtagctgagtagctggcactacagatgtgtgccaccacgcccagctaattttttttattttttgtagagatggggtttcaccatgttgctcaggctgggggagtctgtgtgtgtgtgtttgtgttaaccaaaataggatcatttgctgattatctactttaaaaacataatttatggaccgggcatggtggctcacgcccgtaatcccagcactttgggaggctgaggcaggaggatcgcttgaacctaggagttcgagaccagcttgggcaacacggtgagacctcatctctacaaagaaaacaaaaaaacaaaaccaaaaaaacccataatttatggtaaacactttttcaagttaacaaatatacttctaactctcattgtaatgcctggtgttctctatcccttagaagccttgatatcatctttgatgagtcaatcttcctcatcctttacttccagctgggtatcaagtccttccattactacctctggaatatgatatatctgtctgtccctctctgatcccactatttttggcctggctcagctctcctcttttgttttgttttgttttgttttgttttgttttgttttgttttgttttgttttgtgacagagtcttgttctgtctcccaggctggagtgcagtggcatgatctctgctctctgcaacgtctgcctcctggattcaagtgattttcctgcctcagcctcctgagtagttgggattacaggtgcatgccaccatgcccagctaatttttgtatttttagtagagacgtgatttcgccatgttggccaggctggtctcaaactcctgacctcaggtgatccacctgccttggcctcccaaagtgctgggattataggcatgagccactgcacttggcagctctcctcatttataatctagattgttgaagtttttttcctacctgatttccagtcatctatacctacaatttttctgaactctgattatttatttctgttaggttgcagatgttaaattgaaattctttatcattttagagtcctctggtagcctctttttaaccttattacctacctatcatttttctttcttccttcttcccttcttctcttcccatgctgggagtgcgatggcgtgatctcggctcactgcaacctccgcctcccaggttcaagcaattcttctgcctcagccccctgagtagctgggattataggcacatgtcaccacacccggctaatttttgtatttttagtggaggtggggtttcaccatgttggtcaggctggtctcgaactcctgacgtcaggggtgatccgcccacctcagcctcccaaagtgctgggattacaggcgtgagtcaccacacccagccctttcctctgtttctccttctcttctttccttcctctcttccttctctccctctcttctctctccctcctccttcttctgccccctgaaatacttggacttcttttttttctttttcaagataggatatcactctgtcactcaggctggagtgcagtggtgcgatcttggctcactgcaacctccgcctcctgggttcaagctgttctcctgcctcggtctgccaagtagctgggattacaggcacacgccactatgcctggctaattttttgtatttttagtggagactgggtttcaccatgttggccaggctggtctcgaactcctgacctcaggtaatccacccacctcggcctcccaaagtgctgggattacagatgtgagccactgcgcccggccaggacttctttatatattggtattattgcttattcttaccaagtatgccatacattttcattgcttttccctcagtgtggaatgcgtctctactttttgaaattctgtttaatcaccaaccgtagattaaatgccatcttcttttgaagtcctcttcaattggaattaatacctaccttttcggctcttacattgtattttttgtatgtttcatttatattcttccttgtattataatattcctatcttgttcctacatggatatttctttttttgtattttaaagattcacaaattatttaactcattacaatgataatcaccagcaagtagtctttaagaaatattaacattaagctttttctttcaaagaaaatgccaggaacttaccaaatcataaataaaatgttttatctaatgaattttttgttagtataattctaagcaatctctttgttatgattttgccccttttaggctggatcagtgcatgtaagaattcgacgagatgccaatgaacaaatggttcttgctcatgtgaccaacaggctgtacactctagtgtctactctaactgttcaaattttcaaggatgactggattaggcctgccttattgtctgggcctgttgcagccaatgtcctaaacttttcagatcatcacgtaatcccaatgcctcttttaaagggtactgatgatttgaacccagttacatcaactccagctaaacctagtagtccacctccagaattttcatttaacactcctgggaaaaatgtgaacccagttattcttctaaacacacaaacaaggccttatggttttggtctcaatcatggacacacaccttacagcagcatgcttaatcaaggacttggagttccaggaattggagcaactcaaggattgaggactggttttacaaatataccaagtagatatggaactaataatagaattggacaaccaagaccatgatagactctaacttatttttataaggaatattgactccttggcttccaatttatttagtaatccaactttgcattgactgtttaatcatttactctaaatgttagataatagtagtcttgttcacatttcatgaaacctatgaaactatatttttgtaaaatgtatttgtgacagtgaaatcctcgtaaatgttaaaggctttaaataggcttcctttagaaaatgtgtttctttaaatttggattttggtatctttggttttgtagttgactgcagtgtgatgtgaccttacctttataagagccacttgatggagtagatctgtcacattactaagatacgatatttctttttttttccgagacggagtcttgctctgccactgtgcccggccaatacattattattaacttaaggctgtactttattaaggcttccttagtttttgttttgttttgttttttgagatggagtctcactctgtcgcccaggctggaatgcagtggcatgatctcagctcactgcaacctctgcctcctgagttcaaatgattctcctgcctcagcctcccgagtagctgggattacaggcacctgccaccacgcccagctaatttttgtatttttagtaaagacgggggatttcaccatgttggccaggctggtcttgaactcctgacctcatgatccacccaccttagcctcccaaagtgctgggattaggtgtgagccaccgcacctggccgatattttctttaatgaaatttataaatatgcttcttgaataatacacattttgggaaagggaaaaatgtctgttcaaaaagtaaaagtctcttttatagcttttccaaacttaattgctaaatttttctttgaggttctcctgaattatgtcttacaaactaaaagcaaaaatttttagcagaaattttggaatacattctatctagcacaatttgaatttttaattatcaagatttttgttaaagtttctctcctttaaaaattttagtacatttgtaaatagtccatggttctcagtgttttattttgattaagtgactacccaacttttggtgatatgcagtgaaagaatcccaattttctatgttacatttaatcaaatactgacataatgaatttatctttcctgacacattttcattcattggctttttaatttcttattttattaacaaaatatatcagatatattaccaaaacacatggagttccatacataatatggaatttgatgtcttttcaagttgcacaaagaatttgagcatatataattttaccaaagcataatggaccttagattatagaatacagcattgttaggtctgcagtgggcagtttctttttgttttgctttgtcaaaaatgggaaattgttaactgtgatgaaatgtgagaattacatagattatgttattttttagttgttttccaaatgcagagtttaaggactttctaacatggctagtattacttccaaaaagtataacaagcagcagtcacacatgacctaggagggttttttattgttttattttattatgcattccataacagttttaaaatgggattttgagaatggacttaactttcctggaatccaatgctcctggagatttatgactttcccagccatcagccagctatctagagaagatttttgtttttcttttgcaacagtttcttcagtcaactcattcactttcaaataggagcagcactttgaaatcctttttcttcactgtggattaaaaacatccaagaagccatctctgtcaagcagaattgtcatctgtggtaataagtgaccatgtcctaaatacctttttcttagtgaggagttggtcattgtctttggcatctgcaacccctgttcaggcatgtgacctgctaaagaaatacagcctacactaccttgactactggggaaaatgatacttcgtaaaatgtaataaggcaacctgttccttggcctttatcttatgttttccaactattactgtatctgttattggtctactattacaggatgattcttcttcctccattgatctcaactaaatatgaattagggtcatgcatgaaatctgaactgccgtgtcctgagttatggttaagaggtatgtgctgccaccccatgcatgtcttccccatccccataggattttaaagtgttcaggtaccaaacacagttctgtgtgaggttttatgcctacttcctcaacaccaattcagaggcaacacctgtgcatctgtcccaccaaaggtgctttaatacctaccttcactatttgagaaaggacactcacagttgcctgtgggttatgaaagaattggccctacgtcctgcatgtaagatgttacaggggacattgggccaggcattattatatagagaagtcttatttgccaagctctgactaacttctggatatgaaaataaggaacttgcccagcataggcctataggcagcagccttactagtaaatcttgccacagaatcacttgaagctagacagagaaagaagttcaatttaaatatttgtcccattgtttgtgattaggatgtaagctttgtggaatgtaattaaccctgctttacgaagtcaccatattataataggaaaaacactgcctaggaggcaagagatctgaattccagttctgatgctgccactgtgtaaggaagtagttttataacccatgggcaaatcatctgagctttctcatctgtaaagttagggagaggaattaattagttgatctgtaaaataatcagcttcaaaacgttatggctaaatctgtagaatgtatgcccaattgctaaacggatgttgtgcccagaattttatctagtgactacctcaacatacaggccaagcgttacctacaccaacacccaagccattaatttgaggtgccatgagaataggtgaaccacagcctaacaccatttaggtttttgtgtttttttcaggcttgcctctacttaaatatatttagatgagagagttctcttagacttctttctttgtaaggaagggttatttggggaagtgttggaaaaaagattagggcagggtacccttagtttatatagggtacaaaagaatgggaaacatcttccctttcttctttaatctctgaagtcatgtttggaattacatataatgtagcaggtactggagaggacctgaatttcaagcttctgatttagctgtttgtaaacttccaagttttgcttgactaaagaatgctgatcttttttgggagtctgatctccttctaatatcagaaagtgctttttatattccagattgcttgaattaaactgtttggattaaagaacatatatggagtttcctctctggttttaaataatctttctttattcagtagctattaataatttatctcatattcagcgaatatttattgagaatattgttgagaatctcttacatgccaggcactatactaagttaatatgcattcagtataccagttggtgtgacccagaccaaaggtaacacaaagatgaatgagaattccttcaaggcgccgataatcctagtaggagagctaagacacaaaactgttgcatgtttttaatcatcaaattaaacttctttccacgtccttatcttctttggcatccttttgcaagattttttttaactaccaggcttaaaataatgaggtcccagagcacttactggcttcgagtacactttatttaagcagttactagtttaaaagcacctgtaataacactgagatcatcatcatcaaattgccacccaacaagcctagcttcttgcagaaaagttaacttggataacacttggctaagttttctgactaatgctggatcaggtagaaattctttagtactaaagtcaaaaaacactaattgcttaagattctcaaatacacccatgaaggcaagccatccatcactgctcacacgatttcccgccaaattcaactgctggaagtttttcagagggttctttccaaaaaatgcacctgggtaaagaaataagtatattagttggaagaaaaattttttttaaaaaaaaagagaaataggttctacatttattttacatacttttttttcactctgaaatggccatgtttgaaccagtgctttgcctcagaaagaaattattaatataattctctatagctagggcagtgattgtgaatatggtctattatattttcctagagtataagggaatctgataaatagtgattcgtagtgaggtagcaacaatatgtaaatgaattacttttttttccccttttccttactcctaggaaatggaaggttgctttaattaaatattcagtacttgttttcaaaactggagtcaatctttggcaatattaagtcgtttcctcttctgaaaaagtaaacaccacctaactgttgtttctatgggtatgttcctaactgtaaacttgagtaagtgagcctccttcagtatctaaagatttgggtgtttttgtttacctgtttatgtataaccctcccgagcctcttcaggaagttcctccattccttacagaatagggcacctaaagtatttcctacatagggtaggtggatatcctgtctttctgatacacaaagaatgcacacacacacacatacatacaaaggatgtgtgtgtgtgtgtgtgtgtgtgtgtgtgtgtgtgtatacatacacaaatagtttagtgttcattctttatcccatgttaccagtttaggtggtactggaacccaagtgagtcttgcaataagaaaaaatacctttctttcaggttatttaccatcatacagattggccagtatacaacattaggatttcacaaaactagctctgtgttaattacacatattaaattgtgcaaagcgttagccctacccacctacctggccctttctggatgactaagttcaccttgaagtacagagtggacagacaggcagactggacatgggaactcttacttacatgtttatactccagagtatcacacacaaaatgcagaagatgtatgcctggtttatcaatccacattactcggctcatccgagctcatcttagtcttagtgtacctcacccaactttggagggttaatttgttgtatattaaacttgtgtttcttgggagatgtgtaatattagataatgttccagaaactgacccttatggaaatgaaggtccatgattcagtttggattccaagtaggaaaagaggttttaaaagttcctttccattgtctcagtgagaagaccactaaagagttcaagttaaagaaggaaagattcggtgctgtacaaccttaaggttagcaagcaaagactaaaaggtatctgctaccagtaatgagggcttaatgacagaaatggacagtcttgtccgaccagcttacgtgggtgaggtcaacctagttatgcactgaaactatacccttacccactttcagtaaaggtgtttaccagctccgtagtgagaggagatctgtgaatttggtgtctgatgtcactgcatggccttgtgtagtttgttcagtgcaactaagtacattctagagtgtgtccttagtcaatgtcagccaatgcttttatcaccatcataaggtcttgagtttcgaaaggtcttcaggttcttctttacagacacctaaagtgattggccctgcctgaccgtggtcaagatgctagcggctaaagtgggcaaagccaggtaaggagatgattcacagggttctgccttcatgtctcttacccatggtcagtgtcactgacaccatctttgggccttctttgccacttttattaatttgaaaagtgagacagaggccgggtgcggtggctcatgcctataatcccagcactttgggaggccaaggcgggcagatcacctgaggtcaggagtttgagaccagcctgaccaacatggagaaaccccgtctctagtaaaaatacagaattagccaggcgtggtggtgcatgcctgtaatcccagctattcgggaggctgaggcaggaggatcacttgaacccaggaggcagaggttgcggtgagcagagatcacaccattgcactccagcctgggtaacgagtgaaactccatttcaaaaaaaaaaagagaagaaaagtgagacagactgctagttgttcccaaaactgtctctccttattccatagttaatagagttttatttcggcatatggccactcatatcccaacctcccttgctattaggtgtggctaaatttttgccaaggaagtataggcagaagtgatgtgtgcaacttccatgtcacttttccgcttttcccctcttctactaggttgaaatgatcacagggcagtgacctagctatggccataaagtcaaaaataacactcttaaggaatagaggagtaaaaaaaaaaagtaggggtctgggcctgaaagactgcacagaggaaaaccaccccacctgcctggactgctcatttctggactgttacatgatagagaatcaagttctgccttctgtaagccatggtatagttgggtctctgttatcacagcgtagcctatgcccagcccaaatagtacctaggtccttactttcccctgccttccacctcctctgttccttggaggatggctttctccctgctctctcttccatctcatgttcatgtcctttctgcctttgccccttctccatatgcttcccagcatggcatgcactcagtccaaatgctggttgccagttgtgtgtctatttaaggctctttccccaaagatcaactttttttctccttctcagctagcagaacatattttcaccacctaaaaggaatttaagaagaatttaaagcccattccaccctcacagggtgagcaatttatagtggttatctactaaggtataaggatcttatcatcaatttaagagagtttcttagataattattggaatgtgtgctagtgcaggaaccaagaacaaacaacatttgtcataagccaagggcatgccttttgttcatttaatctgcagtgcttatgttatgaggagcagactagatccaagagaaacagaatccatgacatttagagccataggctgtatgtgggctgtggagagtgcaaatggcttgattggaattccaggaaaaatctcagatgccctgggtagaagggttctgattcttgggggttcctgtatcccaaacacaactcttcatttgtgttgtcctgtagttcacctgaacgagtaccagagttctcactgtttattcattcagcaacatctttagtgctactatgtgctgcggattatgctgggtgctggggatatgtgtaaacgacagacatggtccctgtctaaatgggcttacaaaatagtgtgaagacatgcattataaagtaattagatgggtggtgggtgctatggtaggtcagggtaccctgggagcacacaaaagcaataggctttcccactccactttgttcccagaacacttgcaattgggcttatatgctccaggaggaagactggaggattcttaggagaaatggaactgccccccgggaaaaggccctacaaagaaggggccattttgcttgcccaatcaccccctagtggagttagcctgtcaaaaattcaccgcctcccttagacacacagaactccctatcaacttgtgtctccctctaaaatgtgaagaggacagtgcaggattatcagacatttgacaacagcctcccacaaggaagactgagactaaaagccaaaacaactcccaaagaaatcaggcactgtagaaaacaagaaaaatcaaactccaaagacctaagtttttcagagatcctaagtttttcagtagactgcatctactcagcaacaataagatgctaagaaagagcttttggaaaataaaatatgatagcgggatctatacagcagaatgattgggcccaggatttaacacagagcttctagaacatgaatagggtctgcgatggctttttttttttctttttttgagacaggttctggctctgttgcccaggagtgcagtggtgcaatctcagctcactgcaatctgccccactggctcaagtaagtgatcctgccaactcagcttcccgtatagctgggattataagtatgtgcactacgcccagctaatttttgtatttttagtagagacagggtttcaccatgttggccaggctggttttgaactcctgacctcaagtgatacacccaccttggcctcacgaagtgctgggattacaggcatgagctctctttgagaacaggctggatagcagagttcagcttcaaacatccaagttgaaagataccatttaacaaagggttttgttagagcaggtgaaattggtcaggcatggtggctcatgcctgtaagcccagcactttgggaggctgaagcaggcagatcacttgaggtcgggagtttgagaccagcctggccaacatgatgaaacctcgtctctactaaaaatacaaaaattagctgggcatagtgcacacacttataatggcacatacttatagtggcggcatggaccggtaatcccagctactggggaggctgaggcaggagaatcacttgagattcagagaagcgaatagagaacagagaatcccaggaagcggaggttgcagtgagccaagatcgcaccactgcactgcagcctggaacaaaacaaacaaaaaaacaggtgaaatagatacctgagctagcaatgatttttatgttgtagtctcagattgctgatgggtaagaaacaaaattttgggagtcaagcaaaacatggcaaagcttggagatcaaatgcaatctctgaggaagaacagcagatagtctagaccaagctttaaggaaaactagaaacatttaatatctgggtagaggaatcaccattgaaaagaagactgagaagtagccaaggtggcatggaggtcaagagaatgttttgaaaagaagggaatgctcagtgtcaactcctgcggaggaatcaaataaattaaacacttctgaaagtgtctattgaaattcagccacatggaggggtgtggagagtcagatgcaatgagtagaaagtagcagatggtcaggaaatggagatgtcataagggtacataaaatttgttttagagcttttaccttgaaggagaggagagatagaatgataaccaaaggaggaagataggactcagggagagttttatttaaaatggaagagatttgagcaactttaaaaactgacaggagggagtcagtaacaagaggcacagtcaataaaatgatgtccctgaactggagtgagggtgaggctggcatctcaagcactgctaaagagactgcccttaggtaggagaagagaaacctataagctctaaggagaaggagagaaaaaaataacagtcacatcctctgtgaaataggagacgctgagtactgattgagaagaaaaaagtgtgaaatagtttacatacagtgttgaatacagaaacacagtaagattgccaggaaatattaagagagattgtgtttattcactgttttttgtttgtttgtttgttttgtctcccaggccggagtgcagtggtgccatcctgacctcaggtgacccacccgccttggcctctcaaactgctgggattacaaacgtgagccactgggcccagcccccgctattttttttttttttttttgaggtagagtctcactctcccacccaggctggagttcagtggcgcgatcttggctcactgcagcctccaccttctcggttcaagagagtctcctgcctcagcctcccaagtagctgggattacaggcatgtgccaccacacacagctaatttttttcatactacattttttaatccattcattatttgatggacatttgagttgtttccacttttgagctactaaacatgctattataaacattaatatacaagtttttatgtggatattggttttcatttatcttgagtacctaggaagagagttgctgggtcatatgacaactctatgtttaacattttgaacaacttgccagaatgttttcctcagcagctgcatcattttacattctaactaccagcatatgaatttctccgtatccttgccaacaacacttgttattgtatgtcttttaataaaaaataataaccatccctagtgggtctcaggtggtatctcattgtagttttggtttacattattaccctgatggctaatgatattgattatgttttctgctatttattttgcgatttacatatcttccttggtgaaatgtctgttcagattcttgcccattttacaaattgggttatttgcattttttatcagtgagttgtaagagtttttttgttttgttttttgacatggagtctcactctgtcacccaggctggagtgcagtggcgcaatctcggctcactgcaacctctgcctccaggattcaagcaattcttctgcctcagcctccagagtagctgggattacaggtatgtgccaccacgcccggctaatttttttgtatttttagtagagatgggatttcaccatattggccaggctggtctcgaactcctgaccttgtgatccacctgcctcaacctcccaaagtgctgggattacaggtgtcagccaccacgcccggccataagagtttttttatatattcaagatggaagtcctttattagataatgtgatctgcaatttttttttcacattctgtaggttgtattttcactttctttctttttctatttttttttgtggggggggggtgggggactgggtgtcactctgtcacccaagctgcaatgcagtggcatgatcacagctcactgcagcctcaacttcctgagctcaagccatcctcccacctcagcctcccaggtagctgggactacaggcgtacgctgccacacccagctaattttttggagattgagttttgccatgttgctcagactgggctcggactcctgggctcaagcaatctgcccacttcggcctcccagagtgctgggattacaggcgtgagccaccacacccagccttagttttgaccaaatgtctttttttctgttgcaggaactcatccaggataggacattacatttcattgtcatgtctctttaggttcctcatgcttatgacgatttctcacaatcaccttgttttttatttccttgacagtttcaaggaatactggtcagttttgtgtagaagtccctcagttaggattgtttgatgtttttctcatcattagatgggggatatggatctttggggaggaatatcatagaggtaaagtactattttcgtcatgtcatatctaggtacatactatcaacatgaatcaccactgttaatgttgaccttgttcacctgaccaaggtagtgtcaacagctttctccactgtaaagttactcttttttgctgccttttgctgcatgctacaagttttgatatacagcgttttcttaccattcacttctaaatattttcgttgaaatttgtcagtatgaacttgtatttatctcccaaattttgcagtttttccccagtatcctaagtgtagttacaaaattttaaaaagggaaatttaaggacaatccaggcctggggttttgtcaggaaagtacaccccatctactatatttcatttcatacctctcattccacatctcatgttctgcctgcatctcattaggtagtctttctttaattagagactccatctctcattacactcttcatttcaccattgcatctatcacacacatccatcactcaaagtcattgcctgaattgactcatgctactgtgggccatgagaatttcagctattaaagacaagaatgtttgcagggatggaagatggagttgaaactaggtaggaaggcaagtcaaaatagaaagggcctgaaaaataggtagaaggtagcgggatcgacggactggaagtcccagtgaagtaaaagaactggtgattaggagtagatagaaatacaggaggttgtggtttgagaatgggatatctgcatttattattttgcaggtagaacaattttaagtggcttgtcataatctagtcattgcatgctcatagaatgaatggatgaaggagagtggaagggaaggtcgttgaagaggaaggtccattagcggagcatagtggcctctagtcccagctacttgggtagttgaggaaggaggatcccttgagcccagaagttcaaggttagtgagctgtgatcacatccctgcactccagcctgggcaacagggagaccctgtctcaaagagaaagagaggggtgggggagggaggaaggaaggaaggaaggaaggaaggaaggaaggaaggaaggaaggaaggaaggaaggaagggagggagggaaaggaagaaggaagggagggagggaaggaggggaggggacatactgctttcactgtatcccataggtttcagtatgttgtgtttccattttcatttgtcttaagaaattttaaatatatatatatatatatatatatatatatttttttttttttttttttaattgtagagacgacatgttaccatattgcccaggctggtttcaaacttctgggctcaagcagtcctcccaccttggcctctcaaagtgctgggattatagtcatcagctaccacacccagcctatttcaagaaatttttcagtttccttctgaatttcttcattggcacacttgtcattccagagcatgttgtttaatttccatatgtttgtatagtttccaaagttcctctggttattggtttctagttttattctattctattatggtcagagaagatacttgaatcagatttcaattttgggggattttttaagacttattttgtggcctaacatgtggtctatccttgagaataatccatgtgctgaggagaagaatgtgtattctgcagctgttggatgaaatgctctataaatataggtccatttggtgtatagtgcagattaagtctgatgtttctttgttgattctctgtctgggagatctgtccaatgctgtaaatggggtgtcgagtctccagctattgttgtattgggttctatctctctctttagctctaacaatatttgctttatatatctaggttctccagtgttggggacatatatatgtgtgtgtatatatgggaagatgaagaagctctggagatggatgttgtgatagtggcacaataatatgaatgtacttaatgccacaaagcttttacacttaaaaacagtttaaatagggccgggtgcggtggctcaagcctttaatcccagcactttgggaggccagggcaggcggatcacgaggtcaagagttcaagaccattctggctaacacggtgaaactccatctctactaaaaatacaaaaaaaaaaattaggcgtggtggctggcgcctgtggtcccagctcctcgggaggctgaggcaggagaatggcatgaactagggaggtggagtgtgcagtgagctaagattgcgcaactgcactccagcctgggcgacagagcaagactctgtctaaaaaaaaaacaaaaaacaaagaacaaaaacagtttaataaattgtacgttacgtaaactaaacacattttagacaatctgtaagagaaatgaaggcaatcgaggctgttttcacaagtccttggctttagtatgatagcttccaagttgaacctgatgagcctgacctccttgtattaatgtttccatacgctggattggaataacttgtgcaaccagtgggatatgtcagaagtgaccagaaatgagtgggctgccatgttgtgaggacactcacagcctgtgaagaggtctaatgatgaggaagtgaggcctccagccaacagccagtgttaacttgccaaccatgtgagaagctaccttggaaggagatcctccagcagcccctctcatgagagaggtcaagccagagctaacctgctaaactcctaaattcctgaaccacagaaactgtgagataatggttattgttttaagccattatgttttgaggccatatgttatacaggaattgaaaactaatacagatagtatgaaggcttctttcatcaactgcctgaggttggtggtgtcttcagtcatttatatagatctatttgtttctggataatattacagctatttaaagatattttgtggctctatttagatacagctacattcgcctttatatgttttgaatacccagtaagtaacttgaaaatatttcctgatattggagggaggggcattgctgaatttcagaaagttaaggctagtaagagctatgactaatataatacatcttgttggatactgtgaatgcttttcatttaattctgtaggtaaaggaaatagaatctgaaggaaggccagtgttttaagtcttcttactctaacgtgaatgaattcattagacatatttatattttaaaaaaaagaggaagcaaaataaaataagggggcaaaataagcaaagccaacttaagaattttttaagggccaaatccagttatcttggctctgtatgtgtgtacctacctaaaattctaatctctgtatctgtgagtctccagtttttcaacccaagcttgacgagttgtgggacctcctccaaatgtttcaacaggctgctcaggctgccttgcacgtcacagccccagggcagcatcagtgcggtgagctgttctagcacgttcatcctgtcgactggaagaaacaaagagcagttcagggactggatggtctcaaaactgaggaagaacaaaggggtgttaggggaggaatgatctttatgtttggtggctctgcagcctactcaatctgtaatgagaatctacttaatttttggtttttttttggaaagtattcaagcatatacaaacattatgcagaagaatataatgaaactatatatactaataagacaccttcaaaaacattaaatcatgggcaatcttgcttaatcctgacctaattcctcctgtattattctaaagcaaatcatggacaatatgaatcagttctttccttttttttcttttaaccataatcacatatcactatcacacctaaaaaatcatatcaccaattccttaagcaaatttgtcttgcacatcggctactcttgacagttgcctcttcaaaggaggaaagcaggtgggataccgcctcaaagtgcagtgagcatatgtaaactggtgacttaaaagacatgggcctgtgttccttaagggcagtttaagaaaggcctaaatgattttcctaaggagggtgcatctagtaaggcacacatgggtataaaagacctcaggacccaggctatgtatttcgactacccagtatacatattcaagtatctaattttggctgaattgtcattcttactcagttcatgaagagcttcatttccatctttttccaggtaattttctgataaatcaagaatgctcagtttgaccaaattgtgaagattctgagctggggaaaaaaagtaatccaaaataaaaagattttcaggtaaatataaatgtattttgaagtatccttagaataattctgagttttatcttctctgctaatggtagtgcaaaccataacttgccttggttattttaattatttccaaaggctctggtgtaggtgtaacccccaaatcccatggttatgaccaaatgggcaaatagtcattggtcctaggttctgattaatgaattccaggtcacgtagaacctaaagcagcatgggatgtagttgttatgtcatcatggaaaaatcacttggtctctctaagcctcaatgtcttcctctatagaatgaggtagttggaccagataaaatgtaaagttgcttcaattataaaatgccgttaatcatgcaggagaaacaggaacaacaacaacaacaaaaatgaaatgagctggttttgtgtacctcaacttagatgattttattgacataatagttgagatattaataataaaaacatagtaaaaaatggatgagaaaaaaaacaaatagcaaaatggcagattcaaatttatccatatcaacaattacattaaatcttaatggactaaacactccaattaaaaggcagagataatcagatattcagaactttttttaaagcaagacccagttttatgctgtgtacaaaagacgtgtttgaatgacaaagacacaaatatgttgaggtaatggaaaactattttgcatgcaaacattaattatataatagtaccagtctagctaagaattgcttagtgcttttcttcacatattatcactcttgcttaatctagctgaagttttttctgtcagggctagaaaaatctcctttttaaaaaaatcagacaagtttttcatgaatatgtactcttgttataatattggctattattatttttaatcaatcatatgagcccttttcttaaagtatcttctgggttttgtgctctacaataaaaaacctgctgaacttctctttaaaagagtacgtttgctatttgcagttctaagcctgtctctccccatcagtaagtagagaaataaaggcatgtgctcattgttctcatattcccagtacttatccagcctttttcaactgtgggtttctctagctgtaactttatattagtatacaaatggcttccttagttatctttagagactcccagcagttatatagtttaactttaaaaagattataccactgttttccaaaatctaaattttaaaatatgtctgaattacacatgtatagtttatccagaaatatgcagttagtttccccgtagttgatatgcatccctttgggaactcagaaggctcaattatcatatcatgcacattaacttcatcttaacagggcaatgggtaggaattagaagcctgagatcatttaagaaaatctttatctctcacttctcaatcatttatccattcatttaaatgtttattaggcagtaaattatatgaccggttgtgtggcaagtttcaagcacctatttcttattttcttccttttcactttctctaaaaattacatcttcaattattctgaaattctcccctattatccatcaatagttgatttaattctaatatggagaaaaatcattaaaaacaatctgcttattatcgagaagtttttattttccagttttccttaaaattaaatttccatttgagacatttagtgtgaattagtataatagtatcacatgttctgttatactgtcctcattcagttaatggaagcaacagttacctaggattttcactgcatttgcagacaagcagcaggagactaattgaatttcttcaaggtcacagggttcacttgacagagacttgactatgtaatccattccctctccaatgtcagacaagtgggtcaaatgaaataaacacatcttcttcaggtttttcaggccttcagctgaaaaatgatagaaaggaatgcattaggataccaagttaattcgatttaagcatagattaatgaactgaaaagaaagcaaagaataattgtgcagagaccttgccatgttcttcctgcagcgactttaagttacaaagaatcaacgagagctttttttctttcaattctcactttccagtctcttggaccacacaaaaaatcacttatatggaggttattctcttagtagcatgagaaacactgtagtaaatttgtagtctttttaatgggcatcaatgtatactcttaccgtaattctttacatgaatgaagtcttctagagcactctcctttcaatcttctcaaaaatcttaaacagcgggggggctgagttcagggaggtagatgaggacttggctccttggagtgcttctagtgcaactgtctacagcctcaaaagccttgcctggactcatgatatggggcctgcctgaagctttagaatgaagaccacatccactgcagcatgtttaaccagaagaaagatttaccttatatcaacagtataattggaaacattctaaaatatcccccgttcttaagtctaaagctaatgtgcagtttaggattggttaggcctcactttgtgtcattaaaatactgtcttatcttgatggtactgtagcctacgggaaagaaatatatgattttaatgaccaggcatggtggctcacacctgtaatcccagcactatgggaggcagtgataggcgaatcacctgaggtcaggagttcaagaccagcctgtccaacatggcggaaccccatctctactaaaaatacaaaaattagctgggcgtgatggtgcacacctgtaatctcagctacttcggaggttgaggcattagaatcgcttgaacccaggaggcagaggttgcagtgagccaacatctcaccactgcactccagcctgggcgacagagcgagactcccatctcaaagaaaagaaaagaaaagaaataaaatatatgattctaataatatcagtcttgcagagctttcgggaaggttgcagataatgtacgttaacatatttaatgtggtgcctggcacatagtaagtgctccataaatgttcattgttgtcatgggagtatataccggttaaaggttgtgagcatgagctttgcagtcagttcctggatcccctacttaataattataaacttgggcaagttattcaatcttttagctgaagcgttagggatcattatatctatgtactaggactgttgtggggattcaatggaatgaggtatataaaactgccgaggctagtgtctaatctatagcagagtaactctttaataaagagtaaattattactgatataattagactggtttagtcaagttcacattttgattccttaatagcagaagcaggctatcctagagaggtactttttgacctctttctaccagttggtaagatcttgagcaagtcaataagctattttaggttctagtggagttttctgtgaaatgaatgagttgaattagatgctctcaatccccttccagctctgattttctgtgtaatttatacacatgcaataaatgtttattgaacactgaattaatttgattattctcacgtaggacatataaggaaaagaagtcagccatgttttgcttttgtttttgtttttgtttcaagatggagtctatctctgtcaccgaggctggagtgcagtggagcaatctcggctcactacaacctcctcctcctgagttcaagtgattatccttcctcagcctcccaagtagctggcattacaggtgcataccaccatgcccagctaatttttgtatttttagtagagacagggtttcaccatgttggccaggctggtctcgaactcctgaactcaggtgatccatctgcctcggcctcccagagtgctggaattacaggtgtgatccaccatgcccaggcttcagccatgtttggcttataggctagagttgtctttcggcaggaagcagaataagaaagaacaagatgaagggaagagaggagtattttagtgaggactcaagtagggaaaaaaagagccaaaaaaaaaaaaaaaaaaaatccaacacacgagaaaacagggacattcaaggaaagcagctttaacaggaatcctccctggcctgcagggcctggttccctgtggtaagccatgtgttctgcttgtgttcctgaagtttccttttccttttcatttttttgattggggaaacacaacctgcagtgtagaatgaaagcatgcttcccccaaagttttcttgattcacattgtttcctgtgtcctatttcatttatgaatttttttaactatgaaaccatagtataaactttaaaatattgtttctatgcaactatgaaactatactataaactttaaaatattgtttctatgcattaaataaaaacatagccaatgagccagggagacggaagttaaaaacacgtcaggggctctcttcccaaaagggttaccatctggtgttgtacaatttgaataaaatgatgctgaaggattttaatggcagtagggaaaatgtctggggaaaccaatgtagccacaagtacataaaaacatccttgccttgtgcagacacagccaatgtcagagcctgaagttaactcctcttattatcaaacttacattgatacaaatatgagaacagaaatctgacctagttttatagcatcttcttcattcatctttatgttatccattatgagctttgtaaggttcttcaagttacccaagctgtcagtcagaccacctgtcaaaagaaaaaagattggactctttcagcagatatttgctatttactatgtcatttactattactgtcatttttgttaccaatcaaaagattttaatgatcatcatgagccaaaaatgctcatgaaatagacataaaaatatactttttataagagatgggcattatacttcactgtaagcatgttctgcaaataatagactagataccaatttcccagataacagggaaaaaaatttcctttttttttttttttttttttttttgagacagagtcttgctctgtcgcccaggctagagtgcagtggcgcaatctcagctcactgccagctccacctcccgggttcacaccattctcctgcctcagcctcccaagtagctgggactacaggcacctgccaccacgcccggctaattttttttgtatttttagtagagacggggtttcaccatgttagccaggatggtctcaatctcctgacctcgtgatccgcctgcctcggcctcccgaagtgctgggattacaggcgtgagccactgcgcctggccgataacagggaaatttctaaacacttggaaattaaacaacacatttttaaataatcatgcattaaagaagaagtctcatggaaactttgataatattttgaaaaatataaaaataaaaacaaaacttcaaaatctgcagctctctcctcacaaaggggtgaaaagaaaaaaaaatctgcagctaacacagtgcttacagggacatttacagtattgcatacttatattagaaatgaggaaaggcctcaaatcaacaacctaggcatactacttaagaaattacagaaaagagagcaaaataaatgaaagaagaaagaaaataataaagataagggtgcaaatcaaagttattatgcctttattatacaaattaaaaacagaggcaaggtctcactatgttgcccaggctggtctcggactcctgagcacaagtgatcctttggcctcagcctcccaaagtgctaggattacaggcgtgagccaccatgcccagcccagaaatcaaaattataaacaggtaaacaatagaaaaaaatcaatgaagctaaaagttggatctttgaaaagatcaataaaatttaaaaatttctaccaagactgacaaagaaaaagaagacaaaaattaccaatatcagaaacaaaaaaggggatatcactacacacactgcagatattaaaaggacaattagagaataatataaacaaatctatgcacataaatttgacaacatatatgaaattgaccaattttttgaaaaccacaaactaccaacactcatgtgatacggagtaggtaaccggaataaccttatagctattaaagaaattgaatttgttatctaaaatttcccggaaaagacatctgtaggcacagatatgttcacttgcaaattctgccacacattttcatttttttccttctatcaactgtcttcatatctaccacacatttaaagaagaaataacaccaattctacacagtcacttccagaaaatagaagtacaaagaataattcccaactcattttatgaagccatcattaacttgatatgaaaaccagaaaaagacgtagaagaaaaacttttaggccaggcacagtggctcactcctataatccccgtgctttggggggcagaggtaggaggatcacttgaggccaggagtttgagaccagcctgggcaatatatccagaccctatccctacaaaatattttttaaattacccaggtgtggtggcaggtgtgagtagtcctggctactcaggaggctgaggcaagagaatcgcttgagcccaggagttcaagattgcaatgaagtgtgatgacaccactgcactccagccttggtgacagaatgagacaatgtctttaatgaaagaaagagagagagagagagaatagagaaagaaaggagggagggaaggacggaaaagaaaagaaagaaaattgaggctgggcgaggtggctcacacctgtaatcccagcactttgggagggcgaggcaggcaaatcacgaggtcaggagtttgacaccagcctggccaacatggtgaaactccgtctctactaaaaatacaaaaaatcagctgggtgtagtggcaggcgcctgtaatcccagctagtccagaggctgaggcaggagaatcgcttgaacccaggaggcagaggttgcagtgagctgagatcgcaccactgcactccagccctggtgacagagtgagaccccatctcgaaaagaaagaaagaaaattaaactttagaccaatatcattcatgaatacagaatcaaaaatcttcaacaaaatagaaaatggaattcagtcatgcataaaagaatattacggcaggcgtggtggctcacacttgtaatcccagcactttgggaggccgaggcaggtggatcacaaggtcaggagtttgagaccagcctggccaacatggtgaaaccctgtctctactaaaaatacaaaaattagctgggcgtggtggcgcgcctgtagtcccagctacttgggaggctgaggcaggagaattgcttgaacccaggaggcggcggttgcagtgagccgagatcgcatcattgcactcagcctggtgacacagcaagattccatctcaaaaaaaaaaaaaaaaagaatattacaccacctccaaatgggcttcatatagggaatgcaggatgctcaatatgtggaaatcaatccatataattcattatattggcagtctaaaagtaaaactacgtgatcccataaattgatgcagaaaacacatgtgacataatccaacatccaggctaggtggctcacgcctgtaatcccagcacttcgggaggcccaggcgggaaaatctcttgagcacaggagtccaagaccagcctgggcaacatagcgagaactcgtctctacaaaaaatttaaaaattaaccagatgtgatagttcacacttatggtcccagctagtcaggaggctgaggtgggtggatctgttgagcccaggaagtcaaggctacagtgagctatgatcacgccactgcactccagcctgggtgacagaacaagaccctgcctcaaaaataatctaaaaataatttaataaaaacaatccaacatccatccatgtaaaatgacatgatcatataaatggatacagaaaacatctttagcacaatccaacacctattcatgaccaaaaaaaaaaaattctcagcaacttgataaaagacacctacaagaaaactacatttaacattatacttaaaggtgaaagtctgaatgctttctccctaaggtcaggaacaaggcaagatgttaattcatgtcactattcaacattgtactacaagtcctagttagtgaaataaggcaaaaaaaaaaaataaataaaaggaatacagattggaagggaagaatttaaaatcattcttttcgaagataacatgattgtctatgataaaaatgtcaaggaatctacaacacccccttctgcaaaccccacaaaaaaaacccttctaaaactggctgggtgcagtggctcatacatataatcctagcagtttgcgagactgatggggaggatcacttgagcccaggagttcaagactggccttggcaacatagagagacctcctctctacaaaaaagaaggaggaggaggaggaggagagggagagagggggagggggaaggagaggggaagggagaggaagaaggaggaggaggaggagaaggaggaggaagaggaggagaatgagaagagaaaaaattagtgaggtagcgaggtgtggtggcacatgtcagtggtcccagcgacttaggaggctgagcattatgtagaaaatgggattatagaccgggcacggtggctcatgcctgtaatcccagcaatttgggtagccgaggtgggtggatcacttgaggtctggagttcaaggccagcctggtcaacatggtgaaaccctgtctctattaaaaaatacaaaaattagccaggcgtgttattgggcgcctgtaatcccagctactcaggaggctgaggtaagagaatcacttgaacctgggaggcagaggttgcagtaagccgagatcacaccactgcaccccagcctgggcgacagagtgagactccttctcaaaaaaaaaaaaaaaaaaaaaaacagatgaatagaggtcattatggtaagtgaaataagccaggcacagaaagacagacatcacgtgttcttacttatttgtaggatctaaaaatcaaaacaattgaactcacggagagtagaaggatggttaccagaggctgggaagggtagtagggaggaggtggaaatggttaatggatacaaaaaaatacttagaagggataaataagatctagtatttgatagcacaacatagtatctaagtcaaaataagttaactgtatatttaaaataactaacagtacaactggattgttcttaacacaaaacataaatggttgaagggatggatactccattttccatgatgtgattattacacattgcatgcctggatcaaagcatctcatgtaccccataaatatatatacctactatgtatccacaaaaatgaaaaatagaaaaaatttaccttatagggttaagacatctaaatgagttgatacacgaaatttgcttcaataatacctgtatgtgttcaataatgttggctatcgttatgtatacctttaaaaaatcaacaggttggggccaggtgtggtggctcacacctgtaatcccagccctttgggaggccgaggcgggtggatcacctgaggttgggagtttgaaaccagcctggccaacatggtgaaaccccgtctgtactaaaaatacaaaaattagccaggtgtggtggtgcatgcctgtaatcccagctacttgggattctgaggccggagacttgcttgaatccgggaggtggaggttgcagtgagccaagattgtgccactgcactccagcctgggtgacagagtgagaccctgtctcaaaaaaataataattaaataaagtaaatactttttttaaatggcaaacattaaaaaataattataaacaccatataggccaaattcagcacataggtgatcactttacaggatcagtataaaagaatagttgtcatgagtagatggtgagcttcctgacacagaaggtagtctaatacagtcttcgtgacacccagaatcttacagaagggattccctcattagggaggaggtttcaaagattatctgtacaaaaaattctagaatcttaaaatgataggaaatttctctgtagggtgacaagcaaggcagagctgggtgggaaattgctagcgtttgaaaactaaccccagactgctacagttaagtacagcaagattcctgcttcccatggcttcacaccacatagcagttcctgctcggggcaaccaggctggtctacacaggtagggcagacattctcctttagtgttatttggaatttggggaagtatccccgttacccagaaagattgccctcgcatatctgtgtctgaagtctaaaatctgaaatttcatcatgttagacaatattccccaaatcttctgtcattcattcttctttttcttttctttttggagatagggtcttgctgtgttgcccaggcacagatatgatcatatcttgctgcagcctgaaaattcctgggctcaagtgatcctcccacctcagcctctggagtatctgggattacaggcatgcaccatcacgcccagatgattaatttttgttggagacagggtcttcctattgtgtccaggctgatctcaagtaatcctcctgccttggcctcccaaagtgttggaattacaggtgtgagtcacctggcctggccccaaccaagtaaacaacagttagggtgggaacggagctgagtatcttctacaatttcccagatgagaatcttgtaacacaattagctcctagctcctgcaggtgattaatttacaggttggatttcctccaagacttgaagtagggcagggtgccacttggcagggaaggactgggtattgggtagagatgggggtgctcgcaggagaaggatttgctgaagacaagcttaacctgcgtatatatttattttttttaatttttttttttttttttagacagagtttcactcttgttgcccaggctggagtgcaatggcgtgatctcggcccaccgcaacctccacctcccaggttcaagtgattctcctgcctcagcctcccgagtagctgggactacaggcatgtgccaccacgcccggctaattttgtatttttagtagagatggggtttctccatgttggtcaggctggtcttgaactcccaacctcaggtgacccacctgcctcagccttccaatatattttttaataaaaatatttttagtatatttacatttttaataaaaatagttttaatatatttaaacacatacatatatgtatctatgtatgtatgtgtatatatatctttccaatcagactacagctctgggaatcttccctatggctcccaatctaacagctttcccccaacatagacctctctccacagcccttctaccttcctttcaagtcctgacacctggtagaaactactagaaaatttaaaacaaaactaataaaaatgaaatcatgtcttttgcagcaacattgatggaaccggaggccattatcttaggtgaaataactcagaaacagaaaatcaaataccatatatactcacttacaagtgggagctaaataatgtgtacacatggagatagaaagcagaatagacatggagacttggaaaggtgggagcgtgacagggaggcaagggatgagaaataatctgataatggtggttacactaaaagctcagatttcaccaccacgaaatatatcgatataacaaaactgcacttgtaccccctatatctataaaaataaataataaataataaagcaaaactatatatctaacattttcacagtattcctggctaatatttccagccagtcttgattatagctgtaaactaaaaatcctaagccccccaccaactgaatgcatcccctctgggctaaggagaccccagaaaaaaaccttaaactcagttcctggccatgacaggatgggaggtcaaacacacatcattatactccctctcttgtatggtttgaacacaactcatcagcattactgttgacatagagatcataagactaacagaacagactttttgtggcaataaattaccaagttataaagaggacataagaccatgccaggcaaaggctaagtcattcagctctacgcttaaagaataaactgtcctaggctgggcgtggtggctcacgcctgtaatcccaacagtttggaaggtggaggcagtagaactgcttgatcccaggagttcaagaccagcctgggaaacatagtgagacctcatctccccataaaaaatcaaacaatgaggatcaactgagcccaggaggttgaggctgcaatgagctgtgatcgcaccactgcactcccacctgggtgacagagcaagacccaacctcgaaaaaaaaaaaaaatttaaaaagaataaactctgtcgtaactgccacagatttttcttctttggtagctaaacaagcattggtctcaagataagcaatattgatagttgtgaatattaaacaattcgcaactcatccagctcacaaatgctaacaatccctgttccatctgccataactacagctttgattggagaagagagtgatttcagtaactttctcctgatcagaggaccaccaaccacagactggttctggctggtttacagagattgcgtacctgcttacctttgtgctctgaaaagaacttctgaagtataggcctaattgtaatacatttaaatcatttaaaggggtgtacaatcttttggtttccctgggccacattggaagaattgtcttgggctacacaaaaatgaatttgtgctgggccacattcaaagccgtcttgggctatgtgcagcccacggactgcaggttggataagcttgatttaatgctaaatctccaccccaaagtgaacatgggttgtatgttacatgcatgtttattcaatatgcatgtatcaagaccaccttcatgaatattcatagctcctcctgtaatctgttgaatatgtatgtttagccaacccattcaacataaagtgtctaccccaacccctccttcgaggtgcctgtctctggtcttggttggaggcatgtttctcagcctgtgggatggccaccttgcaggctgtaaccctttagaagaaataaagtctcctctctccttttccaaatttatacactgttatttttttttaagtgaacaaagcacaaaccactgatatttacaatacccggcagccgttgattctgtaggtcatgaatactcaaggttttcaggtttgttacagatgtgatgtgcctctcatcttctatggtgaggggactggcttccaccatgagagaataaatgttcttacaggtgctgaggaccaaactgaggcttccagccacaccagcacatctctttatttgcagcctgaggcttgtggcagagctgaatattttccccagatatctgatatcttgcttattcaacttgctgaaatcccggagtgtgacctccagagtcctgaattcctgcttccagttgaagaacaaagatacagccctgctgggaatgtaggtttctggggcctcttccatgtggattccacctgtgtcttctgcagccttttcccatgaagccatagctcccccataaaagtccagtttaatgaagtccagggcacttgcacaattgggcaaatgttcaaagaagtcaaataagtaatcggggatgttccctgagttgatatataagcttttaccttgaaagaaagcttcaaattcttggctcagggctgatttggatgtactctcttgatataaatggatgccacactctacaaaggaattgatgtttatggctttcagaatttcttgctcagtggtgtttttcacactttgcaaagattcctgtctccagagaggcctcttggcgatggaaagtccgagaaggcagccgtgttgatacactgctgcgaggtgcttcataacagccctggtggcttccacagatgacccacaggtgtaccggagcaggctgctataagtggatgtaatgtccgaaatggaaaccattttctgcaagtaaccattccccttggtcacctcctctggctcatgagacgtcaataaactgctgagtcttcgtcctgctgtgtactcctggaatgacttgtgaaagaatttatactttggcttgaacctttgagctgtatatttacagaggagcccagttgtcagcaggacatcctcattcacgctggacacatcctgcagttcgaaatcaaacttgtgggagaacacaccctccagagctaggtctccacagtggtccaggctccgaatgaagtcacttgcagccacacctttatgtttgtgtttgtttttctgtatcaacagatcatagaaggtatggaacagcgttgtttgtgtgtgagagtggaactcactttcacccatctggattgcacaagtgatgaccacaaagagaggggtcttcatgagattcctcaagcacctggatttctgaatttggagcaacaagccttcagcaagctccttgatcagcacttctcggatgagagcctgggcgctgtcttctgtcatatcccccacctcagcagtcagggcaccaaactgccgtatgtgcctcaggcactcagtggtagtggtgacgatgaccatgttcttgaagcggtggttttcctttatcagggcttcgatttctgggcagttctggggcttgaattcattgtagccatcaagaaggaaaagaaccctctgccgcagcttcagcagcatggccatgaatgtctgcttcctgattgtgccaggtatatccaggagttgatcacagagggtttcaaaaagtccaccctgggccctgctgagacggaggaagaagacgaatttgaacttggtcagagccttgcactttccggagccccagagcatggcaattcgctgcagcagagtggacttgcctttgccagattccccttcaatgatgcaggggctctgaagagcctgcaggaggccattcagggtcagctgctccacgcggtgatggtgttggtccttcctccacaggacaggttctgtgaaggtgcttttcaagttaaaaataatgtcaatatcttcaccaaggggataaaagttcagaaaagatggggtatggtacaagtcctttaaatcctgagccaaatcgtccaagtctccttctgatgtctgatgaaaaagacctattagagaagaggtgatgttaaagaagacccaattctgtgtctcctcaaaacctagagttcaggaggatgaacgggggggtgaggctgagaatctgccattggtgaatgtaatgtcctttcccagttctgagctggcacaaagggttctgtctgctccccctttccccagcatcctttaccccactcccctttttgctttctgtttcctcctttccacaaccaaatcttatagcagctggttggaaaagggaggagcttgtttttgggttaaggaaagtaaagaatttggcagagaaagatggttagggataattgtcatcatagtaggccttcactctgagtaaaatctgtcatgaccttatttactaattaaaaaaataaaaacaatattttatgaaacatagaatcatggttctgtgtcagtcaggctgtctttaccaggaggcctggacatggagtaggtagtcagctgggcctctctcccataggtagatctcatccaaccagggaatgctgagaaccactgctgcactggaagcttaactagtgcacttattctccagttttatcttgcagtgagacaatactcaatcatttatttcctggccttggggttatttgtttggcttcaccatcaattgatctactatgagtttttcctaaaatcatctaagcttttccttagcaggtatcaaaggccactgccaggtgatatgaagagaaggaaaagcagaggctctgccatggggaagatggatctttgttgtggtctattctacttgcagaaacagatgcaaaactaactgatacttactttgtccattcaagtcctgaaatagaggatagttccactccttaagggatttaagaaagaggttacaggactctgaaccctttttcaaaatcatgtgaatgatccctctagcagcatcctgctccaccttctcgcagcaaatgatgtttacttcttcgcgattcagaacattccatacaaataggtcatctgtgatttgctttataacagtcattcccattctttgaataagggctcggctattgtcctttatgaaattcactgaggagatggggagaaatatacatatttatttacttatataaaatgtgcatatccggctgggcacggtggctcacgcctgtaatcccagcactttgggaggccgaggcgggcagatcacgaggtcaggagatcgagaccatcctggctaacacagtgaaaccctgtctctactaaaaatacaaaaaattagccgggcgtggtggcgggcgcctgtagtcccagctacttgggaggctgaggcaggagaatggcgtgaacccaggaggcggagcttgcagtgagctgagatagcgccactgcactccggcctgggcgaaagagcgagactccgtctaaaaaaaaaaaattaaatatgcatatcagcatctgtctccagagcattagggccatgcatttttttcctgtgagcatctcctgagttatggagatgccaaatgcctgaattccaggccttcaagaaatgctctgccaagcattttttttctgagacggagtcttgctgtgtcacccaggctggagtgcagtgacgcgatctcggctcactgcaagctctgcctcctgggttcaagcaattctcctgcctccgcctcctgagtagctgggattacaggcacgcaccaccacactcagctaatttttctattatttgtagagacggggtttcaccattttggtcagactggtctcgaactcctgaccttgtgatccacctgccttggcttcccaaagtgctgggattacaggcgtgagccaccgtgcccggcctctgcaaagcatttctaaccccagagttattgatgagcaagatgttttgctttggtgaagaagtaaggtgagttatcttgtccctctgatataaagcagtccccagtgaggttgtagttgtaagaccgttggctttagaataatggcaatggcctaggatctgccacttgctaccatctatgtgaccttggcaagtcactaagcctctttgagtctatttcaattacgtgctgctggccgggtgcggtggctcacacctgtaaccccagcactttgggaggccaaggcgggcggatcaccagaggtcgggagttcgagaccagcctgaccaacatggagaaaccttgtctctactaaaaatgcaaaattagccaggtgtggtggtgcatgcctgtagtggcagctactcaggaggctgaggcaggagaatcgcttgaacctgggaggtggaggttgcggtgagccgagatggtgccattgcactccagcctgggcaacaagagcaaaactctgtctcaaaaaaaaaaaaaaaaaaaagtacgtgctgctaaatgtttcacaaactggccctggccctctgggagtaaaggccctaatttgtagcattcaccaatccccaaggtataaatattcctaccatggcctatttcaagctaacagcgtatgttaactggctaacaaaaatcctgaaaattcaataatcaggtttcacatcacagtaacaaccagctccagcacactggggattcctcatctgtacaatggtgtcaagagcattatttaacttaggaagttgttacaataattcatgtatagtatctcatacaaagtaataactcaatatatgttagctactatttttagcctttattcaggtgtcaccagacaaagagcacattgtatctccacagactttggtcttttctgaagagtatcacatcaaaacactggtttttatccaatgtaagctctctcgccaggtcttgagggtagctgtgtcctttttgtgtctgactctgcaaggtctaattctgaaacgtagaccacaccgtacccaggcactgtacccacgctatgtttgtgacagcttggagaaatgtcttcctggtttttaactctcagacaccgtctgcactagatttcttcctgggctaggctgctcctggttttttttttttttttttttttcagacgaagtttcactgttgctgcccaggctggagtgcaatggcgcgatctcagctcaccacaacctctgcctgccaggttcaagcaattcccctgcctcggcctcccaagcagctgggattacaggcatgcgccaccacacccagctaattttgtatttttagtagagatgagatttctctatgttggtcaggctggtctcgaactcccgacctcaggtgatctgcccgtctcagcttcccaaagtgctaggattacaggcatgagccaccgcacctggccgctcctggctttcaaacctgtgttgactgatcagagagggaatgcactcctctcaaagaccccagaacctctctggcctgaaatgcaccatcaatcactccaagcaccaggaccccaccccagccgtcctttctcaccattgcagagctctgctgctgacctcagctagaatattccctgtctacatgtcctgcaagagtcccatctctctccttctggggtctcatctgttctctagcttccacatcatccctatggaagtaacctctaagtctgtgtcccattgtgatcttcagtttagagctaaagaaatacagcctcacccgggcgcagtggctcacacctgtaatcccagcactttggaaggctgaggtgggcggattatctgaggtcgggagttcgagactagcctgaccaacatggagaaaccctgtctctactaaaaatacaaaattagccagtcgtggtggcacatgcctgtaatcccagctactcgggaggctgaggcaggcgaatcacttgaacctgggaagcagaggttgcggtgagcccagatggcgccattgcactccagcctgggcaacaagagcaaaactccgtctcaaaaaaaaaaaaaaaaaataagaaatacagcctcagaaaggcttagagacccacacacacacaagttcacagcctagccttcctgagactacctttcttcacctataaaatgaagacacgttatttaaaatactctaattatttaaaagactcattatattgaataagtcacataactctcatacccaaaaatgtcttaaaattggaaaagtggctaggcgtggtggctcacacctgtaatcccagcattttgggaggccgaggcgggtggatcacgaggtcaggagatcgagatcatcctggctaatatggtgaaacctcgtctctactaaaaatacaaaaaattagctgggcatggtggcacgcgcctgtggtcccagctactcaggaggctgaggcagaagcatcgcttgaacccaggaggtggaggttgcagtgagccaagatcacaccactgcactccagcctgggctacagagcgagactccatctcacacaaaaaaaaaaatttacaaaaaaaaatatatatataaacagtaagatattattttactatgttatatctccttgtatgtagaccatcatactccttccttatcaagtaattaggtggaaaaaatgctgctcatttattcattaattattcattcttttcagaatatctctttgtctagaccaatgcttttcaatagaactttctgtgataatgaacatgttctatatctgcattatacaatatggtagtcattagccacatgtgactactgagtgcttgaaatctggctacagtgactgtgcaactgaagtttacattttattttatttaaattcacctttaaatagctacagagggctagtggctactattaatatactagatagtgcaggtctacacccagccatttaaagtggaaggagctacattttggttgccacttagatctataccatgtttcttcacaatgagcttgacatgtatagctctctgctgtctggctgaacaggtgatgagaactaacagtttaaaacatacacctggtcactctttgtgtaagtcctatcctatctgtggttctgccttttatcacaggttaccatatttgtaactgaattcctaaaacaacagaagaatatttattggtaattccacatatgactggtcagaggaagccatgaactgattttccatttaaaatcaccagtatttggtagcagactgtataaccaggcagatgttatttctcatatacttacttgttctggatgaaagcttcccacctttctataacacaatagaaaatattatttccaaatggaaaggtcaaaggtgatcccaatattgtcctcttttttctgtaaaactactcttcattctgtaaaacaaacaaaacagaaccagagactatcaggtggaggggctgatgcaattatctaggtaatgccccgcttttcatagatgagaaaatggtgacccaaaccagaaaaaaactcgctcaaagcccctggctattcatggccaggccctaaagagaacccaggcggctggactccttgcctagagctctaaactatgttcagctggaactttgcccttctcttcaaagtttcttctcatttctgctgttcagagccaagaaggcaacatggaattaaatgtcaaaagacggtataagtgtcaacatgaatggtgcagagggtacgttctctccagtatttccaggaaagagtatatggactggaatcatccagggaggaagttttcatggaggagacagcacatgaaccaggtcttaaaggataagtagggctgggcgcggtggctcacgcctgtaatcccaacactttgggaggccgaggcaggcggatcacgtgaggtaaggagttcgagaccagcctgaccaacatggtgaatcctgtctctattaaaaatacaaaaattagcggggcgtggtggcacacgcctgtagtcccagctgttccggaggctgaggcaggagagtcacttgagcccgggagacggaggttgcagtgagccgagatcgtgccactgcatcccagcctggcagacagagcgagactctgcctcaaaaagaaaaaaaaaaaaaaaaaaggataagtaagatgaggccaggtagttgggctggggtggaggtggagatgaggatgtaaaacgccttgcaggtgagaggatgagatcagggagtatggaaaggggaaaagttctcttgtccccttcgcagggcttgcgatgggggtgtggctcacttcttcagtgcccgctgctcagacctctaggggatcatacagatgggcgggctgtggggttccaatcccacggcagtgtctagtggtgaatgtttacagctcctgaagccccagtgggtgtgtgttacagggtgctcttttagttcagctgtccgtaggcgtcttgtattagctcaatgggacccctgccttattgcaaggacagagggctttctgtattccggggttcttgccttggtgtaccggaggaattggatcacacgtggtcttggagaatgagcgcaaggtttcattgagtggaagaagctctcagcagatggggtagccagaagggagatggtttttccccggagtaagaccgccaccaactcttctccaaccctccaggccaaactccgagtcgttcctctggtggatggcctgctggcgtgccgatgtctgttgtgtgctcttccgccagcattctcccttcaacgtcctctggacgtccagctgcttgtatgttcttccgccgatgtgttcctctcgacgtccagccgcttgtgtgtctgcctgcaagggtctctgggatttttataagcataggatgacggtgtggcaggccagggtggccttgggaaatgcaacatttgggcgccaaggcaggagtgcctgtcctcacctaggtccgtgggcacaggcctgggggtggagcccttgccagggacgcgcccttctcttcccagcacttcccttccccccttccctatcaatatgagtaattgaggagacagaaaaaaggagttatgcttccagggtacaaaggggaaaagctatggaaagccttgtacgccaagatgaggcatttgttctttatcctatgagcaactgggagagattatggtataaggagtatgtttaaagtgatgttttaagataagaaacggatttcaatttcctggtatggtcctgtcatttcatcctcctagttgctttaaaagcaacttcctttctcccttcctcctccacacactctgaaaagcaggggcccagaagcctctgagactgctctgtgtgcattcccaaaccaagttagatgatctaccccggctcctcatacacacatacacgaccccctgcatcaggatgaagatgcaaagtctgaattaaagacagcatgagagggcagacaggaagtggggaagagaactagaatcactgggtggagagaaacaaaatgggagctatgtgagtgtgattgtggtatgtgaatggagttggcttgggaactcatgtggatggggttggcatgggaactcatgttatcctaacattaaaactctttttttgagacagggtctcactctgtcacccaggttggagtgcagtggccccatcatggctcacggcatccttaaccttctgggctcaggtgatcttcccacctcagcctcctgagtaactgggaccgcaggtgtgtgccaccatgcctggctaattttttttttttttttttttttttttttagagacagagttttgccgtgttgcccaggctggtctcaaactcctgggctaaagtgatctgtctgcctcagtctcccaaaatgctgagatcacaagaatgagccaccgcgtctggccattaccctaacattttattatgaacattttcaaacatagagaaaatccatccctctattcatttatcaatctattttacttattttcttgcatattcaatgtaagttgcagacgttagtacacttctatgttcatataattaactagaattcaatattggtttattattctttcttaggaaaaattcacctacagtgaaagcagagatcttaactgtaccctttgatgagctgaaaaatgcttctacctcaaacacctatcaagacagaaaacattaccctctccttagtatcctatgccccttcccagtcaaattccatctctgccacaccctcaaagaaaatcactcttctgatttttttaaaccgtaaattagcctgttgaagaacttcacataaacggaatcatacagtatgtgctactcctttcattccacacaatgtctgtgtaagtcactcatgctgttgcttgcagtataagtagtttgtaacatttcattgcttagtagtattgtactgtataaaatactagagtgtattggccgggcacggtggctcacgcctgtaatcccagcatattgggaggccgaggtgggcggatcacctgaggtcaggagttcaagaccagcctggccaacatggcgaaaccctgtctctactaaaaatacaaaaattacccgggcatggtggctcatgcctgtaattccagctacttgggaggctgaggcaggagaatcacttgaacccaggaagcggaggttgcagtgagccaagatcgtgccaccacactccagcctgggcaacgacaaaaaaaaaaaaaaaaaaaacaacgaaaaaaaaaaaactagagtttatttatctattctcctgttgatggattgggttgttttcagattggggctatcataaatacagaacaatgaatacttttgtacaagggggtccttccccacaaaaacttctctaagaatagcttactttgactctgatctttctaatttcacaagctctttgaataaggatctcctcagcttaaactagatgctcacagccatggcaagtttgctgtgaatgttgctgttgtgagagtgataagtgaggataagaaagtcctagataaagtttcctttcattcaaaaagcccccaaatcatatcttttctaataaaaagcagcctgaaaaatcaagctgcaagtatagataagctaaaagcttgcattggtaaatgccagtagctgtgcccatagaaaaaagccacctgggggccaggcatattcaacatggcggatccatcttcccttttctttttcaaccatgtgtacagtaggaacagacaacatagtgccggccagatagagaccccatctgcataataaaacataagggtggaatggccggcttcttcgtgcgctatgcaaacgttataccggttctgaccaatctctcagtccctatgtatatcagacaccaccttctcaagttcatctataaaaccccatgcattggctgggtgcagtggctcacgcctgtaatcccagcactttgggaggctgaggcaggcggatcacaaagtcaggagatcgagaccatcctggctaacaaggtgaaaccctgtctctactaaaaaattcaaaaatttagccaggcgtggtggtgggcgcctgtagtcccagctaatcgggaggctgaggcaggagaatggcgtgaacccggggggcggagcttgcagtgagccgagatcgcagcactgcactccagcctgggcgacagagcgagactccatctgaaaacaacaacaacaacaacaccatgtatttcaccacaaaaccactcactcaggttcccctctctctctgcaggagagagagctattctcttttctctttctttcgcctattaagcctccccccttttgtttttttttgagatggagcctcgctctgtagccaggctggagtgcagtggtgcgacctcagctcactgcaacctctgccatctgggttcaagcgattctcctgcctcagcctcccgagtagctgggattacaggtgcatgcctcctcacccagctaatttttgtatttttagtagagatggggtttcaccatgttggccaggatggtctcaacctcctgatcttgtgatctgcctgcctcggcctcccaaagtgctgggattacaggcgtgagccaccatgcccggcctaaaactccactctcaaactcacttcttgtgtgtctgtgtcctcgattcctttggcgtgagacaacgaacatcaggtatttaccccaatgatgctgcttcaaaagcatatctattttcagaaaataaagtttcccttttatgttaaaactgattcattaacaatataaaaaattgtcattgaaattggagcagccaggcgcggtggctcacgcctgtaatcctagcactttgggaggctgaggcaggtggatcacgaggtcaagagatcgagaccatcctggccaacatggtgaaaccccgtctctactaaaaatacaagaattagccaggcgtggtggcaggcgcctgtactcccagctactcgggaggctgaggcaggagaatcacttgaaccagggaggcggaggttgcagtgagccgagattgcgccactgcactccagcctggtgacagagcgagactctgggtcaaaaaaaagaaaaaaagaaagaaagaaaagaaaagaaattggggcagctcaggagcttaagcaagggcacattttggtgtcaggattgcgttcaaactacagctctaccactgacacactaagagtcctcaatcaaggggtaatgactggcacacaggaaggactcagtgaatggcggcaactgtagattcttctctccctttctacttccccaaaaaggggtgggtttgggaagaatcacaccatccctgactgggtcaaagtttaagtcagagtagaaaaagaggaagaagatagaggaaggagctaagatgtataaagtttttaattgctctcaagaacaaaatcaatccatatactgaagatcatgtaatttttctcagttacccactggcataaagaatagggctgtggaccaggcgtggtggttcacgcttgtaatcccagtgcttggggagactgaggagggtggatcacctgaagtcaggagtttgagaccagcctggccaacatggtgaaaccccatctctgctaaaagtacaagaaattagccaggcgtggaggtgcacacctgtaatcccagctacttgggaagctgggacaggagagtttcttgaacccaggaggtggaggtttcagtgagccaagatagcaccattgcactccagcctgggtgacagagagagactctgtctcagacaaaaaaaaaaaagaataggactgagaccagtgtactctcttggaatgtagctatggccctgcaacccctccccgcaagctgtccagtgaataactgaattgggtggaagaagtccttcccccacatttgtacattggaaaataatataataatatatattatatatatataggcaatctgcctgcctcggcctcccaaagtgctgggattacaggcataagccaccatgcccagctggaaaataatatttagtactaattctaaaattggcattttcttaaaaaaggttacatgagctcctcagagaactgaagtttctctggacccatataacccacgtctatggggtcattcccacacctcacagataaaataagggaaagagtacatataattaggagcagacaggaagcacacagaaatggaaaatgtgtgtgggctttggcattgcagatctgaattcaaatcctcactctgcaccttatgaggtaagtatccctagacatgttacttagcctttccgaatcttgctttccaaatcatgcataatattcacctccctggactattgtgaagattaaacatgaaagtagttgtgacaaagatggtcagtgggtattatctgtcttcctttctagtaaaaaggctctagactagaatgttcttaggtctttaataggcttcagcaatctcacatgttaatattagtgttatgtgctgaactgggcttcccccaaatccatatgttgaagccctgaacctcagaatgtgactgtatttgcagacagagcctttaaagaggtcattaagctcaaatgaggctgttatgagaagaggaaatcgggacacacaaagggagataccaggaatgtgcatacagagagaaaaggccaaggagggaggcgtggggagaagccaaccctgctgacaccttggtcttggacttgcagcctccagaactgtgggaatataaatttctgttgtttaagccacccagtctatggtattttaaacacattaatacgactaatattataaaagtgtgtgaacagttaagaagtgtgctgaccaggttctatcctagttttgtagacaattagcagtgtgatgtagggcaggacatttaactcctctctaccacattttccacctctcaaagccaggctgcaaggatctactgagataatgtacataaagaccctatcacgaaataggtgtcccgtaaagggtgatttccttcacttctgtctccaaatatcaggtttctcatcagtaacttgggagattggatggactaagtagtccacctcgttcctttcagctttgatcatctgtgattctaacaacagtcttagcaacaagagtgagtttcctggccgggcacgttggctcacacctgtaatcccagcactttgggaggctgaggtgggcagatcacgaggtcaggagttgagaccagtctggccaacatggtgaaaccctgtctctactaaaaatacaaaaattagctggggcgcggtgccgggtgcctgtaatcccagctacttgggaggctgaggcaggagaattgcttgaacccaggaggcagaggttgcagtgagccgagatcacgccactgcagtccagcctgggtgacagagcaagactctgtctcaaaaaaaaaaaaaaaaaaagagtgagtttcctttctgtaatgccaaaaagtgtttccaaagtcctttccatctcacagtagtccaaggggtacatgtaccccttgaacctgatgaagccccagcagacccgattaaccacccctaaaggtttctcggcaggcaaatccagccaggcatgcaaatcacactcgtcaatgttaaggcttttgtacatcccagacacaagctttaaatgaatgtaaacccagattttaatatttgggccccagaccttaaaaatcccattctctctacccacagtacctggctgagcaatccaattgccctcttcttgggagaccaagacatgtttttaaaataaagtttctttgtatttgctttccgtttcagtgaggcctcgagttcttgtagaccagataccttcttgttctgtgagaggacagtgtacagagaggggaactgctgagcagttccttttttttttttcaaagcacagtaagagtggtttggacacaagtactaccagttcagaaagggaagatgggtgtaggcaggagtagccggggaagaagtagaacttcagagtaaaagatgcaagagctagaaattccgtcaagaaaggaattactcatttgtttcctgtttgttcacaacatatgaattcattgctgttgagttacttattctataccttaaaatgaaacaaagtcttctgaacatccaacatatattttttttctttttctttcttttttcttttttttgagacagagtcttgttctgtcacccaagctggagggcagtggcacaatctcagctcactgcaacctctgcctcccgggttcaagcgttcctcccgcctcagtcctcccagtagctaagactacaggcgtgcaccaccatgcccggctaatttttgtatttttagtagagacagaatttcaccatgttggccaggctggtctcgaactcctgacctcaggcaatctgccagcctcagcctcccaaagtgctgggattacaggcgtgagccaccatgcccagccacaacatgtatttttaatgcttaaccatgggagatagagcggtaaatgaaatgagccagcttagttggctaaagcacattgctactgcattcaaggtcatgcttacccctgtaccttgaatcccagaggacttccagcagatgtgttctctcagtcagcagggttctgggcaaggtcacacagggcaaacagatcaccagttttggtccactccaccgatgacgcacggggacaccctccggagtataaacagccaggggcttgcacaggcacactcacattggacgtttgtgttcacagactccaggaggccagcttatactcagctgaggactgaagaaatctctctgcacttcccttgaggatgacattcttgcatactctttcctctgtctttgcataaactaccaggaacatgtctttgtgttacataacttcttatttcaaaaagagcattctgacagtagcctatctgccatagagggataccaaagtttcccggcaaataaatgtctacatcctgggttttctaagggggcatcagtgtcagtgtttcccaacttgtgaggtgggtttctctgaagtgagattgagggctacactatcagctagatttttaaattgtaatgaaacctatatataaacatatgttcaagagaaaaaactgcaaagacagccaccaaaatagtaatgatgcttattgctggggaatacaattataagcaattttaaatttctgtctttggcttatctgtatattctaattttatttatcaacttatttattttttattttatttgtttatttatttatttatttatttatttgagacagagtctcgttctgttgcccaggctggagtggagtgcagtggctcaatcttggctcactgcaacctctgcctcccaggctcaagcaattcttgtgcctcagcctctcaagtagctgggatttcaggtgtgggccaccaccatggctaattttttgtatttttagtagagacagggttttgctatgttggccaagctggtcttgagctcttggtctccagtgatccacctgtgttgtcctcctaaagtaatgggattacaggcgggagccaccatgcccaacctgtatattctaattcttcatagcaaacacctattacttttgtactaataaatgatgtaatatagaataaaaagggaaaatgtagaaatatggttgtagtaggctgaatagtggctacccaaatatcccaaatcctaatccctgggaactgtaaatattgtgtctttccagatatgttccatttaaggctctgaagatggggagagaattctggatgatccaggtgggcccttaataatggtcccttattacagagagccagagggagatttgaaactgacaggagaagtcagtaagaccatgaatgcagagattcgagtaatacggctacgagccaaaagatgccagcagccacctgcagctggaagaggcataaatggattctcccctaaagctcccaggagtgtggccctgctgacaccctgatttcagccccatgatactgatgttggactggtcctcagaactgtgaaagaataaatttctgttgttttaaaccacccagtttatgatattttgttacagcaaccacagtagactaatacagtagtatttcatagtaaaataagcaaaattatatccatattcattcaagtacatcttctgggctgcctcaccagtttcctttgtgagtggatttgcagtcaggtgttttcagggcatttcaaataggtaattaactagtaacttcggcatcctacgttccaacagttacgtcccctgcccttatgttcttcctcccagtctctcccaacgcttattatcctaggagtgtggtaaagtggaaatgcccagagctctggagccaagtagacctgagttcaagtctgggttccttcctgtgactaatacaagtcaccttagcttcttagcagtgcaatgatggttccccaagttgccccagggttgttgtgaatatcagctgagatgccatctgtgaagtaccacatggcactaactattctgtgactttaagcatatgtagctactcatgcttttaactcccagtttaatgcggagggaaggaaaaagtcacgatacttttcttcctagaggcctgtaactcataactccaaaaataattattctggaattctgttagtcttctgcttacatatttagtggcagggaagtcactgggccaaatcaggcaggcagcttcctaatatgccttaataaagaggggtcaatttttttttttttttttttttgagacggattctcactttgtcacccaggctggagagcagtggctgcaatctcagctcactgcaacctccacctcctgggttcaagcgattctcctgcctcagtctcccaagtagctgggattacaggtgcgcaccactatgcacgggctttttttttttttttttttgacacagtttcactcttgtcgcccaggctggagtgcaatggcgtgatcttggctcactgcagccgctgcctcccgggttcacgccattctcctgcttcagcctcccgagcagctgtgcttacagatgtttgacaccacgcccggctaatttttgtatttttgtcgagatgggatatcaccatgttggccaggctggtctcgaactcttgacctcaggtgatctgcccacctcagcctcccaaagtgctgggattacaggtgtaagccacagtgcctggccaggagggttaaatcttcttgactacctcctttaggaaatagaagtacattgtgcctattatcctctgccatatctatatttatattatgtatattattataatttatatataacaagtatatattatacatgatattacatatacatatataaatatatcatttataaatataagttacatatatttacatatattatataaatacatttatatacaatattatataaatacatatatttatatgtaagtatataaatacaaatatttataagtatacaaatatatataattccccatcctcaccccttaaaattggactaataattcagatactctatgtaaaagaggctttggtagaataaactaaatgctggaggacagattgactctcaaggagtctgaaatcctgttctaaaattaacatttgaaacaactagagatatttggcaagaagcagaaagaatttcaaataggtttgataactgtgttatttgcggaggcatggcatagggaagagggaacatgtttcagatgcctatgacaaatgaaaatcatgtacaaggagtcagttaatgataaagttacttctttaggggaattagtcatgctttttttttttgagacagagtctaactctgtcacccaggctggagtgcagtggcatgatctcagttcactgcaatctccatctcccaggttcaagcgattctcctgcctcagcctcccgagtagctgggattacaggcatgtgccaccatgcctgactaatttttgtaatttttagtagagacaggtttttgccttgttggccaggctggtctcaaactcctcgtgtaaagcaatctgcccgcttcagcctcccaaagtgctgggattacaggcatgagccaccacgctcagtctcgtcatactttttgcactccttgcatttgtattccagtatttgggcagtttcccagattatgatactaacatccccaaggtagcagtcatttaccaggttgctaagatatggctacctcctcctcttgttccaagtcggcagtctacatctcagccttcggatgcatgttcttcacccctgcctgacacactggctctctctctctctgctactcccagctctagtggaggactgaaaattccagacttcctcagtgctacagagagaagcctccagaagctaggcaggagggtgtacccccaccatccactgatgctctagatttgtgggtcgctggactcagggctactgagagtagtcctgataggaaaaaatgagcagggcttgctagacagtatctaaaatcattcatcctggctgggtgtggtggctcacgcctgtaatcccagcactttgggaggctgaggtgggcggatcacctgaggccaggagtttgagaccagcctgggcaacgtggtgaaaccctatctctactgaaaaatacaaaacaattagccaggcatggtggtgcatgcctgtaatcccagctactcaggaggctgaggtatgagaatcacttgaacccgggaggtagatgttgcagtgagctgagatcgtgacactgcactccagcctgggtgacagagtgagattctgtttcaaacaaaacaaagcaaaattattcatctggctgggagtggtggctcatgtctgtaatcccagcactttggaaggccaaggacggtgggtcatctgaggccaggagttcaagaccagcctagccaacatggcaaaacccatctctactaaaaaaaaaaaaaaatcgaaaaattagccaggcatgggggtgcatgtctggaaacccagctactcaggaggctgaggcatgaaaatagcttgaacccaggaggcagaggttgcagaggctgtagtgagccaagatcacgccactgcactccagcctgggcaactgagcgagactccgtctcaaaagaataaaataaaataaaataaaataaaataataattcattcaccacacttttaagagggtggtcctggattagcctatttatgtttgaaaagtgaacatactgttttctagcgttaaaaaatctaattgtgcaaaagtatacagtgaatgagataattacctttacagctcagtgaagaaaatgtagcaagcattggatgtacttgtacacccgggggtcctcaagctccgggtgctaactggtacaggtccatggcctgctaggaacttggccgcaaagtagaggtgagcagctgtgagcaagcatgaccccctgagctccatctcctgtcagatcagtgacagcattagattctcagaggagtgtgaattttactgtgaactgtgcatgcaagggatctaggttgcatgctccttatgaaactcttaacgcctgatgaactgagatggaacagtttaatcccaaaaccattccccctccctcactccctatccatggaaaaattgtcttccatgaaaccctggtgccaaaaaggctggggattgctgttctacaccattagaaactaattaaactgcttttaccttttttgaatactttttttgtgtgagatagagtctcactgtgttacccacgctggagtgcagtggcgtgatcttcgctcactgcagccttgacctcctgggctcaagtgatttttccacctcagcatcccaagtagctgagactacaggcacttactgccacacctagcaaattttttttttctaatttttgtatagacagggttttgccatgttgcccaggctggtctcaaactcctggacacaagcaatcctactaccctggcctcccaaagtgctagtattacaggcgtgagccaccatgcctggcctagaatgctttttatttacaaaggtaatacatgttaaattcaaaaactttgaaaatacagaaaagacacacaaaaaaaaaaaccccacaatcctgccacaccaaataatcactaatgagtccaaagaggtatctcattgtggttatgacttacatttcccttgtgactaatgatgctgtgcacctttgatgtgcttattggccaaatgagtatcttctttgtgaagcatctgttcaaatcttttgctcacgttttcatgacactgagttataaggattcttgaagtattctggagacaaatcatttatcagatttctggattgtgactattttcttctagtttgtgatgtgccttttcattgacttaacaatgtctttcaaagagcagaactttaaatttttgatgaaattctattcacacacacacacatatatatatatatatatatatagagagagagagagagagagagagagagagagagagagagacagagtctggctttgttgcccaggctcactgcaacctctgcctccttcaagtgattctcctggctcagcctctcaagtagctgggactacaggtgcccgtcaccacaccagttaattttttgtatttttagtagagatgggggttccaccatgttggccaggctggtctcgaactcctgacctcaagtgattcactcacctcggcctcccaaagtgctgggattatagacgtgagccaccatgcacggcctcaccatttttttaagtgatttgtgccttttgtgtcctatttaagacctttgttatcccaatgcggcaaagatgccatctgcaatcttaattcccctttgccatgtaacaaacatacatattcatagtgctatggtctgcatgtttatgtccccacaaaattcatatgttgaaatcctcacccccaaaatattacgacgtaaggcctttggggggtgactaggtcatgggcgagaagtctttataaatgggattagtggacttataaaagaggcccaacatgtacaccataaatatatacaccaactgtgtacccataaaaattaaaaattaggctactcaagaggctgaggcaggaggattgcttgagccaaggagtttgaggttatagcgagctatgattgtgccactgcactccagtctgaccaacagagcgaggcaccctgactggaaaaaaaaaacagaaaaaaaaaaggcctgagagagcccctcatcccttccaccacgtgaggatatagtgacaaggtagccaactatgaaccaggaaatgagccaccaaatttgccagcagcttggtcttagacgtcccagcctccataactgtgagaaataaatttgttgcttacaagccatccagtctatggtattttgttatagcagcccaaacagactgagacacatggattctggattttaggatgcagacatctctggggggccattattctgcttatcacatacaccctttattagaatgaggaacttgtgttcctaatttgctgagcgtttttgtcatgacacatattgtttactatgtgccaaccactctaagtgttttaaatatgtcatttaactcgcatctatgagataattattacccctactttacagaggagtaacttaggcttaaagaaattaacttgcctagagtaatatagcaaagtggaaaaataagatttgaacagaaatatgttaaaaccaaagctcaaacttttggtaactgttgttaaaatatactgcagattggatgttattcactttctacataaggtcattcatttgttttttaacagctttgtcgagatataattcatataccttacaactcatccatttaaagtgtacaattcagtggcttatagtatattcacagtgttgtgcatccatcaccatgatcaattttagaacactgcctcagcaaaatggcccactcctataatcccaacattttgggaggctgaagttgggggattgctttagcccaggagttcaagaccagcctgggcaatgtggcaaaaccccatctctataaaaaatacaaaaaaattagccggtcataatggcacatgcctgtaagtcccagccacttgggagcctgaggtgggaggatcatttcagcctgtggaggctgaggctgaagtgagctgtgattgtgccactgcactccagcctggatgacagagtgagaccctgtctcaaaaaaaaaattttttttagaacattttttgttagcccccaaagaaaacctgtcctccttagctgtcgccttgatctactgtctatctttatggacctgcctattctggacatttcatataaatggaataataatatgtggtcctttttgattggcttctatcacttagcataatgttttcagggttcatccaaattttagtatgtatcggtacttcgttcatttttattgccaaataatattccattgtatggatataccaatttattcacttatcaactgataaacctttgggtggtttccactttttgtctattatgaatattgctgctatgaacattagtgtgcttgtgtccacacgaatttttgtgtggccatatgttttcatttctctaggagtgcaattgctagatcatatggtacatctatgtttaagcatttgaggaactgccggacagtgttctaaaacagcagctacattttgtatcacaaagagcagtgtataaaggttccaatttcttcacatccttgtcaacacttgttatttctgtctttttaaaattacagccatcttaatgggtgacatgcatctcattgtggttttgcgttcatttattcttgtgtttcttcactcctctaaaaaataagtgaggtcgggcgcagtggctcacgcctgtaatcccagcactttgggaggctgaggcaggtggatcacgaggtcaggagttcaagaccagcctgatcaatatgtgaaaccccatctctactaaaaatacagaaattagccgggtgtggtggtgcgtgcctgtagtcccagctactcggcaggctgaagcaggagaatcgcttgaacctgggaggcggaggttgcagtgagccaagactttggcactgcactccagcctgggcgacagagcaagactctgtctcaaaaataaataaataaataaataataagtgagcagataaatagcataatggcatatttgtgataagtgctaggaaataaataactagggtactataatagagattaatatgctggtcaaggaagctaggatggtgacatttaagctgaggtctcatggatgaatggaaccagccctgaaagcgcaaaggaacaatgttctagtcagagaagagcaagcacagaagccttgaggcgagaaagagcttagctaattctaagaactgtaaaaaggccaagatgattgattacaagcagaagagtggcatgagatgaggctagggaggctggcaggagaaaggagtttagatttcactctaaaagcagtggaaaaccactgacagtttctacactgagagaggaataatgatgcttgtgttttaaagaatcactttagctgctgcactgtaaaaccagttaagaagtgatagctgtttaggtgagataatagtaatttcaatgagaatagtagccataaagatgaagagaagtgctctcaagttctatttcagagacagaacaagcaagatcgaaggggatttaagaggtgagtgaaagggaggagcctgcaatgtaattcaaatttctggctttaacgactaggtgaaggaggatactatttaccaagatacagaaccaacaaattaagaatgaattggctgccagcgcggtggctcacgcctgtaatcccagcactgtgggaggccgaggtgggtggatcatgaggtcaggagttcaaggccagcctggccaagatagtgaaactctgtctgtcctaaaaatacaaaaaattagccgagctcagtggcaggcgcttgtaatcccagctagtcgggaggctgaggcatgagaatcacttgaactcagttgcagtgagccgagatcgcgccaccgcactccagcctgggcaacagagtgagactgtctcaaaaaaaataaaagaatgaattggccaatggtatggcctacaagtccttatgtattgactcaacaatatgcttaaataaatcctggaagctttcaattcggtttttctgagttattgccctttcatctaagtgtgcacaacatcaggttcctggctgtaaatacaatgttaatcaaatggggtttatttaccttcaaactacagtttgttacattatattcttctttcactagtattaattcaaaattaaagacatctcctttcattcacgtcgtgtctcttccacccactcaggattctgtccatttttctagtacttagaaatatcatcatttagttaaaacaaataacatgaaatttaaaacaataaaatatgtgtcacctgaaggggtgggttgcccctccacacctgtgggtgtttctcgttaggtggaacgagagacttggaaaagaaaaagacacagagacaaagtatagagaaagaaataagggagcccaggggaccagcgttcagcatacggaggatcctgccagcctctgagttcccttagtatttattgatcattcttaggtgtttctcagagacggggatgtggcagggtcataggataatagtggagagaaggtcagcagataaacacgtgaacaaaggtctctgcatcatagacaaggtaaagaattaagtgctgtgctttagatatgcatacacataaatatctcaatgccttacagagcagtattgttgcccgcatggcccacctccagccctaaggcagttttcccctatctcagtagatggaacatacaatcgggttttataccaagacattccattgcccagggatgggcaggagacagatgccttcctcttgtctcaactgcaaagaggcatgccttcctcttatactaatcctcctcagcacagaccctttacgggtgtcgggttggaggacggtcaggtctttcccttcctacgaggccatatttcagactatcacatggggagaaaccttggacaacacctggctttcctaggcagaggtacctgcggccttccgcagtgtttgtgtccctgggtacttgagattagggagtggtgatgactcttaaggagcatgccgccttccagcatctgtttaacaaagcacatctagcacagcccttaatccatttaaccgtgagttgacacagcacatgtttcagagagttcgggtttggggctaaggttatagattaacagcatctcaaggcagaagaatttgtcttagtacagaacaaaatggagtctcctatgtctacttcttcctacacagacacagtaacaatctgatctctctttcttttccccacaatcacccatcaaattggcatgttttaaaaaatggttatattcgggctgggtgcagtggctcacgccggtaatctcagcattttgggaggccaaggcaggcagaccacaaggtcaggagatcgagaccatcctgactaacatggtgaaaccccgtctctgctaaaaatacaaaaaattacccaggcgtggtggcaggcacctgtagtcccagctactcgggaggctgaggcaggagaatcgcttgaaccctggaggcggaggttgcagtgagccgagatcgcgccactgcactccatcctgtcgacagaatgagactccgtctcaaaaataaataaataaataaataaatattagccaaacatggtggcagggggcttgtagtcccagctacttagatagctgagttgggaggactgcctgagcccaggagtgtgaggttacaaggagctattactgcaccactgcactccagcctgggtaacggagcgaccttgtctctaaaacaaacaaaaccactacatttactcatcctttaagtaccaacatgttacctcctgtgagaaaattttccagaaataccatttaacacactaatagacatgtctctcgattgctctattgctgatcaattgtgtatttctccaagttggcctcctaatataccccaacccctctttcttcaagttggaagccacatttatgtagcttgaatattaaagttacgtatgtaaacatttaaaagcaggtgagtttgttaacttcggcaagcttatcagtagacagggccttccagtgaaaagagcacttgactagaaattaggagatttaggtactgtcctaaatctgtttctaccttactttctctggcctcagttttctccctcataaaggaatgtatctacagccctagtctctgggtggcgatttacggcttctctgccttttatcttcattctccgatccatccctcttcatcttacaggtgaggaaactgccatccagacattacatataacttagtcaagatcctacactattaattaatggctaatggcaagggaatcttgagatcctgtacggcggctgacccataaaatctacctagttctaaaattctttaacccacccacttaacaaaaacggaggtaataggtaaacaaaacgccaggaaagatcgcacttaaaggaacaaaagcacccaaggaggaaaaagaggcctgagatttccacgaattacaagtgaacttcctgtcctgggtaaacttccggaatcaacaacaggaagacccaatcagaatcttcctccgggagccaatgggagagcacattacaaagagccaatcccagcgccgctgtcactgttatggtcctgtcagggtgccggcgtcgtggtgcttgggtggtcgccaccaagaagactttggtggggtagtctcggggcagctcagcggcccgctgtgcccgtttctggcctcgctcgcagcttgcacgtcgagactcgtaggccgcaccgtagggcgagcgtgcgggtcgccgccgcggccgcctcggggtctgggcccagccgcagcctcttctaccgcggccggttgggagtcgccgcgagatgcagcctccgggcccgcccccggcctatgcccccactaacggggacttcacctttgtctcctcagcagacgcggaaggtgaggctgagcccctggaagggctatcacccggaggaagccagggcccgacgccgtagggtctttctggtgccgaggtggtcgtggccgggtggggacaggcaggaagctgactggtgactgcagcccaccacgcctgccgggccttccgagaggccccgaaggacggagggaggggtgtagggagctgctttttaaagcatcaagttactcggtcagcccttggttttccccataccgtctggtggctggtttttctgggtggcttagtctcttcaattggacccacaaaatcctaagcttttagttctggaattactcgcccttactcagaaaaaggacagattggccaagggagatctcaaagaatgagaaaaaggaaggagggctgttttcttctgttatgtatcaacagataattttttggggggggtctgggatcagattcggcactgcaaatacaaactaaatggtttttattgaatttgatgtcttgcccgagtccccgttttcctcgcattttgtaatgtttcacctcagtattcagagaaattgacgcaggtatattggaagtttagtgtaaaccaacaatgtgtttccagtagcctctacagatttccttgtattattctgaggaagcgattgtgctggagatattttcctacagcacaggagaatgtttccctcctattctcagttccctatccaactcataacctggatattattctgctagtcattttcaatttttttttttttcttgagctctgtcgcccaggctggagtgcagtggcgcgatctcggctcactgcaagctccgcctcccgggttcacgccattctcctgcctcagcctcccgagtagctggggctacaggcacccgccaccacccccgactaattttttttgtatttttagtagagatgaggtttcaccgtgttagccatgatggtctctcgatctcctgacctcgtgatccgcccgcctcggcctcccaaagtgctgggattaccggcgtgagccaccgcgccccggccattttcaaatttttattacacttcgtgcaccagttattttccagtgaccagacttactggctgctatgaaatcataaattatgtttacagaaatttcagtctgagaaagaacctagattttcctttttttttttttttttttttgagactgagtctcgctctgtcgcccaggctggagtgcagtgatgccatctcggctcactgcgagctctgcctcccgggttcacgccattctctggcctcagcctcccgtgtagctgggactacaggcgcccgccaccacgcccggctaattttttttttttttgtatttttttttagtagagacggggtttcatagtgttagccaggatggtctcgatctcctgacctcgtgatccgtccgcctcggcctcccaaagtgctgggattacaggcgtgagccaccgcgcccggccgaaagaacctagattttcctaagaaattttatggtgtatcagtatagcttgttttcccttttgtttttcttgttgtgctgtttggcattgttttttaaaaatagtactggtcataatttaaaatgtacaataaaatttttgtctatcaaagggaacatagctgagacatttatttttttttctcttatgttctttttttttttttttgaggtgtggtctcactcggttgccaggctggagtgcagtggtttgatcatagcttactataacctcaaattcctgggctccagtgatcctcccgcttcagtctcctgagtagctggagaccgtctggtggctggtttttctgggtggcttattctcttcaagtggacccatgaaaccctaaggtctgtgccaccgtgcccagctaatatatatatatatattttttttttgaggcggagtctcactttgtcacccaggctggagtgcagtggtgcagtcttggctcactgcaagctccgcttcccaggttcatgctattctcctgcctcagcctcccgagtagctggaactacaggtgccagccaccacacccagctaatttttttgtatttttttagtagagacggggtttcactgtgttagccaggatggtcttgatctcctgatcttgtgatccgcccaggctaattttttttttttttgagacagagtcttgctctgtcgcccaggctggagtgcagtggcgcagtctcagctcactgcaagctccgcctcccgggttcacgccattctctgcctcagcctcccgagtagctaggactacaggcgcccggcaccacgcgcggctaattttttttttgtatttttagtagagacggggtttcactgtgttagccaggatggtctcgatctcctgacctcgtgatctgcctgcctcggcctcccaaagtgctgggattacaggcgtgagccaccgcgcccggcctaatttttgaacattttgtagatctcactaggttgcctaggcttgtctcagattcttggcctcccaaattgctgggattacagatgtgagctaccagccaagccgtaaatttcttttaaactgagatacagcaccccaaaatatttcaatttgtttcatctacatttggtagcatggtgcttagggaggaatatcaactttaatttcccaggtttaaaaaaattgtttaagtgtcagaacatgatgtttgttcaaactcatgtttccatgtatttgtttatttttttcattctcccttccctgaggaattactttttttaaatatgcctaagaaatccgacagaataatgtaagtagataacccattgattccacatactaagaaacctgaaataagtaaaaatccatgaagtttattcaaacttctctgtatttcctcaggagacatataggtctgtatatccacggagctatatgtatatgcataatatcctcacacaatattatatcgtacagtttaaatttagagtattttaagtatactactcatttgatctttttttttttttccttttttgagacagagtttcactccccttgcctagggtggagtgcagtggcttgatctcagctcactgcaatctccacctcctgggatcaagtgattctcctgcctcagcctcctgagtaactgggactacaggtgtacgccaccatgcctggttaatttttgtattttttgtagagacagggtttcgccatgtttcacaggctggtcttgaactcctgggctcaagtgatccacccaccttggcctcccaaagtactgggattacaggcatgagccaccacacccagcctcatttgttctttataagactcccagtgagctttattattcctgtattctataaagaaactgaggtgagctgggtgtggtggcttacacctgtaatcccagcactttaggctgaggtgggcagttggcttaagctcgagagtttgataccagcctgggcaacatggcaaaaccccatctctacaaaacatacaaaaaattagccgggcatggtggcacgcacctgcaatcccaatcccagctacctaggaggctgaggcaggagaatcacttgaacccagaaggcagaggttgcagtgagccaagatcatgccatcacacttcagcctgggtgacagggtgagactctgtctcaaaaaaaaaaaaaaaaaaaaaggcaaccatggtagtgcacacctgtggtcccagctaccatggggtcagctactctgagtctcacttgagactgggaggtctaggctgcagtgagctgtgattgtgccagtgtgctccagcctaggcaacaaagcaagaccctggctgaaaaaaaaaaaggaaaaaaagaaactgaggcttagagaggtttagcaattttcacatgctagatctggaattaagagctagtctacagccaggtgtgatagcatgcacctgcgatcccagctactcaggaggctgaagcaagatgattgcttgagcccaggagtctgaggccacccaggggaacgtagtgacaccccatctcaaaaaaacaaaaccaaagagctattctgctatctcctcaagtttctttctactgtctctttcttacatttttctaaattgtgtatctgaagtatggaagagtcctggatttgcatcctggctttatcaattactctccatgtgatcttgggcaagctacttaccttttttgttttgttttgtttttgagacggagtctcgccctgtcgcccaggctggagtgcaatggcaccatcttggctcactgcaacctctgcctcccgggttcaagcgattcttctgcctcagcctcccaagtagctgggattacaggctcgcgccaccacacccagctaatgttttgtatcgttagtagacacggggtttcaccacattggccaagctgttctcgaactcctgacctcgtgatccacccgcctcagcttcccaaagtgctgggattacaggtgtgagccactgtgccccgccaacttaccctttcttaacctcattttcctcatatacaaattgggaataagaatacccaagtgcaggccaggtgggtggctcacgcctgtaatcccagaactttgggaggccgaggtgggcggatcacgaggtcaggagatcaagaccatcctggctaacaaggtgaaacccagtctctactaaaaatacaaaaaaattagccgggggtggtggcgggtgcctgtagtcccagctactctggaggctgaggcaggagaatggcgtgaacctgggaggtggggcttgcagtgagccaagatcgcgccactgcactcccgcctgggcgacagagtgagactgtctcaaaaaaaaaaaaaaaaaaggaatacccaagtgctcaaatactttgtaaatgtaaaacatttactactatatctggcagagttaagtgttcaacatatgtgagtaatgatgttgctgcttgggtttcagtgttaactgaccccacactttttttttattgttttccaacatgaacattttactgtacaactccgggtcttttccctggtttctacacgtcatataaattcttgcttctcccctttttatagtgttttttaaccatgaatattttcaacttacagatgttttcagtgtataaccttccttctagattctgtccaaatccctcattcttaatgatagctatccttactatttctccacacataccctttattctaaaatgtgctttggtgttttgtctccatgtggatgcagattctgatcatcatgcttagaatgtctttctcctcctcgccttaagttaaaacctaagactgaactcaaatgctctttccttggtaaaacttgctttaactgtccctcagaaacggaaacttcctaatattttctataccccagtacctatcatagaacccatggtataaatatcacaaaagaattatttgttgaataaattatttttgctttcatttatctcatgtctttttttttttttgagacaagagtctcgctgtgttgcccgggctggagtgcaatggcgcaatcttggctcattgcaacctctgcctcccaggttcaagcaattctcctgcctcagcctcccaagtagctgggattacaggtgcctgccaccatgctcggctaatttttgtatttttttaatagagacggggttttaccacgttggtcaggctggtctcaaactcctgacctcaagtgatccgcccacctctgcctcccaaagtgctgggattgattacaggcatgagtcaccacgccaggcctaatatcacttcttaatttaagctttatggtattgtttgcccttccatcaattaattcattcaataagcatgcacatttgttgattgcctactatggatcaggcactattataagtactggggatatatgtaccaagacaaatgccaccaaaaatcccaaatagtctctcctttcatagattttataaacaaccaagtaattacacaaatatataattatatatagtgataaatatcgtgaaggaaaagtggagggaactgtgaaaggaacttacatagtctagtctgcaggatcaaggaaaatttgcttaagcgagtgtaatggtttggatttgtgtccctgcccaaatctcatgttgaattgtaatcttcagtgttggaggagaggcctggtgggaggtgactggatcatgggggtggacttccctcttgctgttcttgtcatagtgagttctcacaaggtctggttttttaaaagggtgtagcacctccactgtctgtctctccctcctctggccatgtaaaactgcctgcttcccctttgcaatctgccgtgattgtaagtttcctaaggcatacccagccatgcttcctgtagagcctgtggaactgtgagtcaaacctcttttgtttataaattactcagtctcaggtagttctttagagcaatgcaagaatggactaatacagcaagtatatctgagaactgaagaatggatggcatttaattatctgaagttggaggaaacagcctggcacaaggtccctgagacaaacagaatccaggttcattcagagaaatgagaggcttagtgtggctagggtatagagtccagattgagaggagagcaggtaagtgggcctggataagatagggcatgtagagattattggacttgagctagaaaagcaactgggggagggagatgaaggattctaaacaaaagagtgaaatatttgcatcttagaaagagtctccggggtacagtgaagagtatggattggaaggagacaagaatgactggggggagggcagtttgtacaccattataatcatgcagacaggagttgatggtttgcatgagcttgctactggtggtagaaatggtaagtggacagacatttaaaaatatttagaggtaaaactgacaatttagtggtggtttggatggagaggaagcatgcaaataaagcaaactgtcaaggataagcttctagcttacaatgctggatagattagtagtatcatttaatgaaaaaaatggaggaagacctgagatatatcagttttggaatattgaattttagatgcctttgagatagatgcaaggaaatgttgacaataggttatataaatctagtgaagaggactggactcaatatattgcatttcaaccttggccttcttcagtctttttatccctatataaaaattataatacctgcagctcacaatacagtgatcagtaaattgtagataattactatcagtgttcttttgagtgatacttttctgtcactctgttattgtgaccatttcagcctattctttgtttgaaattcccccttcccagaaaggatgtcacctctaatacaagttagtaatgtagacagaggaatctttagtttttccttttttttttttttttggagacggagtcttgctgtgtcacccaggctagagtgcagtggtgcgatctcagctcattgcaacctccacctcccaggctcaagcaattctcctgcctcagcctcccaagtagctgggattacaggtgctcgccaccgcacccggctaatttttgtatttttggtagagatggggtttcactgtcttggccaggttggtctcgaagtctatgattcctacttatgaaaaataatatccatataggtctagtcttatcacaaatgttttctatacaatatgctggtgaagtatgatatatagtatgtaatgggtgcaagaataacttttatttcctttttgaaaactgaaaatgacattttagccaacctttcttaggggagttaaacaaggtttacttttttcattaattaatctacttatttgcatgagttttaaaactcataaggcattacacaaatctacaaatgtgattaaattgcatagaactataaacacatatacacacacacaaatgagtgcatgtcaaactggtgaaatctgaataaggtctgtggattgtaccagtgtcagtgtcctgaatttgatagttatgtgagtttgtactattgggaaaaactgggtaaagggtacataagacctctcttttccatttttgtaactttctatgaatctataatttttcaaaataaaaatttaaagacataagacaaaagaaatttcatctttttgtttatcagataaattacagaatttaattatttacagtatgaaaatttacctataatatttgatagaaaaactactaaaaccataaaccagaacaacatgattaaaaatataacctaagacaaaaatttatacaagactttgaaaaaaacatttttttttttgagatggagttgcgctctgttggcaggctggagtgcagtggcgcgatctcagctcagtgcaacctccacctcccgggctcaagtgattctcctgcctcagcctcccgagtagctgggactacaggcgcacgccaccacacccagctaatttttgcatttttagtagagacagggttttaccacgttggccaggattgtctcgatctcttgacctcgtgatctgcccacctcgactgggattacagacctgagccaccccaccctgctgaaaaaaacattttcttacagagtaacgtgatcaagctccagtataggtctagcagttacaagattatgcacatgcattagtttcttgatctctttcataggcctatgtatacattaaaatggtatccttaggccaggcacagtggctcgtgtctttaatcccagcactttgggaggccaaggcaggtgtattacatgaggccaggagttcaggaccagactggccaacatgttgaaaccccatctctactaaaaatacaaaacttagctgggcatggtggtgcatgcctgtaatcccagctactcgagaggctgaggtagttgaatcgcttgaacctgggaggtggagattgcagtgagttgtgatcatggcactgcactccagcctggacaagagagtctgtctctaaaataaataaaatggtatccttataactcaaatgaaataatgaaatttattaatatcttttagtgcaaaaacatatgcttgtttttgtttctgtggcacatatacacaactctgggtcatactgaagcacacatagacttcattttcaagtctgagatgagatgaaacgagatgatttttgtccttgctcttgttgcttattaaataaggaaaagcttctttacgtatataagaatgtgtcaagtgccacaaaatgttcattgtttattgcaggatactcttctttcacagaaatcgggaacttgtctaggggcagatcagtagtaaatttcatcttcagtgtactatcacactgcactgtgagaatttttcacattctcaggctgagcagaagattcagagaaaggaccccatacccagtcatacatttgagttgaaagggaagaaaaattcctgttaaattttgttgtgtgggttttccaaaggtggctttcagtaagacttgaaatttactgatactcttcactctgagccaaaacagctgtagaaacatttttaaaatttccttttacaatagattttttaaaagattgtatctttttaaatccacttttatatttattatcctttacattgtttttacttaggaaatgacaagaatattttatatatagtatagtaaggaagaattaacctaaaattcatgttttactatctggacgtctatccaagagctgacaaccaagctagcttgttcttactctggtttaaattaaatcagccatgctcctggagtaatttttaattgtttttcttgctctctgacatcattctccacttgttaacttgataacatgttaaactactactaattttttggactttcctgttctttctcactgacagttatgtcttgggggtcctgggggaggtgtcaaactgctattgttggcattcctacatatgtccttgatattttttctactttacatggaacagaaagtactagaaaatttgtaagctgaagatgcctttttgaggttcttgcatctgcgctatgacaaactgctaaacatgtacagttcttgagcacaacattccttagcactataatttatatatccttttttggtttagattaaggactttaagtacagtcctttctagaaaccaggaaacagttgttaaggtcctttccagcctcataactgcaaaacctctaatgtcactgctgtactaatgatttctggatgtaaatcttcttcttgttaagaaaaaacactcttggcctggcgcggtggctcacacctgtaatcccagcacttggggaaggccagggtgggcagattatctgaggtcaggagttcgagaccagcctggccaacatggcaaaaccccatctctactaaaaatacaaaaattagccaggcatgctggtacacgccagtaatctcagctactcaggaggccgaggcaggagaattacttgaacccaggaggtggaggttgcagtgagccgagattgccccactgcactccagcctgggagacagagcaataaataaataaataaataaaaattagccgggcatggttgtgtgcacctgtaatcccaactcaggaggctggggcaggagaatggcttgaacctaggagacagaggttgcggtgagccgagatgacaccactgcactccagcctgacaacagagtgaggctctgatacaaaaaaaagaagaaataacactctttgtatctattagaaatagacttttaaattccacctctctcatttcaacttagacaaagaagtagcaagcacttataagagagtattttcactatgcaattatatgataacatgtacagggattatttttgaactttaagtggtgaattcaaatctggttatattttatctctgagtgagcgcctttataaaaactttttagaattatataatgtttaacctggaaagaactttgaataggaaactagggcccggaaaacatgaatgatttgctgtatcagttagtagctaagctgggacttagcttcagaatgtaaacatttgtcaaacttaattgcaggagttgtcataagccgaccaggatgtgactcatagagtattgtgcaaattaagctctttgtactgtatatgaaaaatggttttttgttttttaaggaagctaactttggtattggttggacatgatctccagagaggtatctatctgtgttagagtgttctggtttggtgtttccaaaagtatttttctgaaataatactataatcatgtgacttgcactgacagtattgatggttgtttattaatgtatattatctggtcctacaaatgtgctttttctttttaatccctatgtgacctcaggcaaatccttaactatttccattttttaactagcaaagatggcattagtactaccatgattatctgtaacccctgagatactgtgcagactctacatggaatttattttttaatgtggataactgaatctcttcacctcttgttagagccgacctaaaaaataaaaacaaaaagaaaacatagcctttatttatttttgccaaaactgaagatgaatgatgtaattatgtgaagaaaagggaagttttggctgaaataacaggggactcttactcatcagacttatcaagaattaagcattaatatatgaaacacttagcatagatatgtgatgatttaaatgaaagaatatatgaataaataaatacatgaaaaggtagagaaaaattatctacgaatttcctttagtaaataaattgtctaatagtttgtatatatacatatgtaatgcctctgaaaagaatttattcagttactttgttctgaggcacatgatatgtgtaagaatgaaggaatccaaaatgatgtcatgtaatgtattttgcatatattttccatggaaattttaaggaattactgttgttaagtctagattctggtaccagtctggctaattagctgtgaaaccttttgtacgttttttcacttctttcatctttcattttattcttataaaataaatgatggtttttagatgtctgtcaactataaaatttgaagattatatgcaatagcagatgttcttagagatcttcaaatgataattattttagttgaatatctgctcactttggttaagattcacatgttgtgccttagtttatatagttttatcctcttttctcctaagatctcagtggttcaatagcatccccagatgtcaaattaaatcttggtggagattttatcaaagaatctacagctactacatttctgagacaaagaggttatggctggcttctggaagttgaagatgatgatcctgaagataacaagccactcttgtatgtaaaaataataatatatattttttgttttttgagctagtctgtgggatgattatattcttcttgttatttagagagaaagcattaaccttttttggtcaaaagctatagtgattgtcaattttactagtaatttaaaaaactgaaataataatgagagaatattttttaaccaattaaaagacaaaaattaaaagaatggtaatcctgtatctcacacacatgtgtgtctactccagcttacctgggtctgtcagctatctgaagtaatcatgcaatttaaaaaagcagggctcttaggtactagctgttgaaattaaggttcggacaaattaagatttccaagaagattaccactccaaaatctcttcaacatagaaattctagagctgccactgggaggagagctacatataaagaggctttcactttctttatagtacttgaaattttgtggttatctggagaaaaaagtaaagaaataaataattttgaaaagaagaacctatagctttgtaaaattgaggcatttccagattcttctttgtattaattatcagtagagtaagtgctgaaacatcctgtgtttcttcatgttaatacaccatatatcggccaggcatagtggcccacgccagtaatcccggcactttgggaggccgaggtgggcgaatcacttgagattagaagttcaagatgagcctggccaacatggcgaaaccccatctctactaaaaatacaaaaaaagaaaaaattagccgggcgtggtgtcaggggcctgtagtcccagctgctcgggtggctgaggcatgagaatcgcttgaacccaggagacggaggttgcagtgagccgaaattgccccaccgcactccagcctgggtgaaaaagcaagactcttgtctcaaaaacaaagaaacaaaccgtataccatcaaatctaagacactattgattataagatgaagttattttacatattaattaaacagaaaagtgcgtaagacggcataaagctgggacatcaaagggctatctccttattagtgtaaggatgaatgagaaataacccacaacacaaagacagcaaggaagtttgcttcagtttgacagtggataagatgttgaaagaaagaatttccccagagaatataaaacctacactggttctcatatgggtttgcaatctgaattaggcccaaaaagtcacaagcagaaaattttacttaaagttttcttaaattgatagggcttccaggagactggcaaaaggaaaggtaaatattagaaacacttggcgtcactccaggctgacgattgtaagactccagtgatagagatatgtcccacatttagagatattggaatgttaaaaatgtacagcttggaattagtgaaatgtggcacttcaaatgcaaatgttttgttgacctatggagattataactgtcttatttaaagttttcttaatttttttttggaattgttttagtattcagaaatgtgtgccttttgagaatttttattttaaaattatagggaagaattggacattgatctaaaggatatttactacaaaatccgatgtgttttgatgccaatgccatcacttggttttaatagacaagtggtgagagacaatcctgacttttggggtcctctggctgttgttcttttcttttccatgatatcattatatggacagtttagggtaagtatatcttattttatacaaattctaaatattttgagagtttcaaaaattaaatataataagatattaactgtaatataccatattatgtttgagaaatgctttacccattatttctcacttgttcatccctaaaaccgttccataattaaataagtgaggagtaccttagattaatgctttcaaacttttccacatcatgattcacatagaaagtattagtatttgtgggcgggtgtggtggctcacgcctgtaatcccagcactttgggaggccgaggtgggtggatcacggggtcaggagattgagaccatcctggccaacatggtggaagccctgtctctactaaaactacaaaaaaagtatctgggtgtggtggtgcacgcctgtaatcccagctactcgggaagctgaggcaggagaatcacttgaacccgggaggccgaggttgcagtgagccaagatcacgccactgcactccagcctggcgacagagtgagactccatctcaaaaaaaaaaaaaaaaaaaaagaaaatattagtatttgtatggcacactggggtaaatgaatagaaccacttccagctgaccagaagtcactagaaggtgcaccttctgattttcccaagagatgaacagtttgaaatgtaatactcatattcatatttcttaccttttttttgattatttttatttttatttttatttttttatttttatttatttatttatttatttttattgatcattcttgggtgtttctcgcagagggggatttggcagggtcataggacaatagtggagggaaggtcagcagataaacaagtgaacaaagaaacaagtgaacaaaggtctctggttttcctaggcagaggaccctgcggccttctgcagtgtttgtgtccctgggtacttgagattagggagtggtgatgactcttaacgagcatgctgccttcaagcatctgtttaacaaagcacatcttgcaccgcccttaacccatttaaccctgagtggacacagcacatgtttcagagagcacaggtttgggggtaaggtcccagatcaacaggatcccaaggcagaagaatttttcttagtacagaacaaaatgaagtgtctcccatgtctacttctttccacacagacacggcaaccatccgatttctcaatcttttccccacctttcccccctttctgttccacaaaaccgccattgtcatcgtggcccgttctcaatgagctgttgggtacacctcccagacggggtggtggccaggcagaggggctcctcacttcccagtaggggaggccgggcagaggcacccctcacctcccggaaggggcggctggccgggcggggggctgaccccccaacctcccggacggggcggctggccgggcagaggggctcctcacttcccagtaggggcggctgggcagaggcgcccctcacctcccggacggggcggctggccaggcggggggctgacccccccacctccctcccggacggggcggctggccgggcggggggctgaccccccccacctccctcccggacggggcggctggccgggcggggggctgacccccccaacctccctcccggacggggcggctggctgggcagggggctgatccccccacctccctcccggacagggcggctggccgggcagaggggctcctcacttcccagtaggggcggctgggcagaggcgcccctcacctcccggacagggtggctggccaggcgggacgctgacccccccacttccctcccagacgggtcggctggcctggcaggggctgacccccacctccctcccggacggggtggctgccaggcagagacactcctcacttcccagacggggtggctgctgggcggaggggctcctcacttctcagacggggcggctgccgggtggaggggctcctcacttctcagacggggcggctgccgggcggacgggctcctcacttctcagacagggcggctgggcagagatgctcctcacctcccagacgtggtcgcggccgagcagaggcgctcctcacatcccagacggggcggcggggcaaaggcgctccccacatctcagacgatgggcggccgggcagagacgctcctcgcttcctagatgggatggcggccgggaagaggggctcctcacttcctagatgggatggcggccgggcagagacgctcctcactttccagactgggcagccaggcagaggggctcctcacatcccagacgatgggcggccaggcagagacgctcctcacttcccagacggggtggcggccgggcagaggctgcattctcggcactttgggaggccaaggcaggcggctgggaggtggaggttgtagcgagccgagatcacgccactgcactccagcctgggcaccattgagcactgagtgaaccagacaccgtctgcaatcccggcacctccggaggccgaggctggcggatcactcgtggttaggagctggagaccagcccggccaacacagcgaaaccccgtctccaccaaaaaaatacaaaaaccagtcaggcgtggcggcgtgcgcctgcaatggcaggcactcggcaggctgaggcaggagaatcaggcagggaggttgcagtgagccgagatggcagcagtacagtccagcttcggctcggcatcagagggagagggggagggggagggggagggccatatttcttaccttttattgactcataattctgttcttaaaatgaccgttactttaaaagaatgatgagaaggattccatcagtatttgtttttatattactactggtattttaatccctttgtcctactttcagatactttatcaccaaaacacaacatatatacatcactctctcatgccaaatttaaggctttgaaggagtaaaaagttactgtttaccacagggatttggaaatgaatgagtttctggtggctgctctaataaactgctacaagcttagtggttttaaataatacagatttattattttacggttctggatgtcaggagtccaaaatgagtcttaaaggactaagatcaaaatgtctacagggctggttcctgtggaagctccagggcagaatctgttgcttgtttctttcacttccagaggctgccagcattccttggcttctggctgcgtcactatgatctctgtttccatgatcacattaccttcccctctaatgtacttaaatctccttcagtttccatctttttttttagacggagtttcactcttgctgcccaggctagagtgcaatggcacgatctcagctcactgcactttctgcctcccgggttcaagtgattcttctgcctcagcctcctacatagctgggattacagacatgccccaccacccccagctaattttgtatttttagtagagagggggtttcaccatgttagtcaggctggtctcaaactcctgatctcaggtgatccacctaccttggcctcccaaagtgctgggattacaggtgtgaaccactgtgcccagcctcagttttcatcttttaaggacaattgttactacatttagggcccagcaaggtaatccagaataatctctccatcacaagatacttgatgcattactatactagtcctattaatatttacactagattagtagtttatatcagatgttatgttaaagtgttgcaaagaccactgaagaaggtgaatggggactctggtctcctacctaccactggttcttcatctagaacatctctaattgtatctgttttgtataatctttcatttgaacaaagggttctaaggttaaaaacagaagattacggctgggcgcagtggctcatgcctacagaccgaggcgggtggatcatgatgaggtcaggagttcaagaccagcctggccaacatggtgaaaccccatctctcctaaaaatacaaaaattagctgagcgtggtagcaggtgcctgtaatcccagctactcaggaggctgaggcagagaattgcttgaacccgggaggtggagattgcattgagccgagatcacgccactgcactccagcctgggtgacagagcaagactcagtctcaaaaaaaaaaaaaaggaaaaaaaaccccagaagattactataccatcatagaacgtcactcattttggatttccttgatgttttctcatgatttgatttggattatgcatttttggcaagaatatcacagaagtgacattgtcctgctctctgtatactaacagggagtatgtgatactgatacgtcttataactggtgatgttaaccttgatcacttggttaggtgatagggtagtatctgttcaatttctccagtataaagttactatttttctctttgtaattaataaatagcttatggaggtactttgcaactatgcaaatatcctgtttctcatctaactttagcctactaattttagcatccattggtagatcttgcatgcagtaattattactataatgtttacagaatgatgatttttctgtttccctcaatcattttatttgagttataatccagtactgtcataatttatttcatcgctcagatttttcaagctttaaccattgggagctccttcagcttgcattctgtctcgtttcaacatatcccattctttttttgagtacttcctttccttcttacttcacacagtgttctgggctaatcttgtattttgcctgccccagccttggaatcaaccgtttttttgtttttttttttcttgaaatggtgtttcactcttgtcgctcaggctggagtgcaatggcgcaatcttggctcaccgcaacctctgcctcccaggttcaagcgattctccagcctcagcctccggaatagctgggattacaggcatgtgccaccatgcccggctaattttgtatttttttttacagggtttctccatgttggtcaggctggtcttgaactcccgacctcaggttatctgcctgcctcagcctcccaaagtgctggaatgacaggcgtgagccactgtgcctggccaaccatttctttaagaagtcctacttcctttaattaggaaatgatacttagaaaccagtttctggggttggtcatggtggctcactcctgtaatcccagcactttgggaggctgaggtaggaggatcacttgagctcaggagttcgagaccagcctgggcaacatagtgagacctggtctctattaaataaataagtacatgaccaaataacatagcaagacctcgtctctattaaataaatacataaataaaataataaataataaaagaaaccagtatctgggtgataaatgtgcttatgttgctactggggtattatttctagaccattccagcagacagcttcaaaatacaaatatatgtatgtattgttacaccaagtttgaggagtttaaaattgtctgaaatggcttccatattccattacttgaataaatatgtaatctaaattttaaagacttccagagaagattggtaacttgcttcagaaataaatttttcttctgggatgctgtaagacagggggttgatagtaaacactttttttttgcaataatcttttatcatagattttgaaatactgaggtttctttaggcaattgataattgctaagattttaatttggatgtaaaattgtattacacattgtattcttattaagttttggagtaatacctgagagcccacataatctctctatgacctgaaattgggcatgctaaactgtcatttatggcagagaatcgagttcctggaaaattatcatcttatttggtataaaaatattaattgcatgatttttccccctaaggtggtctcatggattataaccatttggatatttggttcactaacaattttcttactggccagagttcttggtggagaagtaagtagtttattttgaaaataatcttccttatttatggtgagcttagtttttgatactgcagatatcatcattagctatacaagaaactttcttgtcccagaattgctttatgctagttcctttaagatgatcaacatattagtattgtgcttactcaataaatagtacaagaaatgaggaaaaagaaaatatcccgtcccatttatgaagtaattgcagccttttagggaagcatataatttatttattttttatttatttatttgaaatggaatcttgctttgtcatcctgctgcagtgcagtggggcaatctcggctcattgcagcctccgcctcccaggttcccgattgtcctgcctcagccttccgagtagctgggattatagatatgtgccactatgcccggctaatttttgaatttttagtagagacagggtttcaccatgttggccaggctggtcttgaactcccaacctcaagcgatctgcctgtttagcctcccaaagtgctgggattacaggagtgagctactgcgcccagacaaaatttatttatttatttattattattatttttttttgagatggagtctcgctctgtcacccaggctggagtacagtggcacaatctcggctcactgctacctccacctcctgggttcaagcgattctcctgccttagcctcccgagtagctaggattacaagcacctgccaccctgcccaactaatttttgtatttttagtagagatggagtttcaccatgttggtcaagctggtctcaaactcccgatctcaagtgatctgcctcagcctcgcaaagtgctaggattaccggtgtgaaccactgtgcccagccagaatttattcttacagaaattctcaaactttgatctcaggttgccaaagagatttgtaacaataaaccaactacattttaacataaacaatacatttaaagaaaaataaccatattttccaaaacaaaagagttagaagagtagcattattttacatttttgtaagtagctttaatatctggctgaatggaaattggattctaatacatgctttttccattcaatctgttaagatatattgttttggctaaagtatctgaagaaaataaggctttatacaggtatataattgaaaagggagagtattttaataaccttttcagatgatggtgaatattctctgatatcacaccagaactcaagggggctgggcgccgtggctcatacctgtagtcccagcactttggggggctgacgcaggaggatcacttgcgcccaggagttccaataccagcctgggcaacgtagggagaccctatctctttaaaaattatccaggcatagtggtgtgtgcctgtggtcccagctactagggactgaggcaggagacttgcctgagcctgaggggttatggctgtggtgagctgtgttcgtgccactgcactgtagcctggccgacggtgaaatcttgtcttaaataaattaaataaataaggagttttgagctgggtgtgctggcgcatgcctgtagtcccagctacttgggaggctgaggcaggaggatcacttgagcccaggagtagtttttttgttttttgttttagcctggccagtgtggtgaaaccccgtctctactaaaaatacaaaaattgctgggcgcggtagctcacgcctgtcatcccagcactttgggaggccggggcgggtggatcacctgaggttgggagtttgagaccagcctgtccaacatggagaaaccccatccctactaaaaatgcaaaattagctggatgtggtggcacatgcctgcaatcccagctactcgggaagctgaggcaggagaatctcttgaacccgggaggcggaggttgtggtgagccatgatcgcaacattgcactttagcctgggcaacaagagcgaaactccgtctcaaaaaaaagataaaaaaattagccgggcatggaggcacgcgcctgtagtcccagctactcaggaggccgaggcagaagaatctcttgaacccgggaggcggaggttgcggtgagccgagatcgcgccactgcactccagtgtgggcgacagaggaggactccgtctttaaaaaaaaaaaaaaaaaaaaagagtttcttttatcccttctattttcagtttcagaagtgaatgatattagaatatatgttcaatcgagcatcttaataaaactcttgaataaatttagagtaacatctgtgaaacctttttactctgcatatggaaatttaaaataattctaatagacacttaaagtatatttgtttatatattatttcttatgtcctagacaaaacctagtataatatttatatgaaaatatgtatcattacgtgttttggtaattcaggaatgttgatgtaggagtttaggggcctacattttaatttgaacactgacaccttactagctttgctttccggagcaaagcagtgtttctctctaagaatcgatttcttcacaatagggacaataatgcctatatttcataggattgttatttcatttactctccacagcatgtgaagccctatcacagaacttggcataaagtagtcactaaaaaatatttttctcttcagtctctcctggctaccttccctttccttctggtcggcattggtaacatctaggttctctagaccttggatttttcatctgaatgggatggttgtagtccctttaaataattctacaatttaggggaagtagtgacaaaatgtaatgtagagatatactgaaggtagtatgaaactcaagagagaggtaaatgctggaaatatagatttgggtattatcagcaaatttattttaattgaaaccatgttggttggtgagactgcccaggaacatgggagactatatgatattttgaaataatgagtataatagtttatgatttcttcttaatgctcacatttatttgaatacagcaaggaatatatggtgttcaattttgattaaaatgagtatcttgatttcaatgatatttatttgaaattttcaaaattcacaggttgcatatggccaagtccttggagttataggatattcattacttcctctcattgtaatagcccctgtacttttggtggttggatcatttgaagtggtgtctacacttataaaagtaagttaaggattatgtattacatagtttactgttttccaatgtcaaaagtatactaggcctctagctaggaatattgtgatataaaactctttatcaaacagttggtagtattttggaagtgaccttccttactgattttgccagttatatttctttcattttttttcctttttaatcaccagatattactgtttgtctgggggaaaaaacaaagagcaaatcaggtttcaggatattatagtcagatttttgttttgttttctggagtctcgatctgtcaccaaggctggagtgcctcccaggttcatgtgattctcctgcctcagccttcctagtagctgggactacatgtgtgtgccaccatgcctggctaattttttgtttttagtagagatggggtttcaccatgttggccagactggtcttgaactcctgacctcaggtgatctgcctgccttggcctcccaaagtgctgggattacaggcatgagccaccacacccggcctggtcagcatttttctttttctttctttctttttttttttttttgagacagagtcttgctctgtcgcccaggctggagtgcagtggcgtgatctcagctcactgtaacctctgcctcctgggttcaagccattcttctgcttcagcctctcatgtagctgggactacaggtgcgcaccaccacacctagctaatttttgtgtttttagtagagacagggtttcaccgtattgtccaggctggtctcgaactcctgaccttgtgatccacccgcctcagcctcccaaagtgctgggattacaagcgtgagccactgctcccggctggtcagcattttttaaatgttggatttaaaatttattttctgtatttataatatgagttcatctgacagattttgagggggatatttatttaaaattccactggacatttatttagtaactgctactcctgtttgaatagtaactttcctatcaaatatgatagatgtggttctaataaattggattttccgtagtgcagagatcaggacttctttgtgttatttatgttaaatcaacatatatacatatatttaaatatttactgataaaagtattaataaatagtagtgtaacttaaacattggaatttattaatgtcgaacaactttgggaaataaatgactgctttgacacatatatgtatattacacagtgaatataagtttgttctttatggagaacagaacttttaaagactgtgactttcagaactgctgttatgtagcttccacatgaaagtatttgtttttaagtagctgagccacttgaaattattactaatttcaatataaaagaaataatgattccttttagaatttggaaactatacgctgatactgataataagcattgggaatcgaaaatgtgtggtttttggaactaatcagttctaaattcaaaccctggttctgccacttacttgctgtctggtcttccgaggtatcttaacttttcttaccctcaatttgttcttaacaatggtaaacttaactatattttagggttcgttacaaagagtttatatataatgctgatcaggcatggtggctaccgcctataatcccagcactttgggaggctgaggcgaatggattacttgagctcaggagtttgaaatcaatcagcctgggcaacgtggcgaaactccatctctacaaaatttagccaggtgtggtggcgggtacctgtggtcccagttccttgggaggctgaggtgggaggattgcttgggcccatgaggccgtggctgtagtgagccatgattgcaccactgcactccagcctaggtgacagagtgagaccctgtctctgcctagtacagtgcttggcacagagtaggcactcaagctgttgttattacaaatattataaaataggccaggtatggtggcttactgttgtaaatcccagcagtttggcaggccgaggcaggtggatcagttgagcccagttcgagactcaaccatttctccaaaaatacaaaaattagccgggcatggtggcatgcacctgttagtcctagctactcaggaggctgagatgggaggatcgcctgagcccaagaggttgaggctgcagtgagcagtgatcgtaccattgtactccagtgtaggtgacagtgagaccttgtctcaataaaaacccaaattgtaatattttgagatcatctttgtgtttaaatacttcagagactaaagataccttgttttcctattcagtataaccctaaagcctttttttgaaattggcattattagaacttagtttaaagtcttaacgttgcagcagacatttaattattcctattccagccttagtgaacataccactcacttaccatcatttcctggtgtgtgttttttcacttgggttaagcttgtttctgagactactcccaaaatggttaaaactattgttctgtggtcatctttaatcatatagttatcttaaagttggacctaaatattctttatacaacatataaatgtattataaaatggaaaactcttttttatatcattaaaaatttagagtaaaattgtttttaaacttcagattattctttgccaaaatttttttcctgatcatttaatcttctgtgagtagtgagctatttcacgtttcttatttcagtctgagttttgttgagaaatatgatgcgaaactaatcagtaaactccagcattagagtatatagtttaagtgcagtgattttatttaacattaaatctctgtaatacttatcactctgtaagcatttataatgaaaaaaatctaatcatgaaatacaaatgcagtttgatcaaattttattttatatatttccctgtacttttgtgtatgtttgaattatttcatagggttactttttttttttttaagttcaacaaacccagtggaaagatggaccagaccaaatacatttttaataagtttgccaatatttattttttacctgtataccagtgattctcaactgaggtagattttgtcccccaggggacatttgtcaacatctggaggcatttttgaggagtgtgactagtatatagtgtgtagagagcaggaatgctgctaaccatcctacaatgcacaggatagctccccacagccaagaagtacgcagcctaaaacgtcaatattgcaaggtttagaaactctgccttgtgccaggtctgttcctattagagtttccctgaatttccttgaagtttttccttaattttatgctataaaatgtgttaggtgactacatcaataagtattgcataagtttccagtagaaataatttaaaagtatgtatgtatgtgatccaaaaactatagtatactttatttaaactcttgacaaaatgtgatctttttatctcctttttattcaaccctgtatttctgcctattcctgggaaaaaacttaataaatattaagacttaataaatattgtataaaatttttacttaatcgattttcttatttagaaggaaaaggaaaatttcctactttgcaggaattagttttctctcagtaatttggtataataatagttttttcaaaagttgcctaatcataatcaccagggaacttatttaaaatactgataactagatccttcccttagaaattatagctcaaagaaaaagaaacaataagttataatttaacagaactagagagtcccccaagtctttttaataggcaccccaagtgattcttatgattagactggtttgataagaccacatttacagaagtcaaggagtagagcaaagatggacattcttaataagtttttaacatttgtaacaagttttactatttaccaaaattggttgttgattttttaaaaatattgtaaacaccatttttactctatgatatccaaaaagttaattgacttgctaatatgctgccttttgtcttttttcctttttttaaagctgtttggtgtgttttgggctgcctacagtgctgcttcattgttagtgggtgaagaattcaagaccaaaaagcctcttctgatttatccaatctttttattatacatttattttttgtcgttatatactggtgtgtgatccaagttatacatgaatagaaaaagatggtgttaaatttgtgtgtaggctgggaattcttgctgaaggaattggagaaaacctgttgctgcaaaattttacatgttccagatggaaagggaagtctaagcgctttttaaaacaatttttttttgtatttaattaagcaattgcagttatctgggatttttgggtcagaattttaaattctgtttgattctccatattccagtgaataaaatacaaaagcattgtgtttttaagattgtgtcgatattcacctaaaaacttgtgccaaaagcacctggattggtaattatatttcacttaaagggtaaatttgacaatatcttgataatcaaaagtgcaatttttttcttcaaaatgttttctccagcatcacagatcctgcagatatatatttatatttatacatatatatttatgaaataattcttactcacaaaatatatttctgataaacattaagatattaaatctgatgcacaaactttttaatttggccattaatcttttttatttaaaaatttaaatttgtttttaaaattgtatatagtttttaaaatctcacacatgcttcgatacttccttgttaagaattcttaataactactaaaactgatttttaatagttgctgatatatatttggtttgtttgggtatacttttcaaaaccatttttgaatgtccaaacatctgatttaaagtttctgtttatctttctgaccaaaggagcaagaggtataatggatatggcattcattaaaatctttactatgtacaaaaacagtaatatttacagcatcagtaaatatttttaagtggtacttctaaatcataaaagttggggaaagagacctttaaaatcttgtggtgttgaacaatgttatatgaagtagaaaaaataaaatacttcccagttgtgtgttttgttttacagcaccatgtcctgtattacttgatattttaacaagtatcaggtactctctaacaaatgtacagtttttgctaagggaaatattaagaaatttttatcagtgaaatatttgttgcaaataatttcataggtttttagatacacctgtagttaatattactttgtaaagtaggtaaatcattttatttatgtccataaaatatcaaatgtctgttaactattagcaaattattgtattatcctttctggtctcacctggaagagtttcctgctgtcctcagtatgataacatggcgacctcttggtatgtatttctttagcaaacttacccatcaggaaatatccagcacctctgaagcaaacctacaaatgagtgtgttatcaagcccagccgtcttcctttcccctaatcccaaaaggaaagaaagaaaaacttattttaagctgcagaaaaagtgtggagcacttttgagctagaataatgtagaaaattacatgtactgatttttttaaaaacaggtgagaagcaccagagggacaggacttctagaagttagaataatatgaagtaatcaggaaatatctatgcctacagaagcagcaaccgtaagataaacatttgttacacttaagaaattgctgaggttaatactttgttataatggattataatatttgacattcatagtgttgaccctggaatctttcacagaaagcttgggggtcaggaccaggaggtagaattttacaaggcaataaatgaaggtattttaagatcacctctattaaaaaatggtttaatttttaaaaactatcattgctttaaggtatgaattttaaaaatcacttatatggatcatgtttactcctaatgatataagataaaatgaggtatttttgttccaaaaagtattttaaaatagcatttaatcttgggaactatcttacttagggtttctataaatacaaattacaatgtttcgaactcaaccagtatcattttcgtgtgctaatgagcaaagtagttagaacagattgtcagtttaaaaacaggatttgtaggccaggcacagtggctcacgcctgtaatcccagcactttgggaggccaaagtggatgagcagcttgagtcaggagtttgagaccagcctggccaacatggcgaaaccccgtctctactaaaaatacaaaaattagccgggcgtggtggcaggcgcctgtataatcccagctactcaggaggctgaggcagggagaatcgcttgaacccttggaggtggaggttgcagtgagccaagattgtgccattgcactccagcctgggtaacagagcaagactctctcaaaaaaaaaaaaaaaaaaaaaaaaaaccatgatttgtagatgtgtgcaagacacagtactgctatggctaataatggtaagatgaccctaataatgtcctctccttgaatttttatataataatattttctgagtcataactaattttttaaataatgatttccaatctaattattaattagaattttgttgttgttgtttgagacagagtcactctgtcacccaagctggagtgcaatggcacgatctcggctcactgcaagctctgcctcccgggtttgcaccattcttctgcctcagcctcacgagtagctgggactacaggcgcccaccaccatgcctggctaattttttgtatttttagtagagatggggtttcaccgtgttaaccaggatggtctcgatctcctgacctcgtgatccgcccgcctcagcctcccaaagtgccgggattacaggtgtcagccaccgcaccaggccagttcattagaatttttaaaacaggctgggcatggtggcttacgcctgtaatcccagcagtttgggaggccgaggcaggtggatcacctgaggttgggagtttgagaccagcctgaccaatgtggagaaaccccatctctactaagaatacaaaattagccaggcatggtggtgcatacctgtaatctcagctactggggaagctgagacaggagaattgcttgaacccaggaggcagaggttgcggtgagctgagatcgcgccattgcactccagcctgggcaacaggagtgaaactccatctcaagaaaaacacaaaatacaaaacaaaacaaaacaaaaaaacagaactgggccgggcgcggtggctcacgcctgtaatcccagcactttgggaggccgaggcgggtggatcacgagatcaggagatcaagaccatggtgaaaccccgtctctactaaaaatacaataaattagccgggcatggtggcgggcgcctgtagtcccagctacttgggaggctgaggcaggagaatcgcttgaacccgggaggcagaggttgcagtgagccaagatcgtgccactgcactccagcctaggtgacagagtgagactccgtctcaaaaaaaaaaaaaaaaaaaatcaaaatctatataattaagcattgttttttaaaaagtagtttaggaagatttgtaaagcttatgaaccattgtaaaaccttatttctaaggtctgtaagacagttttatatgtaataatgtgtccatttccaggaattccccaaatactcatacagccattgagcaccccaatccaaaattcagaatgcttcagataagaacatttttgagtgccgatgtgacactttaaaggaaatgttcattggagcattttgcatttcagatttttggattaggaaaactcaaccactgtatttctgcacatattccaaaatctgaaaaagtctgaaacctgagaaactctggtcccaagcattttggaaagggtatactcaatctgtattaacatagacttctaaattagtgaaaatttgcattgaattaaaatgtgaagtaaatatttttgtttaaatattgtttaaaatttagtcatttaaaaattttgtgatgtaacaaaatgttgaatgaaataatgcttctacaacttaaaattatttttcatagtgaacaaaactagttgaatacttctaaatattcatttttgttagtgcacattttatccagttttaggctttagggaattgtgaccctttttttttttttttttttttttttggagacggagtcttgctctctcgcccaggctggagtgtgtggcgcaatctcagctcactgcaacctctgattcctgggttcaagcaattctcatgtctcagcctccctaatagctaggattaccggtgcccgccaccacgcccagctaattttttaaatttttaatggagacagggtttcaccatgttggccaggctggtcttaaactcctgacctcaggtgatccacccaccttggcctcccaaagtgctgggattacaggcttaagccaccgtgcccggcacttttgtttttaaaataatatcttactttcatatgattctttcagactgtggtatggcattctgaagcaagtcttaacagagctaaaaatcacccttacccaattctctgcactgacatatgtacacaaagtaatattttattattctccttcataaatggtttctttaattgaacctttgagccttatactatttttaaatttccctttaaaaattgaattacagccaggcatggtggctcatgcctgtaatcccagaactttgggaggccatggcaggaggattgcttgaacccaggagttgtagaccagcctgggcaagatagcgagatcctgcctctgaaaaaatcataataatactttaatttagaaaataccctgaattagaagtgcttcattcctcatttgtgtacagctgttcctctatatacgaaggggattggtaccagaaccactgcataccaaattccacccatactcaagtctcacagtcttccctgcagaatccaagtatacaaaaagtaggcctatcatttatatgggttttgcatcctgacagtactgtattttcaatcctagtttgtttgggaaaaaaaaattgtttgtatgcctgggtacagtatcatacctgtaatcccagcactttggaaggctgaggcgggaggactgttttgtggccaggagttcaaaatcagcctggtcgacgtagtgagaccccatctctacaaaagaaaaattagctgggcatgtggcacctgcctgtggtcccagctactcaggaggctgtgaggcaggagaattgcttgagcctgggaggttgaggctgcagtgagccgcgatcacaccactgcatgccagcctgggcgacagagtgagaccctgtctcagaaaagaaaaaaaaagtaaaaattgcatgtaagttgacccgcactattcaaatttgtggtgttcaaggttcaactgtaatttcctagcagcattttgtgtgtttgagaatctcttgacactcttcaagtaaatccctaaattacaactttgacatcaaaaaagctagacattcctacatttttgcactacaatacataaaaactcccatgctgatcggttgtgggatcgtgcctgtgaataaccactgcactccagcctgggcaacatagtaagtaagaccttgtctcttaaaaaaaatacattctgaagaaagttctacttatgaatacattttatttataacaaactggtgaaaattttagaccaaaccatgtctttctgggttgtagtgattaaaaaatggttaagagaatgttccctatacaaggcatatgttattaaacatgaaatttaggattagttttctctttgaaaattcttttgatatgctgaggttacagtttggaggttacattagagaaagaatatagggaagatggcagtggtaaaacatttccctgctttacatttttatattggcagtatcttggtttcaacttttctattttcagcaagatatttgcaagtttttactttgaagatgtttggtttatagtagtccatgctatactaatgctgttgctgagataattaagttagatactaatatgaaaaagaatatttgtgtaaaatattttgaagttgtaattagtgtatatacaagttgttaatacttacgaaaaaaggaagcattcccacctgtaataattttgttaacactagactatcagtaaattatcaagaataaaaaccttggtttttctgtaatatttgccactgagcaatttttattaaaaaccaaacagaagtatttacacaagaacaagtgaaattacacaaaatgataatggggagaaatttctcatctggtgataaagggaaaaagataatgtaaaagcagattgctgctatttgcataataagcacttgttgaagaataaatgattaagttcaatatttttgctctattttatacctactcactttggtggaattagttctccatgtaaagtatctttttaatagtaagcaccatttaataatgaaacaactcatatgttttgtaatccttatggagaattacttcatgtgataattatagtctcttcatggaaaacagtaaaaatactcacgtttatgatgatgggcctaggtactaaattcctcattcaatctttttttaccaaatggtacttaataaaatcttttaccttataaaaatctattttcggccaggcgcggtggctcacgcctgtaatcccagcactttgggaggccgaggtgggcggaccacgaggtcaggagatcgagaccatcctggctaacacggtgaaaccctgactctactaaaaataccaaaaattagccgggcgtggcagcgggcgcctgtagtctcagctactcgggaggctgaggcaggagaatggcgtgtacccgggaggcggaggttgcagtgagccgagatcgcgccactgcactccagcctgggcgacagagcgagaatccgtctcaaaaaaaaaaaaaaaaaaaaaaaaaaaaaaaattattttcaaaggattgtgctagtggtggcctgaataataaaacattgagaagaaacagcctttgaatttggcaccctgaatgtgaagggacaatagatattaatcacatatttattaaccccttcctgtatgaacctagtactgtgctgagtgtagggatacagtgataatgcaaaaaagacccccaataggccgggcgcggtggctcacgcctgcaatcccagcactttgggagaccgaggcgggtggatcacgaggtcaggggatcgagaccatcctggctaacacggtgaaaccccgtctctactaaaaatacaaaatttagccgggcgtggtagcaggcgcctgtagtcccagctgcttgggaggctgcggcaggagaatggtgtgaacccgggaggcggagcttgcagtaagcagagatcgcgccactgcactcccgcctgggtgacagagcgagactctgtctcaaaaaaaaagaccgccccccccaatatacacacaccctgactttaatgagcttattttgctggggactcagccaattaatttcacaaattgtaaaactatttcaagaaatgagaaaaagaggcctgtggtggtaagcaagtatataaaagaagccttccttgaagcaacgatgcttaagctgaaatcttagggaaaaataaaagttaactaggcaaagaaggtagggaagactctttcagatagaatcgcagtttgtgagtttgcttggggaaaaaaatttaaaaatataaaaagaaaaccagtttgaagtttagtggttaatgaaattgaacaggtatgtcagcaccatacctgacattctaggccattctttctttgtcagagcttttttgttgagatggagtctcgctgtctcgctgaggctggagtgcagtggtgcaatctcggctcactgcaacctctgcctcccaggttcaagtgattctcctgcctcagcctcccaagtagctgggattacaggtgcccatcaccacacccggctaatttttttgtttttagtaaagacggtttctccatgtaggccaagcgggtcttgaactcccaacctccggtgatctgcccacctcaacctcccaaagtgctgggattacaggcgtgagacactgtgcccagcctgtcagagcttttgagtagaaatacggtatcagaaatgtgctttattttattttattagacaaagtcttgctctgttgccaggctggagtgcagtggcgcgatcttggctcactgcaacctctgccttctgggttcaagcgattctcctgcctcagcctcccgagtagctgggattacaggcacccactgccacactcggctaatttttgtatttttagtagagacgggatttcaccatgttggtctcgaactgctaacctcaggtgatctgcccgccttggcctcccaaagtgctgggattataggcatgaaccactgcgcccagccagaaacgtgcttttaatactaaaggccaagatatgcaattatactcttgacatatattcaaccgaaatgcatgtacatgtaccataagagacatatgtacaagaatgtgcacagttaacattattcaaatagccaaaaacgggaacatgtccatcaacacagaatagacaagttggtataattacacaatggaatcttatgcagcaatgaaaataaatgaactaaagccgcatacaaaaacatgaagaatttcacaagtattatgttgagtgaaaaagacaaagaatttgtactgtattacttcatttatatgaagttcaaacacaggcaaaattaagctatagtgtttagggatgcatactgaaatgcagtcttttaaaacagctttagaattccttggccaggtgcggtggcttacgcctgtaatcccagctctttgggaggcagaggctggcagatcacctgaggttgggagtttgagaccagcctgaccaacatggagaaaccccatctctactaaaaatacaaaattagctgggcgtggtgtcgcgtgcctgtaatcccagctactctggaggctgagacaggagaatcgcttgaacctgggaggtggagagtgtggtgagctgagatgtcaccattgcactccagcctgggcaagaagagcaaaacttcgtctcaaaaaaaaataaaaaaataaggctccaagcgctgttgtgagggttaaatgaactagataattaatgtaataaacagaatagttttggcattcaacaaacattggctgttattatattagctattaaaaatttaagtcatttaggtcaatgaaacaggagggtttccagaattatacccaattaattatacatgggaaggtgatgaaggtagcatgtcaaattggtataaaaagatggaatattaaataagtggggatactgtatcagataggaacatatttggttgcaagaaacaaaaattcctgtgattactagcttcactgtgagtttattttttcacgtaataaatccaaggttacataatccataactgatatggcagtttaacagtgttattaagaactcaaggtccatttattgctctattctgccatctttggtgagtggctttcatcctcattgtctcagaaaagttatttcacctctaagtattacatctacatttcaagcaggaagaagatgaagcttaagagaccaaatggagcatgtcagtcaaaggtgtccttatttaaaatctctggaagccccacttagtggcttccatccatgtctcatgggacagaactgaatcacatagccatcccttgctgtaagagagttggggaaagtattttaagctgggacatcccagccctgagtgaagtcagggatctgttaggaagaatggatgctaggtaggtaaatggcaatgtctgacaaagacatggtaggccagtctgaaaaatgtaaagctgggctgcgcgcggtggctcacgcctgaaatcccagcactttgggaggccgaggcgggcggatcctgaggtcaggagatcgagaccatcctggttaacgtggtgaaaccccgtctctactaaacatataaaaaattagccgggcttggtggcgggcgcctgtagtcccagctactgaggcaggagagtggcatgaacccgggaggcggagattgcagtgagccgagatcgcgccactgcactccagcctgggtgacaaggcaagactccgtctcaaaaaaaaaaagaaaaatataaagctggatctatacctcactccttataccaaagtacattacccttgtatcaaatattttaaaaactggaataagcttttcatataatctttgagaagatggggctttcaaagcgttaaatgaaacacagaagccatggccaggcacggtggctcatgcctgtaatcccagctctcagggaggcaagaggcaggagcatagcttgagcccaggcgttcaagacctgcctgggcaatatagcgagaccccgttctccccaaaaaggaaaaaaaaaaaaaaaccaaaaaaaaaaaaaaagtataaagcacagaagcgaaaggaaaagtgatgaagacacttgaagacctgtcatttaaaatgattctacaggaaaaagatgaactacaaattggggaaaaatatttgtaggacttatgtagacaaaggactaattttcttaataaaaacatttatcagtaaatttaaatgggcaaaggaaatacttggacaatcatatcatgtatgtaatattaatatttataaatcaataaaatgggctagggatataaatcagcaattcaaggggagggtaaaaagaccaactaatatatgtaaagatgcacaaattcattcatgattaaatgtgaattaacaacgttggcctctcggattcccaaaactttaaaagattaataatatccagtattggttgggattataagcagatatgatatttcactgatagagaccagcatgactgtctcaattgttaaactattgaaatgcatctgtgtcaatggtaaatagtattattgtaagtacaacactaaaattaataaattgtgtaaattctaatatggattaatttgtcttttgtgacaactattgataacctctttgttgtaatgacacctaagaaacatttgtaacatctgctagcttggcctgcatcttggtaaataatgtagctgcattatgtattacctatgaagcattccttgctgtaacagttgctactgcttttaaatacttttagtctagtttttttttttttttttcaagacggagtctcgctctgtcgcccaggctggagtgcagtgatgtgatctcggctcactgcaacctccgcctcccgggttcaagcgattctcctgcctcagcctcccgagtagctgggactacaggcttgtgccaccatgcccagttaatttttgtatttttggtagagacagggtttcaccatgttggccaggtggtctctgtctcttgacctcgtaatctgcccacctcgacctcccaaagtgctgggattacaggcatgagccaccacgcccgccctagtctagttttttatttggttttactgttagtgcgttgtaattcttaggtaaaaagtaagtaaagtggctgggcacagtggttcatgcctgtaatcccagcactttgggaggccaaggtgcaccgatcatgaggtcaggagattgagaccatcctggccaacatggcgaaaccccgtctctactaaaatacaaaaaattagccgagtgtggtgatgtgcacctgtagtcccagctactcgggaggctgaggcagagaattgcttgaacctgggaggcggagattgcagtgagccgagatcgcaccactgcactccagcctggtgacagagcaagactccatctcaaaaaaaaagtaaagcattttcatattttaaaattgaggaatttataacaaatatttgaaaacaaacaccccaaaactgcttgacactattttctatcaatgctgagtatatatacaccctataacctggcaactcatgtttatcaagtcatgtatacagtgctgtgtaatggaactttctgtattaatgaaaatattctacattctatgctgtttgtaaagccactagtctcatgagcacttgaaatgtggctaatccaactgaggagctgattttcaatttaattttacttaaagagccacatgtagctaatggctactgtactgacagcagtgagtgttcatagcagtagcattcataattacaaccattcatgccccaaactggaaaccaacgtagcaaattatggtgtattcacataatacaatatgtgaaagatgtatagctgcacataagaatatgaatgaatcttgctcgccctggcatggtggctcacgcttgtaatcccagcacttgggaaagctaaggtgggcagattgcttagcccaggagtttgagaccagcctgggcaacatggcaaaaccccgtctctacacatacaaaaaagttagccaggcatggtggtgcatgcacctgtggtcccaattactcgggaggctgaggtgggaggatcacctgagcccagggggtcgaggctgcagtgagctgtgatcacaccactgcactacagcctgggccacatagtgagaccctatctcaaaaaaaaaaaaagaatatggatgaatctcaaaaacataatattgaacagaacacagatacaaaagaatatactttatgattctattaatgtaaagtacaaaaacaggatgttagttacccttgagtggcaaggaagtaactgaaggagagtacagagatttgggcttctaggatgttagcatgttctatttcttaatctgagagctaattacatgggtgcagttagtctgaaaaatttatcaagctgtagacttataacatgtacacctttctgaatgggtattgtgcttgaattaaaagttataagttggaggtcggatgcggtagctcacacctgtaatcccagcactttgggaggctgaggctggcagatcacttgaggtcaagaccagcctggccaacatagtgaaaccccgtccctacaaaaaatacagaaattagccaggcgtggtggcacatgcctgttatgctagctactcgggaggctgaggcaggagaatcgcttgaacctgggagacggaggtggttgcagtgagccaagattgcaccactgcattccagcttgggtgacatagtaagaacatgtctcaaaaacagggtataagttggaaacacacagaatgaagtgtcagcaaagtgttgataagtttagcgttattttaaatgttgtaaatgttcatatttttatactatggaagaacatgataatgaaccatagcttggatcatgtcttgaaacatcctgaaatctcttttgatactgtgcaagaattaatacaaataaaacatgattttcgtctctgaaatgaaaaacatgacactgtggctgggtgcagtggctcacgcctgtaatcccagcactttgggaggcagagggggtgcagatcacctgaggtcgggagtctgagaccagcctgagcaacatggagaaaccctgtctctactaaaaatacaaaattagccaggcgtggtggcgcgtgcctgtaatcccagctacttgggaagctgaagcaggagaatcgcttgaacccaggaagcagaggttgcagtaagccgatattgcgctattgcactccagcctgggcaacaagagcgaaactccatctcaaaaataaaaaaataaaaaagaagaaaaaagaaaagaaaaacatgacattgcaagtggtgaagtgaatgttaggtgctagcagttatcaaaaattgtggtgttcaaagtgttaaatgcgtttttcatccaaaaagcaatcatgttcatttaaaactcatgctttaaacaaagatttgcaatcatcagtgagaaaattaagagggtatataaatgtttcaacaataaagaatttgaaatagtgactaaatagcctcccaaagtgctaggattacaagcatgagccacctcatatggccaaaaatatttttagaaatttggccttatgaaaattgttttagcaaaatgtcaattctttgtttaggttttcaagagaatatgttttattcataaatgaatttgacaaaagctaaaagtgattgaacatataaaactaaaagcatgaaaaaagcaataatgatttaaggaagtacaatatggtatttgaaataaaatatagagccaaatccaaaggaagttattattatctaataaaatgtatgatagcattttgatatatttcctttctgtgatagttaatttgtttgtttgtttgtttgtttgtttaagacggagtctccctctgttgaccagtgcagtggcatgatctcggctcactgcaagctccgcctcccgggttcatgccattctcctgcctcagcctcccgagtagctgggactacaagcgcccgccaccacgcccggctaattttttgtatttttagtagtgatggggtttcaccgtgttagccaggatggtctcaatctcctgacctggtgatccgcccgcctcggcctcccaaagtactgggattataggcgtgagccaccgcgcccggccttgtgatagttaattttatgtgtaaacttaactgggccacggattgcccatatatatggtcaaacattattctagatatgtctgtgagagcactgttggatgagattaacattcaaattggtggccgggcgcggtggctcacgcttgtaatcccagcactctgggaggctgaggcgggtcacgaggtcgggaaatcgagaccatcctgactaacacggagaaaccccgtctctactaaaaaatacaaaaaaaattagccgggcgtggtggcaggcacctgtagtcccagctactcgggaggctggggcaggagaatggcgtgaacccgggaggcggagcttgtagtgagcagagatcgtggcactgcactccagcctgggcaacagagcaagactctgtctcaaaacaaacaaacaaacacacaaacaaaattcaaattggtagacagagtagattggcctccctaatgtgggtggccctaatcagttgaaggcgtaaatagaacaaataaaaagctaatttacctccatgagtaagacaggttgcctcctgcctgactgcctttgagctgatttttttcctaccttcagactaaactgaaacattagctcttcctggattttggacctgttggtcttcagattcacactgaagttcttgggacttgtcagcctctatattcaagtaagccaattccgtataataaatctctttctttctttatacattccatagattctctttccttggattcactttgtcactaatacactttctatccttttttccctgggcatagtcttaaaatatggacatttttagatgagtgactttggtacaatcttattataagtatactttagtgcatgttgattttcagaaacctgtttaagagaaaaatagagctcattttaaagtgagataacatggatagtcaaaattatattaccctaagcattaaaaataacataaaaatctataaaattagccaggtgtgatggctcacacctgttatcccagcactttgggaggccgaggtggatggatcccttgaggccaggagtttgagaccagcctgggcaacctggtgaaacctcatctctactaaaaatacaaacattagccaggtatggtggcacacacctgtagtcccagctacttgggaggctgaggcaggagaatcacttgaacgggggaggcggagggtgcagtgagccgagatcacaccactgcactccagcctgggcgacagagtgagactctgtctcccccccaaaaaaagaaagaaaatttaccaaggagtagaattgctgggtcctaggcatgtatgtcaatgtaagttgctaaattgctctccaaagtgaatacaccaacatccctcttactagaaagttccttttgcttcaccaatccaatgacaatgcttggaattctcagaattcttaacttttgccaatctaatggtatctcattatggttttaatgtccccaattaccaatgaattggagcatcttttttaaaattattattttaaaaaatgttttttcgagactgggtctcattctggtttgcccaagctggagcacagtggcgtgtgtacacacctgacacacctgacagcaacagcttgactgaagcataccctgagaatgaccctgtatggcagaagcgcctggcagcaataacaacctaagaaattagggttgctatgtggaggttgctggggtggagggtgctaagcgaaggtgctatataaactgcatgctttttacaagcagtagcaattctcctgtccagcccactgccgctgcactgtccctgtatgaaagttccccctggttaaaccctatgtctcccttgctggctctaggtctctttttcagcctcttgacccttgtgccatccctactggagtcaataggggtccagcaggacagcatgatcatagctcaccgcactatgggctcaagcagtcatcccgcctcagcctcctacgtagctgggactatagactcataccaccatgcccagctaattttttttattttttatttttatttttgcagagacagggtctcactatgttgcttaggctggtttctaactcctgggctcaaatgagcctcctgcatcagccttccaaagtactgggattggccgggcacggtggctcatgcctgtaatcccagcactttgggaggccgaggcaggcggatcacgaggtcaggagatgcagaccatcctggctaacacggtgaaaccccgtctctactaaaaatacaaaaaaattagccgggcgagatggcgggcgcctgtagtcccagctactcgggaggctgaggcaagagaatggcgtgaactccagagggcggagcctgcagtgagctgagatctcatcactgcactccagcctgggcgacagcgagactccgtctcaaaaaaaaaaaaaaaaaaagcaaagtactgggattacaggcaagaaccaccatgcccggccacatgaattttttcattttcatgataccattcccaaagttaagaacatgtgtcttaggccatgtgcagtggttcacacctgtaatcccagcactttgagaggccgaagagggcagatcacctgaggtcaggagttcgagaccagcctggccaacatggtgaaaccctgtctctacaaaaaaattagccaggtgtcatggcacatgcttgtaattccagctgcttgggaggctgaggcaggagaatcgcttgaacccaggaggcagaggttgcggtcagccgagatcgtgccattgcactccagcctgggcaacaaaagtgaaactccgtctcaaaaaacaaaaaaaaagaaaggaaaaagaatatatgaatatatgtctcaggccagatgcagtggatcatacctgtaatctcagcactttgggaggctgaggcaggcggatcacttgaggtcaggagtttgagaccagcctggccaacatggtgaaaccccatctgtactaaaaatacaaaaagttatgtctcatttgtgttcagctacttctttctgctattacaaaaccttccaaagataaattcacactggtatcagagcaatgtagtcttgagcaagacaactgttttccgtatagatggtattaaaaacttcccaatattttaccgtgaagtacttcttaattaattttaaagtaataaattttctttggccttatctaaaaatccatgatcctgtttatgttccacttaaaataatacactaattcccttgcttttcattagtaggttgaaatttgaataagcagcaggaggtggagcctcagcttagcctgaggtgaacaatgagcacatacagtggtttgcagggcaaacccactagaagcctatttcctgaaaatagactgaaaatccttgtaggactaaactcatccttagggaatagagccaggtacagcaagtctggtgcagttgcaaacctttagtcttccaaagggaaaatcaattctatgtgaagtctgttacttggattttatatccaggccagcagtacaccctcagccccttcttctctccaggtagaccacggtacaagacattaagctaaagaactcaataggattcttaggtcatgtaggataaacttccttctcaacccttttatcttcaaatattaatgctaagaggggagcctggagctagactgcccatcttccaatctcagccttaccacttaaccaggagacctttgccaagttatttgccgggcagcattgtaagctcttttacgtatatttaaaattttttaatgtttattttagcttaatttcagtcagaaattaacttcttctgagtctcaaaactgagaacatgagagcaataaaagtatttacttgaggccagatgctgtggctcacacccataatcccagcactttgggaggccaaggcaggtggatcacgaagttaggagttcaagatcagcccggccaacatagtgaaacctcttctctactaaaaatacaaaaattacactttgggaggctgaggcgggtggatcatctaaggttaggagttcgagaccagcctggctaacatggtgaaacactgtctttactaaaaatacaaaaaattagctgggcgtggtggcacacacctgtaatcccagcaactcgggaggctgaggcaggagaatcacttgaacctgggaggcagaggttgcagtgagccgagatcacgccattgcactccagcctgggcaacaagagcaaaactccgtctcaaataaataaataaatacaaaatacaaaaattagccaggcatggtggtgcatgcctgtagtcccagctactcaggaggctgaggcaggagaatggcttgaacccgggaggcagagggtgtggtgagctgagatcatgccattgcactccagcttgggcaacagagcaagaccccgtctcataaaaaaaaaaaagtaattacttcatagggttgtagtgaagactaaatgttaatgaatgtgtacgcatgcatgtgtgtctgcacctatgtatataggtgtaaaaatgtacaaatacatttatttctcagttctgtcccctcatagggcccagtagcaatgagaacacgtaacatccagatcttggcttctaaatcccttctcccttaaaaataaccatgatttggactggctctagctcagtattcctttgacaaaaaaccgagactccttgaatacatgcttagttctaagactggagcagaaaaaatacaagatgagcctggaacatcgctttgtgccatggcataggtcacagaagcctatttgaagagccccttattggccaaatctgggaccatttgaacatcagaataaaaaatgaagtcaaataaatatatcctattgagtaaagaacaagaccacagtgaggtggatggatggatatacagatagatagagcacatgagagtgagcgacaggagatgtgggagggggtagcaaatgtagtaaaatggtaacaattggtgaatctgggtgaaaagtatccaagagctctttgtactattcttgcaacttttctgtctgaaattaagccaaaataaaacatttgaaatttttaaatatatgtaaaagagcttacaatgctgcctggcacataataaggagtatatgtgtgtttgctgttactatacgggtaacttccaacaagtggtaggttggaagcctaggttaggtgagggtaaagaaattaaggtatgtgacattttccttagatttatcacaagtctcaggacttgtaatagtttagtgtctaatgtaggctggatctttttattttgaaagaatctaaaagcatatgaccttaaagtggaaagtgaaaaatagctttttatttgaaaagaatggaaagattttgtgggtagatacaagcataccatctggttaactcaacagaaatcctaagagcttagaattctttttatttttcttttttttttttttttttttttgagacagagtctcactcttgtctcccatactggagtgcaatggcgtgatctcggctcactgcaacctccacctcccgagttcaagcaattgtcgtgcctcagcctcctgagtagctgggattatagctgtgcaccaccatgcccggctaatttttgtatttttagtaaagacacggtttcaccatgttggctaggctggtctcgaactcctgacctcaagtgatccgcctgccttcgcctcccaaagtgctaggattacaagcgtgagccaccacacctggccaagagcttagatatcatatttttatcagccacgtatgatttaagataaaccaccataacctaaaaatacacaattgtatttattctgcaattcataagttatttggaaatgccactcaacttaaaatcccaattatcttatctgagaatcagactccattgtggtttatatttctcaagttcaaatgttcaatgacatataagacaaattcatcacataagaaataggcaaggttggcatagcagtagtatctctaaaattaaatacactttagttctttaaaaatgtgatcacaatgattctcaaccagggacagtttttacccttgggattttttttttttttttttttttgagacggagtctcgctctcttgcccaggctagagtgcagtgacgcgatcacggctcattgcaagctccgcctcctgggttcatgccattctcctgccccagcctcctgagtagctgggactacaggtgcccgccaccacgcccggctaatttttttttgtatttttagtagagacggggattcaccgtgttagccaggatgatctcgatctcttgacctcgagatccgcccacctcggcctcccaaagtgctgggattacaagtgtgagccaccgcgcccagcctacccttgggatatttcaaaatgtctggagacattgccacaactggggagggagggtaaggggggagcagaggttactggcatctagtggtagaaaccaggaatgctactaaatatcctacaatgctcaggacagctccctacatcaaagaacactaaatgaacatatcttctaaaatttcaagcagtgaaagtactactagggatggaataatgcttttaggcctgtctttatacacagtattaccatctagcctagtgcctggtacataatatctatttaatttttactaatttaattaatgaatgaagaattgatgctactcttaggctgggcacggtggctcacgcctgtaatcccagcactttgggaggccaaggcaggaggatcacttgaggccagcagtttgagaccagccttgccaacatggcgaaaccttgtctctactaaaaaatacaaaaattagttgggcatggtggcacaagactgtatcccagctactcaggaggctgaggcaggataatcgcttgaacccgggaggtagagattgcagtgagccgagattgcgccactgcacttcagcctgggcaacaaagcaagatgctgtctcaaaaaaaaaaaaagaattaatgctactcttattttatgagtatttttatgtttttcccttcatttatatgtaccctaaaactgtaccagaatctcctacctgctacctttgtctcaaaatatggcaagggaagaacctagagatagatttttgtataagaaaatacaggccagagtagctgggattacaggcatgcaccaccacacctggcctattatatctattttcttttttgagacagagtttcgctcttgttgcccaggctggagtgcaatggcgtgatctcggctcactgcaacctccaccccccgggttcaagtgattctcctgcctcagcctcccaagtagctgggattacaggtgtgcgccaccacacccaggtactttttgtatttttagtagaaacagggtttcatcatattggtcaggctggtctcgaactcctgacctcaggtgatccaccccccctcggccttccaaaatgctggattacaggcatgagccaccgcgtccggcctctattttcctttcctttctttttttttttttttttttgagatggagtctgctctgtcacccaggctggagtgcagtggtgccatcttggctcactgcaaccttgcctcctgggttcaagcaattccatgcctcagcttcccagagtagctgggattacaggtatgcaccactacacccggcctcttatatctattttctttttttttgagactgagtctcactctgttggccaggctggagtgcagtggtgcagtcttggctcactgcaacctccacctccctggctcaagtgaccctcctgcctcatcctcccaagtagctgggattacaggcataagccaccatgcccgacctattatatctattttcagttaacttgtcctaatttttattagctgttttaatcacacatagtaaaaaattagccagtctagaaagacataatgaaatgccacagacccctcttcattccttccgtactcctcaccctagtgctgcttgggggcaagtcattttatttttatttgcaggtagtcactttataactctgagtaatatttctatgttaatttgttttgttttgttttgttttgttttggagacaaggtctctaactcttcactctgttgcagtagtgtgatcatggctcactgaagcctcgaactcctgggctcaagagagcctcccacctcagccttccccgtagccagaactatagatgcgtgccatcacatctggctaattacaattttttttttttgtaaaaatggaatcttactatgttacccagtctggtttcaaactcctggcctcgagtcatcctcctggctcagcctcccaaagcactgggattataactgtgagccaccacacccagcctcctatgttaatatttctccatgcatcaattttagtcctgtatttactcctaccattggatggtaaggatttaactacctaggccactctctgtcctccccagtttattttattatttatttatttatttatttattttgagatggagtctggcactgtcacctgggctggagtgcaatggtgaaatctcagctcactgcaacctccacctcccaggttcaagtgattctcccacctcaccctcccaagtagctgggattgcaggtgcccaccaccacacccagctaattttttgtatgtttagtagagatggggtttcactatgtttgccaggctggtctcaaactcctgaccttgtgatccacccacctctgtctcccaaagtgctgggattacaggcataagccaccatgcccggcctccccatttttaatagttatattatccttaggtataatactgaaaatttttatgacttaaaataagatacttaaactcctgcttcttgctcatcaactttacagcagctcttgtctacccagtatataagataaagccattatcactccctcctttcattctctcctcttcttcttccacccaacctctgtcagcttcacttttgctttctgtcttttcgttttataacttcaaggttaatgacagctacaccctgttctgtaactgtaaataaatagtcagtgttttgtctataactgattctaaactttgaacagcagtaagcagcatttgctttactatcactatgtaaatattactcaaggcagacacgggaggcacaccaggacatttcctccttcagggtccactttttgacactgctgtcacctaaaagagaatatatctttccttaaatcctatcaatgttaataaaaaatgaatccaggaggccgggcacggtagctcacacccgtaatcccagcactttgggaggccgaggtgggcggatcacctgaggtcaggagtccgagaccagcctgaccaacatggagaaaccccatatctactaaaaatacaaaattagctgggcttgggtggtccatgcctgtaatcccagctactcaggaggctgaggcaggagaatcgcttgaacctgggacgcggagattgcagtgagctgagatcatgccattgcactccagcctgggcaacaagagtgaaactccatctcaaaaaaaaaaaaaaaaaagaagaatccagggttgggagtggtggctcacgcctataatcccagcactttgggaggccagggcaggcggatcacctgaagtcaggagtttgagaccagcctggccaacatggtgaaaccctgtctcttccaaaaatacaaaaattagctgggcgtggtagtgcacacctgcagtcccagctactcgggaggctgaggcaagagactcacttgaacccagaaggcagagggtgcagtgagctgagactgtgccattgcactccagcctgggcgagagtgagactttgtctcaaaacaaaacaaaacaaaaacgtgaagccagatcttagtttgcttcatatctggactgtggcattcttgtgaattttttggcttttcctataaatgttaatcgcctttttttccctgctgaaaagaagaaatatgtgcctcctttatccatctgcaacatgaaatccattccattctcattcttgattacatgctccttggagtccactgacaatctatgcacacagattgctttccagctctgccacatcttgacattcctcttcactgcattcttggttggttgccgtgtttcttgaatcccatgtcttcatccttcctgatttttgcctgaacacatcaatatgtttttacaaggatttcttgttttctattttagaacatgtccttgattctctttactgaaaaaaaattatgtgatgtccacccatgtgaatttcttctactttaatgttctccccttgtgaacttatcttccaacttcctagatttcttagaagagaagcaccagtatttttctttaaagggtaggcatagctgggcacagtggctcactcctgtgatcctagcactttcagaggccaaggcagacggattaattgaggtcaggagttcgagaccagcctggccaacatggtgaaaccccatgtctactaaaaatacaagaactagccaagcgtggcagcgcatgcctgtagtcccagctactcaggaggctaggggcaggagaatcgcttgaactgggagacagaagttgcagtgagctgagattgcaccactgcactccagcctgggcaacagagtgacccaccatgcccggcccttggtaatgttttaaccatctacataggaagttagcctccaaggtgttaggcaaaaatccaatctttagaaactgaggcacagacaggcatagtggctcacacctataatcccagtactttgggaagccaaggcgggcggatcacggggtccagagatcgagaccatcctggctaacatggtgaaaccccgtcgctactaaaaaaatataaaaaattagccaggcgttgtggcgggcgcctgtggtcccagctactcgggaagctgaggcaggagaatggcgtgaacccgggaggcggggcttgaagtgagccaaaatctctgccactgcactccagcctgggcgacagagcgagacccagtctcaaaaaagaaaaaaaaaaagaagataaaatagagggaaaaaaagattcaaggaaagaaagaaattgagtcactggaatagaaactcagttcctgaaggaaggttaaaccagatgctgagaaacttagaacaaaggtcaagtcaggacaaacagtaaagccagaaggctcctgaattagagctctgcatactttatcagcctggggccaaggttgggatcagagcgaagggcaggccagggtcactggagggcgattagaataacctcaattagaacatgaggcctaggtagaatgtttcactatatatatataatttttctctgaaatcctactgactgtaccagtcagagtttggtgcaagaaacagaaaccactggaagtattttaagcatgaaggaatttattgcagagatgtatgcacttagaaaatctttgaaagggccaaaggaatagattctaggcagggcctttaggagtgaaacctagaacagtactgaacctggccgggcgcggtggctcacgcctgtaatcccagcactttgggaggctgaggcgggtggatcaccttaggtcaggagtttgagaccagcctggccaagatggtgaaaccccgtcttaactaaaaatacaaaaaattagctgggcatggtggcaggcacctgtaatcccagctgctcgggaggctgaggcagagaattgcttgaacccagcaggtggaggttgcagtgagccgagatagcgccactgcactccagcctgggcgacagagcgagactccatctcaaaaaaaataaaaaaaataaaaataaaaaaagaacaatactgaactgactcaccacgggagctgcctctgaggccactactttgagtgagttcaagaccacaatatcttagatgcattccagggttcagtcttgttgccacagcaaatgcaccccaaccctcaggaagctggaaaaggaacattgaaggaggtcctataaaaaacaaaacctcacatttccacgacctcacctgcagcagaaaaataagcaaaggaacaggaaaatagtttccacctcacttatgccttccaaatctcaaccaaatatgtctaattggtggaagcaattcacatcccaaactgtacctgcaaaggagccagaactgtggattttagtcttctacttctgcagtacaggaagctatcctgtaggagggtagaatgcaggttgagggagccaattaatactatccactaacataacatacaaatttaaagtgcaaaaagatacactgagtaggaacaggaaagaccactgaaggtataggctagaggccagatgctgtgcaaggctgttgaattcaaaatcaaacatttttctatgacatttagaatcattgtggtcttgagttgcttttaacagtcagtaccagactgcgccccggtggctcatgcctgtaatcccagcactttgggaggccaaggcaggcagatcacttgaggtcacaaatttgagaccagcctggccaagatggcgaaaccccatctctactaaaaatacaaaaattagccgggcgtagtggcacacacctgtagtcccaactactcaggagactgaggcaggagaatcgcttgaacctgggaggcggaggttgcagtgagccgagattgtgccactgcactccagcctgggtgacagagactccatctcaaaaaaaaaaaaaaaaaaagaatgaagaacttcgtacactgataaggaaagatgtagaaacattgagcaaaagaagcaacgtgcaggtaactatgtatggtatacttgcaattgtgtaaaaataaatagaagaggctgggcgtggtggctcacgcctgtaatcccaacactttgggaggccgaggtgggtggatcacttgaggtcaggagttcgagaccagcctgaccaacatggagaaaccccatctctactaaaaatacaaaattagctgtgcatggtggttccacgcctgtaatcccagctactcaggaggctgaggcaggagaatcgcttgaacccgggacacggaggttacgataagccgagatggtgccattgcactccagcctgggcaacagagctgtacacacacacacacacacacacacacacacacacacacacacacagtagttgggctctctctttgcctctcagttcattctagaggaactcagccaaccaaagggagggtttaaggtgtgtgtgtgtgtgtgtgtgaattttttattttgaaataattttagacttactctaaagttgcaaaaataatacaaagagttcttgaatacatatcacccagtttccctggtattagcatattacataactacagtacatatatcaaaatcaggaaattaacatctgtacagtactattaactaagtaatgttcttttcagtatgtcatatcagggagtatatgatgtcaatatgtaaagtttactaactagagtacagaacttggtacagtccttttcttctttatccttacagcacacagtcaaaatactgttttgcaaagttacttaggttagttgttttcttcctcattcccttcagtgtggttatattatttttatttatttatttatttatttatttatttgagacagggctcactctgttgcccaagctagagtacagtggcatgatcatgactcactacagcctcagtctcctgaatagttaggatcacaagtacatgctaccatgccaagctaattgaaaaaaatttttggggccaggcgcagtgactcacacctgtaatcccagcattttgggaagccaaggcgggcggattatgaggtcaggagtttgagaccagcctggccaacatggtgaaaccccgtctctactaaaaatacaaaaattagctaggtgcggtggtgggcgcctgtaatcccagttactcaggaggctgaagcaggagaatcgcttgaacctgggaggcggaggttgcagcaagccgagatcgcaccattacactccagcctggcgacagagcgactcccattcgggaaaagaaaaaaaactgtagatgtgaagtctgactgtgtgcccccaccgatcttagactcttgggctcaagcaatccacctgcctcaacttcccagagtgctgggtttacaggcatgagccactgcacctggcctatgttacagttaggttcacttgttatcatttatattccattttaggtttatttcataccctcattgaaatttttaaatttgtttattaaagtttattttattttattattttgttttattttattttatttatttcattttaatgagagatggcgtcttgctatgttgcctaggctggtttcaaactcctggcctccagtgatactctcgcttcagcttcccaaagtgctgggatgacaggcccgagccaccatgacccgccaagttgtgtttttagagaaaatatattctctttagaataaggattctaggctgggcgcggtggctcacgcctgtaatcccagaactttgggaggccgaggcgggcggatcatgaggtcaggagatcgagaccatcctggctaacacagtgaaaccccatctctactaaaaaaacacagaaaaattacccgggtgccgtggcgggtacctatagtcccagctactcgggggcggggcggggcggggcggggcggggcgggggggtggggctgaggcaggagaatggcgtgaacccgggaggcggagcttgcagttagccgagatcgtgccactgtactccaacccgggcgacagcgactctatctcaaaaaataataataataaaaaagaataaagattctataggcacttcttttacagcagagttataagaacctgagttcttttaccttaggcccaaggatgtaattcattcgtccacacaaactttttatttatttttatttttttatttttgagacaaggtctcgctctgtcgccaggctgaagtgcggtggcgccatcttggctcactataacctccgcctcccgggttcaagcgattctcctgcctcagcctcccgagtagctgggactacaggcgcacgccaccacgcccagttaatttttgtgtttttagtagagacagggtttcaccatgttgaccaggatggtcttgatctcctaacctcgtgatccgcccgcctcggtctcccaaattgctgggattataggcgtgagccaccgtgcctggcataaagtttattttttaaacagttgagaattccttgccaacatttaaaaaatttggagattttacatttaataaatccaaccgacagctttgcttaaaagaatcagatcgatttatgctggacctgccttcgcatatggtaacaactccaactcagtagatctgttgtatgacaaggaagttcccttagaggccttcagggattctgcaactgagagctactgctctgctgttagaggggtaccgagaaaagacagaactagaacctgggtccttagacctaagccttcctcttactacaccatgttccctctgaacattaataccaaattaataaaattacacctctgagggggagttcagtgtagtggctacaagtcacactatgaagtcagataggagttcaaagttcaaatcagacacttactaatgtctgattttccttgttcttttaaccccttgtttaaattccttaaccccttaggatttcaggggcatcaagcataaaacaggaagtaccttagggttattgtaaaggatgtctgagacaatgttcctcctttagtcttctcaaactctgtgctatggcagggtgcagcggctcacgcctgcactttgggaggccaaagtgggcagatcacctgaggtcaggagttcaagaccagcctggccaatgatgaaaccccgtctctattatttaaaaaataaataggctgggtgtggtggctcacacctgtaatcccagcactttgggagactgaggtgggcggatcacctgaggtcaggagttcaagaccagcctgtccaacatggcgaaaccccatctctactaaaaatacaaaaattagccgggctcggtggtgggcgcctgtaatctcagctatgtgggaggctgaggcaggagaatcgcttgaacccgggaggcggaggttgcaataagccgagattgcaccattgcactccagcctggtcaacagagtgagaccctgtctcaaaaataaaataaaaataaaaagtatgccaggcgtggtggctcacacctgtaatcccagcactttgggaggccgagatgggtggatcatgaggtcaggagatcgagaccatcctggctaacacagtgaaaccctgtctctactaaaaatacaaaaaattagccgggtatggttgcaggcacctgtagtcccagctacttgggaggctgaggcaggagaatggcatgaacccgggaagcggagcttgcagtgagctgagattgtgccactgcactccagcctgggcgacacagcaagactctgtctcaaaaaaataaataaataaaaataaaaaataaaaacaaaaataaaaataaaaagtaggctgggcctgggtggctcacgcctgtaatgttagtactttaggaggccgaggcgggcagattgcctgagttcaggagttcgagaccagcctgggtaacacagtgaaaccctgtctctactaaaatacaaaaaaattagctgggcgtggcagcgtgtgcctgtagtcccagctactcgggaggctgaggcaggagaatttcttgaacccagaaagcgtaggttgcagtgagccgagatcatgccactgcactccagcctgggcgacagagtaagactccatctccaaaacaataaataaataaacaataaaataaaaataaaatatcacattaaaatataatttacctggattatgggatatttttacagccctttaaagtttgcatctgaggtgagtaccttactcgtccctccctagtcctggccctacttgctgcctttaaatttattattagcccagcagccagagcaagctctttgaaggcaaatcggatgatgtcactctattattaagtggctttcctttgcacttaatataaagttgaaaatccctagtggcccacacctctcagttcccacatgagctggctcctgccctcctcctgaacctcatcttgtgccattcttcccattgcctactgaactccagctacaccagctggaataagccaaacaaatgcccaggactttcatagagaatattccctgcctaggatattctcttttccaagatatcccgaaatgctttcctcttcaactggtatttcctttttttttttttttttgaaacagagtcttgctctgttgcccaggctggagtggcataatcctggcttgccgcaatgtccaactcccgggttcaagccattctcctgcctcagcctcccaagtagctgggattacaggcacctgccaccacactcggctaatttttaatatttttggtagagatggggtttcaccatgttggccgggctggtctcgaactcctgacctcaaatgatctgccggccttggcctcccaaagtgctgggattacaggcatgagccaccgcacccggcctcaactggtattttcttttcaagttttagatgttggctcgacttccacttgtgttgaaaagcctggcgtgactctgttctaaggcagtgtccctgtaactttttcacggcactataagtttttcctcatacagttgtcacatttgcaatcacatgtttatttttctgatgatttgattaacaactgtctgctcacttgattgtaaacctcaggagagcttatttctttgttttatttttcttgtcacctttgctctattcccagtgtctactatatagtaggtgcttaataaatacataactggctaggggtagtgactcacgcctgacatcctagcactttgggaggccgaggcaggaggatcacttgtagccaggagttcgagaccagtctgggcagcaaagcaagaccctgtctctacaaaaaaaaaaaataaataaaataaagtaaagtaagtacataacacagggactgggtcataaaaaattctctataaatgtttgcaaaaatgtgattagaaatgtaaatgaggtagcatatgaaagcaaggaggaaagcaaatgaactttccaagcattttattgaactttcagttagttaccactgttttttgtttgtttagtccattattttgtcttttaatctcaggctgcagtcttgtgtttacccttatcatagctatagcttctgattctgattaaggtgtctatttttactccaaagtggcccggtgatttttcttctgattgcctgaaagcatcaaaggtaagtgaatcagctgggcacagtggctcatgcttgtaatcccagcacgttgggagaccaaggcagatggatcacttgaggtagggagttcgagataagcctggccaacatggtgaaaccccatctctactaaaaatacaaacattagctgggcatggtggcaggtgcctgtagttccagctacttcacaggctgaggcaggagaatcgcttgaacctgggaggtggaggtaggttgcagtgagcagagatcatgccactgcacttcagtctgggtgacagatcaagactacatctcaaaaaaaaaaaaagtaagccaatcatgtatccaagcctttcaactatacaccatgtcgaaacttttctccataaataatgactgctcacaccaaaaaggcaatagaatttttcttagaattcttccatgtgaaattaagaaagtgtatattcaacatactttactttctatgaatgtggtttggccaggcaggaagaacaaagcccatgaaagaatggtggggtcccttgcttttgcttcctatcttccagctctttgcttctcaaagtatggtctgggcatcagcaacatcagcctcagagctgggaacctgtcaaaggcaaaatatgaggattccactcccagaatctatatttttacaagatcctagtgcttgaaaaatttaagagcacgtgttcttgtaaaaacaagtactcactgcagaatggaaaaagactatagtccaggcgtttccaaacctgactagtatgaaaacttcataaggtgcttgtgtaaaaataaaaattcctatgttacccctcccaggaaactgtaattttataggtctagggtggggctcaaaaatgactctgaagcttccaacacctaaaatgacatttgaaaactgttgtgtgtgtgtgtgtgtgtgtgtgtgtgtgtgtgtgtgtgtgaacccccatcactatttttttaattaaatttaaaaaaactaaatacacaaaattaagggccactctgaccctgaacagaaggacacgcaataaatttgtagtaaaatttaaacattactggctgggtgtggtggctcacgcctgtaatcccagaacgctgggaggccgaggcgggcggattacaaggtcaggagatcaagaccatcctggctaacatggtgaaaccccatctctactaaaaatataaaaaattagccaggcgtggtggcgggcgcctgtagtcccggctacttgggaggctgaggcaggagaatggcatgaacccgggagacggaggttagtaagccaagattgcaccactgcactccagcctgggcgatagagcaagactccatctcaaaaaaaaaaaaatttaacattacttattttttatcatcaaaaattataaaaacctgacaagaacagaaaatgtatgtcattgtaggaggcaagaggcgttattcaaagcagaaagaaactagttaagtaataaagaagtgactctaatctccttgaatgtggagaccatgttttagttaactttgtatcccagcactgttgtgccagacacttggtattcaaaagttgtttgttcactgaaggataatgattcacacttacatagtgtctatgtgccaggttaaaccacataattcctttaatcttgcagtagctttaagagttttatatcattggtctcttttacagatgaggaaactgaggcacagaatggttcagattataatgatggtgtcaaggctaaagtaactccatcttggatgcaaatctgccatgttgacttttgattaacccctagttctggaaactgttgattttgtccagttttacaatttagcctaggtggcaacacagttcggaagttttagcagcttcctcattgtcactagaaagtgacaaaactgtactgaaaagtaattcttttgagggagtaggagagagattctaagtgtttgattttatgttttcattatggtatattttaaatatttcatgattttattatttcaaacacacagaaaagttgagaaactttttgtagtaaacatctgtatacacacctcttagatcccatcgttaacattttactatatttgctttatcattatctatccatttctatccatccctctatccatcatcagtctctgttttttaatgcatttcaaagtaaattctagcacacatcagttcattcttttttttttttttttttttgagatgaagtctcgctctgttgcccaggctggagtgcagtggcgctatctcggctcactgcaagctccgcctcccgggttcacgccattctcctgcctcagcttcccgaatagctgggactacaggcgcctgtcaccacgccaggctaatttttttttttgtatttttagtagagactgggtttcaccgtgttagccaggatgctctcgatctcctgaccttgtgatccacccgccttggcctcccaaagtgctgggattacaggcgtgagccaccgcgccaggccacccggccaatttttgtatttttagtagagacggggtttcaccatattggccaggctggtctcaaactcctgacctcatgatccgcctgccgcagcctcccaaaatgctgggattacaggcgtgagccaccgtgcccagcccagtacatccttcaaaatgctgcatcatgcctatgagataattctttttactactaatctttacactatttcatacaccttccataaaaggggcaagaaaaccatgaagagaaccagaaataagaaaatatggtcgggtgccatgactcatgcctgtaatcccagcacttttgggaggccatgcagaggcaggtggatcacctgaggtcaggagcttgagaccagcctggccaacatggtgaaacctcatctctactaaaaatacaaaaattagcaggcatggtggcgcatgcctgtaatcccagctactcaggaggcggaggtgggagattgcttgaccttaggaggatgaggttgcggtgagccgagatcatgccactggactccagcctgagcaacagagagagactatggcataacacatatatatatatatggctgggtgtggtggttcacgcctgtaatcccagaactttgggaggctgaggccagtggatcacttgagataagaggttcaagaccggcctggccaacatggtgaaacctgcccccctctactaaaaatacaaaaagtaggctgggtgcggtggctcacacctgtaatcccagcactttgggaggctgaggcgggtggatcacgaggtcaagagatagagaccatccaggccaacatgatgaaacccatctctactaaaaatacaaaaattagctgggtgttgtggcgcatgcctgtatgtagtctcagctactcaggaggctgaggcaggagaattgcttgaacccggaggtggaggttgcagtgagccgagatcgtgccactgcactccagcctggtgacagagcgagactctgtctcacaaataaataaataaataaataataaaaattagcttggcgtggtggcaggtgcctataatcccaggtatactcaggaggctaaggcaggaaaattgcttgaacccaggagatggaggctgcagtgagctgagattgtgccattgcactccagcctgggtgacagagtgaaactctctctcaaaaaaaattaaaaataaataaatacattaattaattaaataaatgaggccgggcgcggtagctcacccctgtaatcccagcactttggaaggccgaggcgggtggatcacgaggtcaggagatcgagactatcctggctaacacagtgaaaccccgtctctactaaaaatacaaaaaattctccgggtgtggtggcgggcgcctgtagtcccagctactccggaggctgaggcaggagaatggcgtgagcccgggaggcagagcttgcagcgagccgagatcgcaacactgcactccagcctgagtgacagagcgagactccgtctcaaaaaaaaaaaaaaaaaaaaaaaagagagagaaaatacggtaaaaacatgtaaaagaaggaacactggcgtatttaaagatgattaacttcaatttctgaagtacaaaaaaccttacacaaatctagtaaatttatgcaaattactacagaggataatttttaaaaacagtaccttttagatctatcttaaattcatgaagtctgatttttggcactagaggtaattttggaactaacatgttattgttcccctggcagcatttcctttctataaatcatcatattcacatcccacacgtacatatcctgtgacagccctagctctggcctctttccaggacaccaggataccactaatgtgaacaaaaccgtatctggaaaaatttggagaactctattccccagtaatgagaaacaaatatggactgtgcacctgttttctcctgtgggtgaatattttaatatatttttttaaaatattgaggtaagggctgggagtggtggctcctgtctgtaatcccaacactttgggaagccgaggcaggaggatcacggggtcaggagatggagaccatcctggctaacacgatgaaattccatctctactaaaaaatacaaaaaattagcggggcgtggtggcatgcgcctgtagtcccagctactcaggaggctgaggcaggggaatctcttgaaccggggaggcagaggttgcagtgagccgagatcacgccactgcactccagcctggtaacagagcaagactccatcttaaaaaaaaaaaaaaaaaaaaaagaggccgggtgtggtggctcatgcttgtaatcccagcactttgggaggccgaggtgggcggatcatgaggtcaggacttcgagaccagcctggccaacacagtgaaaccctgtctctactaaaaatacaaacattagctgggcgtggtggtgggcacctgtaatcccagctactcgggaggctgaggcaggataattgcttgaacccgggaagtggaggttgcagtgagccgagattgtgccactgcactccagcctgggtgacagagctggactccatctcaaaaaataaataaataaataaaaagggctgggcgcagtggctcacgcctataatcccagcactttgggaggccgaggtgggcggatcacgaggtcaggagatcgagaccatcctggctaacacggtgaaaccgcgtctttactaaaaatacaaaaaattagccgggtgtcatggtaggcgcctgtagtgccagctactgaggaggctgaggcaggagaatggcgtgaacctgggaggcggagcttgcagtgagccgagatcggcgccactgcactccagcctgggcgacagagtgagactccgtctcaaaaagaaaaaaacacccacaaaactggggtaaaaaacacagaacataaaatttattattttaacctttaaaaaacttaacagactggccaggcgcgacggttcacgcctgtaattccagcactttaggaggctgaggcagggggatcgcttgagcccaagaattcaagaccagcctgggcaacattttgagaccccatgtctacaaaaacccaaaaaattagctgggtgtggtggcatgcacctgtggtctcagctactcaggaggtgggaggatcgtttgagcccaggaggcggaggttgcagtgagccaagattgcgcctctgcactatagcctgggtgacagagtgagaccctgtctcaaaaaaaaataaaataaaataaaataaataatagacttccattttaaaaacagttttagatttacagaaaatcagatagtagaatttccatatcccccttcctctgcactgcttctcctattattaacattttgcatgagtgtggtatattttttataataaatgaaccaagactgatacaaataactaactaaagtctgatagtttacatgaagattccctcttgtgttgtacaattctactggtttccacaaatgtataaatgttatatattcaccattacagtttcacacagaatagttccagcctgaaaaatactgtgttccacccctctccactaaccccaaacagttggcaaccactgatctttttacagtctccatagttttgtcttttctaaaatgccatatagttggaatcatacagtatatagcctctacagattagcttctttcattaggcaatatacgtttagggttcctccatgtcttttgtagtttgatagcccatttcttttcttttcttttccttttctttttattttttgagaaagaatctcgctctgtcacccaggctggagtacagtggcgggaccttggctcactgcaacctctgcctcctgggttcaagcaattctcctgcctcaacctcccaagtagctgggattacaggcgcccgccaccatgcgtggctaattttttgtatttttagtaaagatggggtttcaccatgttggccaggctggtctcgaactcctgacctcaggtgacctgcctgcctcggcttcccaaagtgctagggattttatttttgaggcagggcctcactctttcaccctgtctggagtgcagtggcataatcatggctcactctagccttgacctcccgggctcagtgatcctccctcctcagcctcccaagtagctgggactacaggcatgtgtccccctacctggctaatttttgtattctttttgcagagatggggtttcaccatattgctcaggctggtctcgaactcctaggctcaggccatctgcctgccttgacctcccaaagtgctaggattacaggcgtgagccaccgtgcctggcccccatttattttttatcactgaacacttccattgaatgtaccacagtttgtttatccattcatctattaaagggcatcttagttgcttccagttttgggcaattatgaataagctgctataaatattcatgtgcaggttctgtgtggacataagttttcaactcagttgagaaaatacctaggagtgtgattgctgaatcattttgtaagactatgtttagctttgtaaaatactgccaaactgttttccgaagtaatcttaccattttgcattcttaccagcaatgtatgagagttcattgctgttgttgctccacatcctttcgagtgtttggaattgtcaggtttttggactgtagccattttaagtggtgtgtagaggtaccatcttaatcatttttaagtgcacagttcagtggcattaagtacattcacattgttttcctatcgtcgccatcatctatccacagaactcttttcattttgcaaaaccaaaactcttatacctattaaacaataattccccattttcccccaccctaaccacattctacattgtgtcttggttaatttgagtactctagggacctcatataagttgaatcatacagaatttgttcttttgtgtctgccttacttcatttagcctaatatcctcatggtgtatccatgttgtagcatgtgtgagaatttccttcctttctaaggttaataatattctatcccatgaatattccacatttggttccatcagccatcgatggatacttgggttgctttcacatgttagctgttacgaataatgctcccatgaacattggtgtacagatatctcctcaagttcctactttccatttttttcaatatacactcagaaatggaattattagatcatatagtaattctatttttaagttttggaagaactgttatgctgttttccatagtagctataccattttacattccctccaattgtgcacaagggttccaattttccacattagtattttcttgtgttttttttttcttgtttttttttttttttttttttttttgagacagagtcttactctgtcacccaagctggagtgcagtggtgcgatctcggctcaccgcaacctctgcctcccaggttcaagcgattctcgtgcctcagtctcccgagtagctgagattacaggtgcccgccaccacgccctgctaatttttgtatttttagaagagatggggtttcaccgtgttgcccaggctagtctcgaactcctgacttcaagtgatccactgccttggattcccaaaatgctgggattacaggcgggagccgccacacttagcccacattaccattttctgtttttttttttttcttcaatagtacccattctaatgggtgtgaggtggtacctcattctcatggtggctttgtccttagggtgaattttaattatacatgtactggctgtcaatatcaagccagagagaaggaattcccaaagagatcaacctttctgttataaatcattagaattttatcatattttgctttgagacaaagcaagtccatctgtaaacttcagcaaagaggttaattaatttgggtattagggtgatgtgttttaatttctttttagtttagaaattttaaaattatcattaatttttttttagatttagagatccccttattaacctcaaacatttgtatagtgcaatgtttcttttctcttttcaaaatttttttgatacagggtcttgctctatctccaggctggagtgcagtggtgcgatcatggctcactgcagcctcaacttcctgggctgaagtaatcctcccacctcagcctctagagtagctctagagtagccacagcacatgccactatacccagctaagtttttttgtgtgtatatatatatatgtttttgttttttttttttgagacggactttcgctcttgttgcccaggctggaatgcaatagcactatagcactatctcggctcaccgcaacctctgcctcccaggttcaagtgattctcctacctcagcctcccgagtagctgggattacaggcatgcaccaccatacccagctaattttgtgtttttagtagagacggggtttctccatgttggttaggctggtctcaaactcctgacctcaggtgatcacctgcctccgcctcccaaagttctgggattataggcgtgagccaccatgcccagcctttgtattttttagtagagatagggtttcaccatgttgcccaggctgatctctaactcctaggctcaagtgatccacctgccttggcctctcaaagtgttgggatcacaggtgtgagcaaccattaccagcctagtgcaatgtttccatatggctcaatagtgtgcgtgtgcatattgtgggttttacagtgtagtatcaatgtgcccaaattctggctcccatgatatgacctcagccaccctttcagagtcttccctggtatttacaagggaatcttcaggggtggtgcttgttctttaagctccaaaatcagttatgcttttttctcactgctccagacacaggccttcagagccctttcctaccactctgccaatcaccatcagcagtttttctttttaggcctcagcacctactcttccttctaactgcgtgaccctcaccagtactgcactaggggtggagaatgggaggtgagaatctctgcttgttctcttttcatgtgtggtttttttttttttttttttttttgtatttttagtagagacggggtttcactgtatttgccaggatggtctccatctcctgacctcgtgatccgcccacctcggcctcccaaagtgctgggattacagtcgtgagccaccgcgcctggcttttatgtttctaaattttttttttttttttttgagacagagtcttgctctgttgcccacgctggagtgcagtggtgtgtgatctcagctcactgcaacctctgcttcccgggttcaagcaattctcctgcctcaacctcctgagtagctgggattacaggcatgtgccaccatgtccagctaatttttgtatttttaggagagacagggtttcaccatgttggccaggctggtctggaactcctgacctcgtgatccgcctacctgggcctcccaaagtgctgagattacaggcgtgagcaactgtgcccgactgccctccctcccaccctcccccccttccttcctttctttttttctttcttttcttttttttttttttgagacggagtctcgctctgtcacccatgctggagtgcagtggtgcaatctcggctcactgcaaactccgcctcccaggatcacgccattctcctgcctcagcctcccgagtagctgggactacaggtgcctgccaccacgcctggctaattttttatatttttagtagagacggggtttcactgtgttagccaggatggtctcgatctcctgaccttgtgatctgcccacctcagcttcccagagtgctgggattacaggcgtgagccactgtgcctggccatctttcttttcttttctttttcctttttttttttttttttttttttgagacggcgtcttgctctctcgcccaggctggagaaatgagtgttggattttttttttttcaaacgcttttctgcttcaatcagacctgctttctgagtccatgtttctgatttcagcaaattcctctttgcggaatgagtgtcaatatgaaggaatttctacttcccttaaggtgctcaccacctctgcccaaaatggtttggctgtggtcccttaaaaggccatcacttcaaaatagactagtcatgaaaatcagtacatttctcaatgttgagggtatttgctgtcaaaaccacgtgcaacaagatatcaacaacacagctgatggtgaatttcacccagtcttccccaattctatgtttacaatcatttattttttatttttttgaggcagggtctcactctgccaccaggctgaagtgcagtagcatgaccacatttccctgaagcctcaacctcccaggctcaaacgatcctcccacctcagcctcctgagtagctgggactacaggcacgcaccaccatgtccaaataattttttattgtagagacagggtctcgctatgttgcccaagctggtcttaaactcctgacctcaagtgatcctcctgccttggcctcccaaagtgctggggttacaggtgtgagtcaccacgcctggcctttacaaacactctatttttttaattttttaaaattttatttatctatttatatttgagacagagtctggctctatcacccaggctggagtgcagtggcatgatctctgctcactgcaagctccgccttctgggttcatgccattctcctgcctcagcctcctgagtagctgggagtataggtgcccgccaccacgcctggctaattttttgtattttttagtagagacggggtttcaccgtgttagccaggatggtctccatctcctgacctcgtgatccgcccaccctggcctcccaaagtgctgggattacaggcgtgagccaccacgcccggccacgaatatgtatttctgtttgaaaacttgctgagaccttaaagactacagttaagagattcaggacccaggctcagattccttgaattaaagtgtttgtaggcccaggctggtctcaaactcctgagttcaggtgatccacccgccttggcttcccaaagtgctgggattacaggtgtgagccacagcacctggctaagaccctgtttcaaaaaataaaaataaaaataggctgggtgcggtggcttacgcctgtaatcacagcactatgggaggccgaggcgggtggatcacctgaggtctggagttcgagaccagcctggccaatgtggtgaaaccccgtctctactaaaattacaaaaatcaggccaggcatggtggctcacgcctataatcccagcactttgggaggctgaggcaggcggatcatgaggtcaagagatggagaccatcctggccaacatggtgaaactccgtctctactaaaaaaaaatacaaaacttagctgggtgtggtggtgcgcctgtagtcccagctactagggaggctgaggcaggagaatcgcttgaacctggacggtggaggttgcagtgagctgagatcgtgccgctgcactccagcctggcaacagagcgagactccgtctcgaaacaaaacaaaacaaaacgaaacaaaacaaaacaaaacaatcagcaggcatggtggcacgagcttataatccctgctactctggaggctgaggcaggagaatcacctgaacccagaaggggagctgagattatgccagtgcactccagcctgggcaacaaagtgacactccatctcaaaataaataaataaataaataaataaataaataaataaataaataaatagaaaaattaatttaaaaaatagaaacaaattaaaatgaggggcttgaattgcattggagacttattcaggggaatcttttttttttttttgatggagtctcactctattgcccaggctggagtgcaatggcactgtcttggttcactgcagcattcgcctcccaggttcaagtgattctcctgcctcagcctcctgagtagctgggattacaggcatgcaccaccatgcctggctaatttttgtattttaatagagacaggttttcacgatggtcaggatggtctggaactcctcacctccactcgctttggcctcttaaagtgctgggattacaggcgtgagccaccgagcccggctattcgggggaatctttcagattaaagaaaaagattggctagatgagatactgagagattaaaactttgaaatggcagtttttatggtttctacttatatcctattattattattattattattattattattattttatatctattttttgagacagagtcttgctctgtttcccaggctgaagtgcagtggggcgatctcggctcattgcaacctctgcctcctgggttcaaacgattctcatgccttactctcccaagtagctgggattacaggtgcccagctaatttttgtgtttttagtagagacggggtgtctactaaaaatacaaaccactgaacccagctaagttttgtatttttagtagagacggggttttgccgtgttggccaggctggtcttgaactcctgacctcaggtgattcacctgcctcagcctcccagagtgcttgaattatgggtgtgagccaccgtgtctggcctctacttatatcctaaagattttttttttttttttgagacatagttttgctctgtcgcccaggctggagtgcagtggcgcaatctcgggtcactgcaagctccacctcccaggttcacaccattctcctgcctcagcctcctgagtagctgggactacaggcacctgccaccacgcccggctaatttttttgtatttttagtagagatggggtttcaccgtgttagccaggatggtctcaagctgctgacctcgtgatctgcctgtctcggcctcccaaagtgctgggattacaggcatgagcctccgtgcccgactatatcctaaagattttatttatttttattttggagacagagtctcctctgtcacccaggcttgcgtgcagtggggcgatcatggctcactgcaacctctgcctcctgggttcaagcgattctcccgcctcagcctcccgaggagctgggattacaggcatgtgccaccacacccagctaatttttgtatttttagtagagatgggatttcaccatattggtcaggctggtcttgaactcctgacctcaggtgatccgcctgccttagtctcccaaagttctgggattacagacgtgagccaccacgcccggcctatcctaaagattttaaaaactgttttaaaacgacaccccacttatatttagatttgattatttacagtctttcacctcaaggccctgaagttttgaacaagagggttaagttggaagtacaagttctcgaatcaaactgctggagctcaaaatccaggttatttctaccccagccccagaaaccgtgagacgatggagaagccatttcacctctctgtgtttcaatatttatttatttatttgagctggagtcctgctctgtcccccaggctggagtgcagtggcgcgatcttggctccttgcaacctccacctcccgggttcaagcgtttcttctgcctcagtctccccagtagctgggattacaggtgcctgccaccatttctggctaattattttgtattttcttcttttttttttcagacagagtcttgctctgtggccaggctggagtgcagtggtacaatgtcggctcactgcaacctctgcctcaagttcaagctattctcctgcctcagcctccagagtagctgggactacaggcacgtgccaccatgcccagctaattttttgtagttttggtagagacagggtttcaccatgttggccaggatagtcttgatctcttgacctcgtgatccgcctgccttggcctcccaaagtgctgagattacaggcgtgagccaccgtgcccggcctattttgtattttcagtagagacagagtttcaccattttgaccaggctggtctcaaacatctgaccttaagtaatccgcccgcctcaacctcccaaagtgctgtgattacaggcgtgagccaccgtgtctggccctgtttttcaatttttaccatttacaagtactttcagaagtacttagaacaaacctaaatgactagggcaagaaattttatcatctccgtttgacacttggtgaaacagtctcaaaatgtatgactagcccaagttcatagaggtgatcaatgatgctacagttatgaaaatcagatattcatccagactttactatgacaaagattctttggccaaactttagtcagacttctgaatcttctgctaggtccatccgtgcacttccttgtaaagtctagttttagcagaaaactgagctaagtcagtttagcaagaacccctcttcctccatatctgatcaggctcctcatcctccaccatctcccaggtgatgtctgatcactgtggcctgtcttcagcaagaatcctgttagattgatttggccagagtttcacttacccctgaggtttcctcttagtaattttctatctactgaccccctacattgttccttggtgaatcagattcctgaaccattgctcaagacaaatgtctgccaaagctggtaagaacagatgtggattcttaaggtatcagtatactctggctgggtttggtggcttgcacctgtaattccagctacttaggaggctgaggcaggaggatcgcttgagcccaggagtttgaggctgcagtgagctatgatcatgccactgactctggcctaggtgacacggtaagacgctgtctcttaaaataaggaaaaaaaacgccgggcgcggtggctcacgcctgtaatcccagcactttgggaggccgaggcgggtggatcacgagatcaggagatcgagaccatcctggctaacacagtgaaaccccatttctactaaaaatacaaaaaattagccgggcgtagtggctggtgcctataatcccagctactcgggaggctgaggcaggagaatagcgtgaacccgggaggcggagcctgcagtgatccgcgatcgcgccactgcactccagcctgggcgactgagcgggacttcgtctcaaaaaaaaaaggaaagaaaagtatattctctgaaactgtgttacagtcccaggcttcttttgaaaggtaccttctgggctggatgttctttctggctctctgtgaagcctctgtattctctctattggatcttgcttctcccatgggaaattctgtcacctgaaacccttcttctctgaaaccagaaatccctactgattataacctttgccaactttgtccaccactgccagatcctttcccttctcactccagccccacagtcacttgcactttaggctccctaccctccactgggggctctgaagggactgagaggaccctccaaatcaatcacttgaggctgaaaagagagaaaaaaatgagactgttttgaaacagggcaaataaaaaaaaaagtaaaaagaattttccacaaatattggtaaaaagctttagcccttactaagtaggtaaactcaacttgtcccattttcttttttttttttttttctgaggcagattgtcgctctgtcgcccaggctggagtgcagtggcacgatctctgctcactgcaacctccgccttcagggttcaagtgattctcctgcctctgcctccctagtagctgggactacaggtgcccgccaccaggcccggctcatttttttctatttttagtagagatgggctttcactatgttggccaggctagtcaaagtgctaggattacaggtatgagtcaccgcacccggccaagtattcctatttttatggcaatatagttatttgcataatttctataaaaatgtgttctcctgtaacaagacataattggaggcactggttgtattaaccaggttttgactggaatgtcatattttcaaacatgaccagatggcattaaggagctatggttgactttatggagccaataaagtcttcgtttgaaaaactggcctgattgttcccagacttacaggtgagtggcctgagtggccgggcgcgggggctcacacctgtaatcccagcactttgggaggccgaggcaggtggatcacgagatcaggagttcaataccaacctggccaagatggtgaaaccccatctctactaaaaatacaaaaaaaaaaaaaaaaaaaaattagccaggcgtggtggcaggtgcctgtaatcccagctattcaggaggctgaggccgagaattgcttgaatccaagaggcagaagttgtagtgagctgagatcacgccactgcactccagcctgggcgacggagtgagactccgtctcaataaacaaacaaaaacaaacaaaaaagccaaaaaaaaaaaaaaaaaagaaccacagatgagtaaggaatgtcactctctggcaggcccaggaacttcagtgtattttagggacccccaagaagagaggaatacagtcaaatctctaagtgtttcagatgtagcctgatggctaatagtttaagatgtagttcaggtaatccatgaagatttcctgaaggaagttcgcatgaatgtgagagggcaattaacttttataatttttattgagcacgtagtatatacttgtcagatgctcttctacacattttacaaatgattcttaatcctcacaacagatctttgattaggtttttaaggaaaactagttctttccaaaataacctaatgatcacaaaacatatagaacatacaactctgcatcttgactatggtgcgtaggtctacatgtgataaaatgacattgaactatacacacatcatacaactatcaaatccctccttttgagattgtactagaattatgtaatatgcaaccattgggggaaactgggtaaagagtaaattggatctctctgtactatctttgagtagtgtttaggtattttataaaaataatgtcctacagtttgggtttgtcaaatggttttctcatagttagataggggttatggcttttggagagaaagaccacagaggtctgtagtatattttcaactgtaatctatttcaaaataaaaagttttaaaaaaattctccaaggggggatgattagtaaattgattagtcctttctagacctccaacacaccccaccacacactcacacagacccacactcctattaattccggtaactcgggttgtttggaatgtggatagagaaactaagcttaactatgcgcttccagcacctcgtatctggtacttctgttcaacagaaagccttgggaatggggagggcaggcgtggtaaaaggtacaggtttgggaaggtcgctcggttccttccaatccaaacgagaggcttctgattgtttattctcacaccagagccgtgaccgagacccagaggtccgcttccggccacggccgaacagctgcaccgtgcgtaccgggaacggtcaaggcgcagctggaaccgctgcaaaaggcctccgggcgtaccggacaggtcgcaagggcgggggtccccacctagcggaaatgcacggaggccaacccctccccctgcccccgcgaggagcggggcggactcggcagccgccactccccaggctcacaggaagaaactgggacgctgcggacgcggaactggccagacccgcggcgcgtggcacgcgcgagccctcccgcgcatgctccacccgccggcctccagcccgcgccccgggccccgcctccctccctgcttctccccctctcccgtcagcctccctccgagtttggcccctccggccgggcgatcgacgttccgcgtgcgtgcgggcgcctgacttcacttccggctaacgcgctcggcttgccccctggccccggatggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtggtgagtcttccgcacgccgggcgggcgcgaagccggggaaagaagccgtccagccccggggctcggcctcgcgactcggggaagcgagatggcgagagggcagggctgggggttcgggcccagccgtgaagggaggcccggaagctgatggagggggaccttaggacttggctttttcagcggctgcagttgggaggaaagaccggcgagtcagggagtggtgggaggggagttgcctttcgggcctggagcgtccggtctggcttggtcctccgcgagaggtgaggagaccttggagcttggcaccggaggaagcgaggcccgggtaggccctggagaggctgtcggtcctgcgtccggttagatgagagcgaaaggctggaagggttgaccccgggcggagaggctggtggccggaggcgaggggcggggagcgtctgagccggcaaccaagccctcccttgtgggagaggagccggcagtctgctgttctcaggtcccgcagtgcgggggacagaccgcgggctgtgcgcccagcgtgggggtgggggtggggtgggggtggggtgggtcgtggtgggggtggggagggaagtaggcgggccagctgcctgaactgcttggtcgacgactgtaggactctgcggacgccgaagacgactagacctggtccccttgctcggggcttccaacttctacgccccagtgacgagaaagtcaggacctgtggtgtatgaaatagattcctttgggtttgtaacttcaggctgtctctacttgttttcccacagcgagccgaaaattaggatttgaaggtgtgtctgagtctcaccattggaggagagcacttctgggtggcgtaaaccttggtccagggacgggactttcagatgcgtgaggtgtatgctcagtggacggactggagtggttttggaatggccctggctgagttagatttggcggagatgacatttcatttgtggttaaatgatgggtggcttaatttggatgttgtaggtttagattgaaaagttagtgtatgagtgaatcggactcctgcatagagatgtaatgtatacaactgtctgcgtttagccaagtggaagtagttatgtggtcaaccaattcacttgtattttaacgtagacgaacaaggaaaagtttactatgtgagtaataaggcatttgtaagagtaaatggcaatttagggatgcaaacgtgaaattagacatgttaattattgttgatgtgagagttgtgaaagaattggattatgtatagtttcaggatataaacttggaacatatctaagagaaagttttgggaggtaggtttgtaattttttcttttcttggcttaggtaaatgatggggtggcccagatgtagcagtgaacagttactgcaacttggacataatggcttctcactgtgtgtaagagggagatgctcattggtaattggatgtctttctttttaaaagtcatttaaaagtatttcaagtatgaaaaggtatgaagagtaattacagtgaacaccatgcatccccaactcaggttaagaaataaaactttacaaataggattaaaatctcagctgaatctctcctggactgcatttctccaatcctccctcttcataaacgttatctttaatttgattttatccttttcatatatgtctacactttctagtatatgtttctatcttgaggatgtagtatttttgtgatttttaacttggaataagtggtatatgtactaggatttctaaagaaagtcattaacaaaagtattcaagtgttttggatagaaagaggaattttatggtgtgctttttatgtctggaggccatgtttgagaataataatgtgtgtcaggatttgttggttggggaaattggacatatatttatgtgcctgtacatggaaggaaagacaatattcactttagtggtagattactaaagaggagggttttagatgtataacatgaaggtgtaggtagataagtaaaatgtagcattgatttgggataacaggttttgttggggcatctgttgattagaagagttcgggattggatacaattgcaggtccccatgcatgaagattgagtatgtgaattaaaatatgtagaagggtttatagtgaacggaatgaaggattacagaaaaaatttggaagttaacaatggatgcattctgaaacattttcatatatgagaagtgaaatttattattatttgtaaaatttattcgtatttgtagagatggggttttgctgtgttgcccaggctggtcttgaacttccggcctcaaatgatcctcccacctcagcctcccaaagtgctggtattacaggcatgagctgtcccacctggccagaagtttgttattaataataattatcagaggttgtatagggtcctatttgccccagttcagatgattgaggagggaatgctgcattttatgttttacttagaatctgcaggtatttagtaagtttgcttttaatgattaatagagggtgacagccctataaatagagtagagagaagatgccagtagcgatcatggtcctaacataatccctctttcccgtttatgggcaatgggccactttcttttctaccacagaggaaagacatctgtgtctgaggggataaagactaggtgatacagtaataggtcttatggacgcctggggttcagtttatagggttatgggttgcctgtagatttgcagttgaaggatgggaacaggacttgtatgtatatgtattgagtggcaaagacagtgaatttttaactatgactactagtatatgtctttatattatctgtatctgatataaaatgtttataaatacagtttaactggattaagagctatcagtatatacacaggctgggtaagtatttgctccctgtcagtatttaagagtgaagatttttgaagctctgagctgcgtgatctggcttttactagtctctctagtcttgtctccttatttataagttttgtgaaatggtccatttaattctttttcctaactacagtagttttgttctttcttggaatgcaccaattcgctccagtcatttagctaagtcttagtcattttcaagacctagagcgtatcttaacttcctgatccctttagccagaaatgactgaagccctaagcacatatggtcctattagtgtccattttagtaatctggcaggttagtattttgtggtattttttcaaccgtcttgaactatttaagtttaaattccattttatttagctttttgtaaatatatgaggtctgtctcatatttcaagctccttgtggggaggtactttgtttatttgtttatatatcccttccccaggatgcctaatatacagtgtgtgtgtatgtgtgtgtgtatgtatatatttatttattattattgtttctttgacagagtgtcactctgtggcccaggctggagtgcagtgatgcgatctcggctcactgtagcctctgcctccttggctcaggcagtcctcctgcctcaccttcctgaatagctgggattacaggtacacaccaccagacctggctaattttttttatttttattttttatttttagtagagacagggtttcaccatgttggccaggctggtctcgaactcctgacctcaagtgatctgcccaccttggcctcccaaagtgttgggattacaggtttgggccaccgcgcccagccctaatatatacagtataaactcgagtatttttgattggatgcatatataacaatgagtatattagtacttccttatatactaattgctaagtaaacacattccttgactttttttttgtttaaatatgtgtttcttttttagagcagttttaggttaacaacaaaattgagcagaaagtacagacagttcccatatgccctctatctctgtgctcacacagcctcccacccatcagtattctgcaccagagtggtatgttaccatccgtgatcttagcactaacaatcatcatctcccaaagtgcatagtttacattaggatttactcttggtgttgtacaggctgtgggtttggacaatgtatagtgacatgtatccaccattgtactatcataaagaatagtttcactaccctaaagatcccctgctctgcctattcatccttcccttccttttccccccaactgttccctcccctctccctgctggcaaccactgatctttttactgtcttcatagttttgccttattcagaatgtcatagttgtatttataccgtttgtagacttttcaggttgccttctttatctatatgcatttacagttcttccttgtcttttcatggcttgatagctcattcctttttagcgctaaataatattccattgtctggatgtagcacagtttatccattcacataccggaggacatcttgctggcttccatgttttggcaattatgaataaacctgctgtaaacatttgtgtgcaggtttttgtgtagacataagttttcaaatcatttgggtaaatactaaggagctcaattgctgggttgcatgtgagagtatgtttacttttgtaagaaactgacagactcttagtggctgtgtaccattttgtattctcatcagcaatgaatgttctacttcctcaccagcatttgggggttttatattttggccgttttagtagttgtgtagtggtatctccttttttaaaattgtaatttcctaatgacatgatgttgagcatcttttcatatgcttatttgtctctttttatatgtttatttgctgactttgtttttttttttttttgagacagagtctcgctctgtcgcccaggctggagtgcagtggtgtgatctcggctcactgcaagctccgcctaccaggttcacaccattttcctccctcagcctcccaactagctgggactacaggtgccccccaccagacccggctaatttttttttgtatttttagtagagatggggttttaccatgttagccaggatggtctcgatctcttgacctcatgatctgcctgcctcggcctcccaaagtgctgggattgcaggcatgagccacctcacccagcctgactttgggttttaaaaataaaaaagctacacaccacttgaccatactgttcatattactagatatgtccttcaccctagctattgtttgttcatgaaatttagcataatagttagaaaggagcttggttctggacacagatagcttgggttaagatcccagtgtcttaaaaatttttttttttttaaattcatcccattacacagaattattttaatttttaaacacctgtctaaatttttaaacaccttgactaaattatttaatatttctgttccagtttccttatttgcaaaatgaggataattgtactaattgtgagaattaagtgattatgcatgtaaagtgtttgcagcagtgtacttaccagacaagtgccccaaaaatgtttgtcttatctactttaattccctgtaaataccttgcttttggcctggtgctgtggctcatgcctggggtcccagcaccttgggaggctgaggcaggaggatcgcttgagcccagtagttggagaccagcctaggcaacatagtgagaccttgtctctagaaaaaaataaaaaaatttgctgggcatggtggtgcacacctgtagtcccagatactcgggaggctgaggtgggaggattgcttgaacctgggaggttgaggcttcagtgagttgtgattgtgccagcctgggcaacagagcaagactctgtctcaaacaaacaaacaaaaacaagaaaaccttgctttttttttcttttttacttaaagctttttttatattcagtttttggacttaaactgaactttgaacttcctaaggtttttttgtgatttaccactttccaccatcctacagaacccatctagattttgcttttttgtgagagtaagatattgttaaggtgttctcttacttaattactgggggtgatgatttctcttacttcctgaaataatgcccctccccagtgtagtacattttataccgtttgtcttttttataagcttttttgagattatgtggagagagcatgcgctttatgttaggtagtcctgaattttgaattttagttcttttatgaactcactacttaaacctcctgaacctcagcttcctcatctgtaaattaagattaatgtttaataggatggtggggaagactaagtggtcaaacatgttaaaagtgcctaacagtgcatgacaaatgtaaaataggggatgctcagcaaatgctaattcctttgagtctcttggctgcttggtcaatattgccacactcctcgtgattactttaaaaaatgttcactaaatgtttatacatagaggataggcagatgtagatggaaatataaatgtttgtaacaaatatacagtaatctgtgtttggataaatatcttttagtgtattggtgtggctaaatgtcagaatgaagttaagatagttgtattactagttctgtgtgtatacagatttgtttatgtagtatatatacatatgtaagtgaaggtatatgtgtgcaggtattaatcaatggatatggcagtatatgggtaggagacagtcatgtctcttcagtttccgaagtgaattccagatctgtgttgcagtgaagaagaaaaaacctgctcagtgtttttattttattttattttatttacatattgagatggagtcttgctctgttgcctaggctggagtgcaatggcgcagtctctgcctcccgggttcaagcgattctcctgcctcagcctcctgagtagctgggattacaggtgtgcgccaccatgcctggctaattttttttctatttttagtagagatggagtttcaccatgttggtcaggctggtctggaattcctgacctcgtgatccgcccgccctggcctcccaaagtgctgggattgcaggcgtgagccaccgtgcccagccctgctcagtgttcttagacaaacactccagttttacatttctttgtatcttttttcttttcctatatagatagtgacttttttttttccactgggtttttagagtcagtccctcagtaatacagataatgactttgatttgagaaatttgtatgtggtcataaataagaggaagatctttgtactttactgtagcttcagtgaggtttagatcgggtgttttttttttttttttctttcctgatgtaagagcttcttgatcaaacttcaggcccagagctgcctgctctgagaggtcatggtgcctgcatagtcctcaagaaataattttttttggctaaaatgtgcagtctcccagtgatggaaactgtaaatgattcaaaacagttctaattcctggctaacttcggtacatgcggcattcctactctcaactattctttgagagataaacatgatatagaattcggatctcaatagccctagaagatgtcttatgaatgcatttgagtttttataaaaacttaatttagcagaatctctttttgggctatgaatatgtactttggctctgtttctggtgactgactttagtgatattaagaaagaatagaatattggctctggagccagacaatttaagttccaggtgtgaccttatgcaaactgcttaacctctctctgtgcttcataattagtacttaactcactgggttattgtaaagattaaataaactgatacatacagaatactgcttgactcaccataaacagtcaataaatgttactttttttttttttttgagaggtcgccctgtcgcccaggctggagtgcaatggcgcgatctcagctcactgcaacctccgcctctcaggttcaagcgattctcctgcctcagcctcctgaatagttgggattacaggcgtgcgcctgcacgcccagctaattttttctatttttagtagagacagggtttcacaatgttggccaggctggtctcgaactcctgaccttgtgatccactcgcctcggcctcccaaagtgctgggattacaagtgtgagccaccgtgcccggtcctactttttgttttgttgtcttaaattatatagttcagttcaacaagtgtttgtctgccttatgtaggtaacaaggttaatttgaactaccttggccatgattcccatattttaaagtacaagaactcccagtttaaggtaaaaaaattagggccctattatgattggagcttggttgcagtattaattaattgagaaaatattgtaaaaacaactgcttttaagcagttttatttatttattttattttttaatttaatttaatttaatttaatttattttttgagatgaattcttgctctgttgcccaggctggagtgcagtgatgtggtcttggctcactgtaaactctgcctcctgggttcaagcgattctcctgtctcagcctcccaagtagctgggattacaggcacgtgccaccatgcccaggtaattttcgtctttttactagagatggggtcaggctggacttggactcctgaccacaggtgatccacctgcttcggtctcccaaagtgctgggattacaggcatgagccaccatgcccagccagcaattttaattattagacctcttttacctatgtatgtgagaaagaatacaacgtgaatgttttgggctttctttccctgctggcttagcttttaagatttttggggaggagaggaaacagattagttaatgcttttccatttgccctccaacttcaaaaattttgttgctattttctcttcacttgttctttttgtctttttggatttgttcaataccttctttattcctttactgtcttttcagtgggatcttgggagggagcagaggtaaatgtggatgtatgatattatttttaaactgaaaatctctagttgtaactatacttacattgttaaacatttagtagtctgtccttaggaatgttggctataagtatatatagaacttaaaaaaataatagatttctgtaatatagtatgtaagaacagtggggacgcaagcaggagtgacctctctgatatgtgtgttgtattgctgatggcttcatgaaaagggtgcctttggcaagatacttctctgagataccaactttaaaatgggctaatggcctgtaatcccagcactttgggaggcttaggtgggaggattgtctgaggccaggagtttgagaccagcctgggcaacatagtgagaccccgtctctacaaaaaaaaaaaaattagctgggtgtggtggtgcatgcctgtaggcccagccacttgggaggctgaagcaggagtatcacttgagtccagcacttcaggcagcagtgagctgtgattgtgccactgcactccagcctaggggagaaaggggcttttaatacctttctaaacatagaaattttttgcatactgtagaactgtagcacttcaaatgtaagggatacaaaaaagttaagataaacttgggtgtagaagagaatatcatatagagatacaaactgcaaaaagaaggaaatacagacaggagataatagagatacaaataaaaagaatacagtaattgctttataaaacagtctgtggcctgggcatggtggctcatgcctgtaatcccagcactttgggagaccaaggtgggtgggtcacctgaggtacggagttcgagaccagcctgaccaacatggtaaaaccctgtctctactaaaaatacaaaattggctgggtgtgatggtgcatgcctgtaatcccagctattcgggaggctgaggcaggagaatcacttgaacctgggaggcagaggtttgcactgagctgagattgcaccattgcaatccggccagggcaacaacagtgaaacaccatctcaaaaaaaaaacaaaaaaacgaaaaacaacaaaacagtctgtggctgggacagcgctgttaaaaaaagtaattattaggctgggcatgatggctgtcgcgtgtaatcccagcacttgtggggccaggacaggcagatcagttcaggagtttgagaccagcctggccaacttggtgaaaccccgtctctactaaaaatacaaaaattagctgggtgtggtggtgtacacttgtaattccagctactcgggaggctgaggcaggagaatcgctggaacccgggagatagaggttgcagtcagtctagatcacagcactgcactccagtctgggcgagaagagtgagactgtctccctgctgcccccaccttccccccaaaagtaattatcatcaggtttgagtatgttaaatcagggatgcatcttagaggaggtaaatactatgtttactttttagaggaaatgaatttttgagtggggaagatgggaatgtcttcttcaagatttattgtgggcagcaggaatttaaatcttcataatttgtttatgtacttttactttgatttatgaagtaggagagacagaagactgggagatggcacagggcagtggttctcaacctttgttcatttagaatcatcaggggaaattttaagaaaatacctcgcttgggccccagtattctgacttaagtggcctggagtgcagcccaggcatactgttttttttttcttcttcttctcagaagtgtgccagctggttctaatgtgcagttaggtttaggagttcaaactccctggctgggcatggtggctcatgcctgtaatcccagcactttgggaggccgaggtggatggatctcaaggtcaggaattcgagaccagcctagccaacatggtggaaccttgtctctactaaacgtagaaaaaattagccaggcgtggtggtgtgcccctgtaatcccagctactcaggaggctgaggcagaagaatcgcttgaacccaggcggcagaggttgcagtgagctgaaatcacaccattgcactccagcctaggtgacatagcgagactttgtcccccacaccaaataaataaataaataaataaaaaataaaacaggagttcaaactctctaactccctagactttagagaagtttgtttagtgtgtctgggataaatgagagcttcccgcccctgtccccttttgaaacggagtctcactctgtctcccaggctggagtgcagtggtgtgatctcagctcacttcaacgtcttcctcctgggttcaagtgattctctttcatcagcctccttagcagctgggattacaggtgtgtaccaccatgcccagctaattttagtacttttaatagagacaaggtttcaccatgttggccaggctggtctggaacacctgacctcaagtgacctgtcctccttggcctcccaaagtgctgggattacaggtgtgagccactgtgtcattatggcattaattacctcttgatatactatagtaattaatgccataaggaaaattacagctgatatgaggatgatggtatattaaatttgtgcttttaggtagtcttgggaaggcctctttgaggtggtgtttgagtaaagatctgcatgatgcaagatagcatcagtacagatatccaggggacatttctgtttgtctgttatataatagacaaaaacagctagatagattttcatatttggatggaattcgagttgggctgacttaaaatgtaggctctataaggagtgatgaagatgtctgtgtgactaccattcaggagatatctggcatctatattaaacagaaaacagtaatttcaaatatgagctctaaatagaaattcgcaagggcacatgttccaaaccgtaggattattatattgattagtagctgagttgcttctcacattggcacctttgtgcagcagtagcaattgatttttttttttttttttgagatgtagtctggctctgttgctcaggctggagtgcagtagtgtgatctcggctcactacaccctccgcctcccgggttcaagcgtttcttctgcttcagcctcccgagtagctgggactacaggcacacaccaccacgcccggctaatttttgtgtttttggtagagacagggtttcaccttattggccaggctggtctcgaactcctgacctcaagtgatccgcccacctcagcttcccaaagtgctgggattacgggcatgagccatctcgcccggcgccattgatttacagacggttaagggttctcttgcccaacatcagttggggaagttagtcttcaaattttacttaactatagccagtttagccaggttgcacacctgtagtcctagctgcttgggagactgaggtgagaagattgcttgagaccaggagttccaggttagcctgggcaacatagtgagaccctgtctcttaaaaaaaaaaaaaaaaaaaatatatatatatatatatatatatatatatatatatatatgtatgtatgtatgtgtgtgtatatatatgcatatatgtatgtatatatatgtatgtatatatatgtgtgtatgtatacacacacacacacacacacagcacgcacgggtgtgccaagttcagcatcctaaaggaataatataacttatgtgtcccaagacgttgagagatataactgtgataaattgaacaatgtatatgaagaaaccccacagcaagtatcttacacggagtagtaggtctttagagattgagccctctccatgataaatttttcgtggtgattatattttcaaaacaaatgatgtcagatactaaagattatagcaaagtaagtggtctgatgacacttttggttaatgtgaatgaagagaatcataacttggaactcttaattccagtaattttgtatcttttggagaacctcttctgtgcttaagtagatgttggttctcttgcctgaaacaacactgtccctgcattgtgttttatgttgtattttatcatgtgttacccctttctttgtggtgcagtcactgacctttcccaaacttgttttgcagtgagttctgcttcataggaatactcattttggcttttaatactatagtgttactaacattttttctcttattaaatgatttcatttttggttaattatatcaaaagctttgtgagaaccttacattaattttgtaccttctttttaaaaaattttaaaaattcttgtgggtacatagtaggtgtatatatttttgggttacaggagatgttctgatacaggcttgtatcttctttattgactttgaatgatctttgcatatagtaccttttaataggctattttaaaatagcgttgaagtctgatgagatgtcagtggaaatggagttttacagtgtattgtcagtttgaaaagataatgtatttcttgtaacatttttgcaagttttttagggttgtacattatttcttaaagtattagaattggtaactaattaaaatttctttcctttgaaattttcaattttgccatcctgggcaacatggcaaaaccctgtctctacaaaaaatacagaaattagccgggcgtgctgtcacacacctgtagtctcagctacttgggaggctgaggcgggaggattgcttgagcctgggaggcagaggttgcagtgagttgagattgcgccattgcaccactccagcctgggcaacagagtgagaccctgtctcaaaaaaaaaaaaaaaaaaaaaaaaaggaaattttcagttttaaaagggacataccttataggatgttagacagactaaggaaaaagtaagtacgtataatttcattacctagagatgggcattgttaacattttggcatttctttttactttcttctattagtattatttttttttggagacagagtctcgctctgttgcccaggctggagagcagcggtgcaatctcagctcactgcaacctctgccttctgggtttaagtgagtctcctgcctcagccttccgagcagctgggactacaggttcatgccgccatgcccggctaattttttgtattttagtagagacaaaatacaggggtttcactgtgttacccaggctgctctcaaactcctgagctcaggcaatccgcccgcctcggcctcccaaagtgctgggattacaggcatgagctaccatgcctggcctcttctattgtttaatatatttttatagaatttggatcatagtgatgtgttatgaactaccccctccttagttaatagcatagttaataggctattgctccatgtgtacatgtttattctttttttgtttgtttgtgttttgagacagagtctcactccgtcacccaggctagagtgcaatggcgcgatctcggctcactgcaacctccacctccctggttccagtgattcttctgcctcagcctcctgagtagctgggattacaggtgcctgccaccgtgcccagttatttttgtatttttagtagagacagggtttcaccaggttggccaggctggtctcgaactcctgacctcaagtgatccgcccgcctcggcctcttgaagtgctgggattacaggtgtgaaggcattgcgcttgggtgtgttttttcctttacaatatcatttaaaaatttttattttttatagaatataaagtaaagttgtctattttttgtgtacttgtcatacaggtacacacatgcatagattgatgtaacccaccatcacagtcaggatacagaccagtttcaacacctgaaaaaattccctgtggtatcactttgtagtcacatcttccctttaccactaatcttttgggaccactgatctgttctccatactatggagttttgtgttttctacattgttactgaaatgtaatcattcagtatgtaacctgttgatgctagctgcttgcacttagcatgatgcccttgagattctgtcaagtttttgcatgtattaatatttcattccttttttattactgaatagtattccatcgtattgatgcatcattatttgttttgccagtcactctttgaaatatgtttggggctgggtgtggtggcttattctgtaatcccagcacttagggaggctgaggtgggcacatcacttgagaccaggttgggcaacatggcaaaactttgtatctacaaaaaatactaaaaattagccagacatcatggtgtgcgcctgtagtcccagctacttgggaggctaagatgggaggattacctgagccctggaggtcaaagctgtggtgagcagtgatttcgccactatattccagcctgagtgacatagtgagaccttgtctcaaaaaaagacaaagagaaagaaaaaaaaacatttgggtgttttcaatgtttgatgattataaatagagcgactataaacttctgagtatagatttttgtgtgaacataagcttttatgtctccagggtaaatacacagaagtgggattacagggccatttggtaagtttgtgtttaactttgtaagaaactgtcaaaccagtgtggctgtaccatttgtatttcctttagaaatgtatgagagttccagttgttctgcatccttgccagaacttcatactatctttatattgttaagatatctatactgccccaaacaatttgcagactcattgcaatttgcagactcattgcaattcctatcaaaatcccagtaacttttttctatttctgcaggaaaaaaaaaaaatctgttctaaaattcatatagaatctcaagggaccctaaatagttcaacataatcttgacaaagaacagagttggaagattaacacttgatttcaaaatttagtatgaagctacagtaatcaatatagcaaagtaccagcataaagatggacatatagactgaaggaatatagagccgagaaataaactattgcatatatggtcaaatgattttcagcaaggaggccaagaccattcattgggggaagcgacaatcttttcaacaaatgttgctgggaagactggatactcacgtgcaaaaagtataaagttggactttaacaccatatacaaaatacaacaacggagaataagtgttggtgaggatgtggagaaattggcactcttgtgcactgctggtgggaatataaaatggtgcagccattatgggagatggtggagtttcctcagaaaattaaggaaaaaatagaattaccatatgatcgctgttctgtttctgggtgtgtacctcaaagaattgaaagcagggaatcaaggagatatttgtacaccagtgttcatagcagcactcttcgaaatagccaaaaggcagaagcaacctaagtgtctgtccattgatagttgaatggataaaaggaaggaaattctgacataggctctaatgtggaggaaccttcaggacattatgctaagggaaataagccagtcacaaaaggaaaaatactgtatgattccttccattcatgtgagatatttagagtagtcgaattcatgaagacagaaagtagcaaagtggttgccaggctttggggagaggggataaaagtcagttactgtttaaagcgtacagagtttccctttatcctgatggataaacaacagcatgaatatactcaataccactcaactgtacacttaaatgataaaatggtaaattttatgtttattttaccacaattaaaaaaactacataattgaaaaaaatccaatggccatgtttatatagtcatatctcttgactctattttgttccattgagctatatgtctgtcctttgccagtaccacactttcttgtggtactgccttttcaaatacatttcagtcagtttatttatatggtgcaatcatagctcactgtagccttgaactcctgggctcaagtgatcctcccacctcagtgtccgagtagctagaaccacaggtgtgtgccactacacctggctaaatttttttaattttttttttttttttgtgacggagtctcactctgtcgcccaggctggagtgcagtggcgtgatcttggctcactgcaagctccgcctcccaggttcacgccattctcctgcctcagcctcccgagtagctgggactacaggcgcccgccaccacgcccggctaattttttgtatttttagtagagacggggtttcactgtgttagccaggatggtctcgatctcctgaccttgtgatccacctgcctcggcctcccaaagtgctgggattacaggcgtgagccaccgcgcccggcaatttttttaatttttaaattaagatagatacggggtctgtctcaggctggtctcaaactcctggctcaagcgatccttccgtgtaggcctccctaagtgttgtattatgggtgtgagccaccatgctgacgccacctgggattttgattgaaattccgttaaatctgtagatccatttggggagtgttgaggtttttaccagattgacttgttcagtccatgaacatggtattatttaggcttttgatttgtgtaatcagccttttatacttttcagcatacatatacaccttttgtgtatatgtatgtctaagtatgttttagagctattgtaaactggtattttaaaaataaattttggttttagattaatcagtgctcgtatagaaaagtatgattgatttttatctacacgggtaatcatttctgtaaaaagggacagttttatttctttttgatttgtttgccttttatatcctgattttttagtgcagtgactagatcttttagtatagtattgaataggaatggtaagagcatacatccttgtcttgttcctgatctgtatgggaaagtattcagtcttttaccaataagtatgttgacatgccaggcacagtggtgtgctcctgtagtcctagccactcaggaggatggcttgagccccaggcgttgccctgggcaacgtaacgagaccctgtctctaaaaaaacaaacaaacaaaaaaaacccccaaaaaactccagaccttgtgatccgcccacctcggcctcccaaagtgctgagattacaggcatgagccaccatgccaggccgaaaaagccaaattgcttgatacgtaccatagactgaggtctccagctgtggttgcgtgccatttcaggcacaggattcattttgtaaacagatgacatacatttaccgtattgataagtgcaatatagtgccgtaaatgtattttctttctctctctttttttttttttttgcaattcagctttttattgtaatcatatgacttgtccctgccttttgggaacacttcgagcatcactagtgttaccttttatgggtttcatagtgttattcagggtttatggtattgcactaaacccgatgaaaatacatgagatggccgggcgcagtggctcacgcctataatcccggctctttgggaggcccaggcgggcagatcaggaggtcaggagatcgagaccatcctggctaatacggtgaaaccccatctttgctaaaaatacaaaaaaattagccgggtgaggtggcaggcatctgtagtcccagctactcgggaggctgaggcaggagaatggcatgaacccgggaggcagagcttgcagtgagccgagatcatgccactgcactccagcctgggggacagggcaagactcggtctcaaaaaaaaaaaaaaaaaaggaaaatacatgagaatcaggagagatcactttttactgcgattaccaattaacaattgagagatgaactgctcacctggatatgattagggtcacatggtggtactcataacacttgaactcactgcaataggaacaaaattatcacagttttataatatgtactacagctaattttatttagttatgatttaatactgtattttttacatttgtttacatttttcttgactggtgccatgtactatttgtgtgcgtaagttttgataattttaactttatagtagatttgtgtatattttatgtcagtaaatgatcaaatagactaatatctacatatattttatgcatcagtgacatactgttttcttaattttttagatatttctaggctacgtgttttgtctacatgttttttaaattgtcacaaatctctgaaatttttttcaatgtatgaattggaaaaaaatttatgtatgagtggtctcatgctgttcaaacttgtatggttcgagggttagctgggttttcttcttatgcatacctgtaataaagtttaatttaaaatgtaggcatagtgacagattaacaactaataataaaatagaacaattacaatatattaggagttatgtgaatgtggtctctcagaatatcttatgtactgtacttttggacctttgattgaaaatatcttattgtaccatacttacctgtttttgggcttctattgactgggtaactgaaactgcacaaagtgaaactgcagataaggaggggcactgctgtatctaataactgtccatgctgtctttatgcttattgagttttgcaaaaaatgacatccaataattcatttttaaaagttttgtttttgaacactttcattttgcacttacagaaaaattgcaagaatagaatgttacaaagaacttccctatataccctttacccagctctactagttttaaacattttactacatttgcttattattcccttaatatatatgtgtgtgtgtgtgtgtgtgtgtgtgtgtgtgtgtgtatacacatcatattttattctacttgagagttggttgcatatatcatgctcattttccctatactgttgctgtgtttatttctcagaacaatgatgttcttttataatagcaatttggttgtcaaattttagtaatttcacattgatacttttatctaatttatggtacatatttgaatttaatccagttggcccaataatgttctttagagaagttttttccagtttaagatccaattcaggataatatattgtgtttagtcactatgtaaacatttatttttaatagaccattggcctgaaaatcttaagtgttgaatttttgttcttttaacagctaaaccaggtggacaggtgaaatgtcagtatatctctgctgtggataaagttatatttgtggatgattatgcagtagggtgtaggaaggaccttaatggaatcttgttgttagacactgctctgcaaactccagtttcaaagcaggatgatgtggttcagcttgaattacccgttacagaggtaagttgaaataagtatcaatgtggtcctctacttaatgtaatcttagacatattagatgttaaatgaaattaagtcatcctttaaggacgttattatatatattgctataaaaacaatttacttattgaccacaacttcatttaaatattaatactcaccttttctctgcataattaattcttgttgaagtggtgtttttaggtgtgaatggtgcatcagcacaggttaaacagctgtaaccgagacccaaaaaaacaatggcttaaacaggatagcttgtttccaataatagtccagggctaagtgtatggccatcattgccaacctcaacacttgggttagcttgggagtttaagacagctgctctaggtgtcattatttcccagtcacagggaaagagagggcaagaggctagaggagagcactctggcatctctctcttctctccttccctttccctgtcccttaacccccagccccctctcctactcatttgttcttgttctctttctgcctttcacaactcaaatactctctcatatagcctcatatttaccccattagacagaatttagtcacatgaccacaccaagctgagagggagactgggaaagaggtggttctttctttcttttttttaatattttaaaatgagagaggaatagactctggtaaaacagcagtaatttttttttttttctttgagtcagagtcttgctctgtcacccaggcaggagtgcagtggcttgaccttggctcactgcaaccttcatctcccgggttcaagtgattctcttgcctcagcctccctagtagctgggattacaggcatgcaccaccacacccagctaatttttgtatttttagtagagacgggtttcaccatgttggccagactggtcttgagctcctgacttcaattgatccgcccgcctcagcctcccaaagtgctgggattataggcgtgagccaccgcacccagccacacaaccagtaatttttgctatgcatcatgtctttcaataacttgagttttaagttttagccatatatacttttctgtagtgttaaattttctttacttaatttttaagtctagcccaacttaaattcttttgtgtggcttcatatcctgcagtttgaaagtacatttttcataattactggattttgcatcaccttaaatagaatgtaaaagattatgttgtgttctataataaagtgagatattatttgtgttcatgctaacttgttatgaaagttatcaaaaaagtatgtccaataaagtatattcacttagattttacatttagtgtcatataacagtagtctattatatgttaatattgaaagcatgttgctgaaagtttgagttccaaaaacagagaagctgtctttttctcatcagagtatttgggtctggaggcatgtctaaaatctttggatagagaattaattagttctacttgatttgaacaagtagaaactttgaaaaaccatttgaaaaaattgaacatttttccctaatttaaggaatataaaccagctgatatcaggatatataatcagcagcaaaaaaacactatcaaactatgtttaggtttaacaaacaattaaagaattacaataaaatacttgaacacttattaactctcaagtcagtgtttttcctactacagtgaaatgctgtttagcttctatcccttcctccacctagtttactgttaaatctactgttttttttctctttgtactttaatcacagctgtaactgttgttcagataatattgtttgtagatcttccagcattccaggcttcctttactgcatcagattagtttgtcactgtcttccctaaagtcttaggtttgatttgctcagtgtagatatattcttttccttatattagcatatatctttattacagtagttcatattgaatatgtggataacaatgcaaagggctttttcatattacttgctgacttagtgtcctctattatgactttatatagcttgagtatttaaagctcattggaggactttaagtttgtctcttcagattttttcctgtattatttttgcttatggtttcagcttgtccatttttctatcttgatttggtttacaataactactttgtgtttaaactttaccatgtagtatttctacactgaatacattgctttatctcatttaattttataatagccctttaaattattgtttaattaagtagatttgttaaaaggtaagtttagtatagtacctgtcataatcattgcatattaaaatatctgaaagaggatctgaatttaattttttgttgttcttgtgttgaattttctgtgatttttttattttttattttttatttaggcacagcagctcttatcagcatgtttagaaaaggtagatatttctagtacagagggttatgatttgttcatcacacagctcaaagatggtttaaaaaatacatctcatgagactgcagcaaaccacaaagttgctaaggtaagaagttaatagattgcctcttttggggttatattacaatggacacctccattcttttgcactttcctttcctctccttttggaaatgttctaattctagatttttcttttaaaaagcagaatgtgcttataagtcatcttaaagttgaaactggctgggcacggtggctcacacctgtaatcccagctgagggaggctgaggcgggcagatcacctgaggtcaggagtttgagaccagcctggccaacatggcgaaaccccatctctattaaaaatactaaaattagccaggcgtggtggcaggcgcctgtaatcccagctacttggaggctgagacatgagaatcacttgaacccaggaggcggagttagctgagattgcagagattgcgccactgcactacagcctgggggaaagagtgagactctgttgcccaaaaaaaaagaaaaaagttgaaactttgaaacttcttaatcgaagcttaacttcagtttgtgggaactattttgcttattgtgttttctgatgcttccttaaatctttcttagtgcctgatggacctggattggtcaagaggctgatgaaagaagcttccttgttaggttgtgagcttggatgcttggataagaatggactatgtctttggaaattgagccattttgtgctttctctgaaattttttggcatactgggatgtatatgagagacagtgctttcaattaaatccttgggtatatttttattaatttcctccagatttttcttttaaggccttttctaagttatactgcatatcaaacttccctgttattgaaggatataaggtagaaggtaaaagccattttcctataagtaacttgggcatttgcaaagatttttctcaagtgcagttgtaactatactaaaatatactaatattgtgttatgatataccttgctttttttcttttattttttcttttgagacagagttttgctcttgtttcccaggctgcagcgcaatggcacaatctcggctcactgcaacctctgcctcccgggttcaagtgattctcctgcctcagtctcctgagtagctgggattacaggcgtgcgccaccacgcctggcaaattttgtattttttagtagagacagggtttcgccatgttggtcaggcaggtggcgaactcccgacctcaggtgatctgcctgccttggcctcctagagtgctgggattacaggtgtgaaccactgcacctggctcttttttttttttttttttggttcgagacagagtctcactctgtaacctaggctggagtgcagtggtgtgatcttatctcactgcaacctccgcctcgtggattcaagctattctcctgcctcagcctcccgagtagctgggattataggcacacgccaccatgcctggctaatttttgtatttttagtagaaattgggtttcactatgttggccaggcttgtcttgagctcttaacctcgtgattcacccatctcggcctcccaaagtgttgggattacaggtgtgagccaccgtgcctggccaccttgctttttttcactcaagaatttgtcttggatatcttctcatatcctcagagatcatctatgttcttcttagtagttgcattgaatttttttttgtagatttgtcatgattgtattataccttactctattgatggggcattttatttaggaaaacagaaactgtcctatgagtttcaacagagataatttattgtaagaaattaactggtgtttgaaaactgaaaaagtgaaaaggagatcctgagataacagagataactataggaagcagttttcacctaggtctggaggaacaaagagtagagattaggggttatcagaacctagaaacttagagaataggccccgtggatctgggactaggaagtgctacccagttggtaactcaggagcttggacgagggcgttgcaaaactgggactcagatctctgaagagagatgctacttgactgatggtagtacctctgagggaactctatgaaactggatctcggaatgctaaaacaaccaaaccaaaacaaaatgctgaagactggaagaatcaactactgcatcatgtcctttgctgaaacagtgctgatggcaatggccagtaaataagaaggagcaagtctttcttcatctttctttccagtttccttcctgtgctgttgctgggagaacctaaaagccaggaaactggttgaaaagaggaaatacagtatgcagagtcctagccccaacctgatagagcagagaattaaagggtagatttggagctcagagacaacagtttaattaactgcacagtctacccctttggctactcagcatctccattcacactttatatatttgaactttcatataacaaaactattatgctttttaaaaaatttatttttatttttggagatggggtcttgtgctgttgcccaggctggagtgcagtggtgcgatcttggctcactgcaacgtccgtctcctgggttcaagcagttctcctgcctcagcctcctgagtagctgggattacagatgtgcaccaccatgcctggctactttttgcatttttaatagacatggggtttcactatgttggtcaggctggtctcgaactcctgacctcatgatccacccaccttggcctcccaaaatgctggggttacaggtgtgagccaccgcacgtggcctggtcctcagtttatttaattttttaatttaatttttttttcttagacggagtctgtctctgtcacccaggctggagtgcagtggtgtgatctcggctcactgcaagttccacctcctgggttcaggtggttctcctgcctcagcctcccgagtagctgcgattacaggcgcgtgccaccacgcctggctaacttttgtatttttagtagagacggtttcaccatgttggtcaggctggtcttgaactcctgaccgtgtgatctgcccaccttggcctcccaaagtggtgggattccaggcgtgagcctagtcctcagtttataatggtcaagaggatatattggtcaagaggatgtataatagtcaagaagatatctaatttcttttttttgtattacctgttccttattagctctgtcatcattcagcatctcaactggtcaggattctttacgtacatgaacgacccatcttcattcttgaagaatctgaatcctcactggtgctgtgtctttattttattttattttttgagatggagtctcactttgtcacccaggctggagtgcagtgatctcagctcactgcaacctccgccttctgggttcaagtcattctcctgcctcagtctccccagtagctgggactataggcacgggccaccacacctggctaattttttgtattttagtagagacggggtttcactgtgttggccaggctggtcttgaactcctgacctcaggtgatccaaccgtcttggcctcccaaagtgctgggattacaggtttgagccaccaagcccagctggtgctgtattttaagttgtaattgttacttcatctttactattggacttggaagtactaaggggcatcctagagaatctcttgggttctgcataagttctccttgcccctgttacttagcatcaatccaggtttccgcttgtcagttccagtcatacaaactagtagaacttctttgactatttattcagtggcaagaggacctcaaagttgctgggtagcaatctcaacacccacttcaatggaagtgttgttgtacccctgctggaacattcctcccttgggagtaagacctgtagagctgaaagctttaaaaaaaatctgtgaatgagtttattaaatataatagtgggcatgcccagagaaactgtatcatacatttttggttgattcaaagcatatgcttcatcttgtaaggtagaactccataacctttcagcatgtctctttcggttagcgttgaaaatgagtctttagtaggccattgagcttttctgccaggccagcttcatcaggatgatacacagtaagaccagtggaaaaaagatttttttttttttttgctttgaaatacttttcttgatcagaagcaaagttttctacaataccatgacattctgtcagtccacaggcaatggactatataatattacggcagaaaactatggacagaacaggtaaatgcatacctagaatatatatttgttatgttgaagacaaattgctgcctagtccatgactaggaatcccgtataatcaacctactgtcagatagctggctgttccccctgggaaatgacgtgatatttgccacccaactttggtaactgtttggcagattaggcaatcagcaacagctgtagcctggttagtattggtacagggaagtttacatttttgggcctgtgcatagcctccatatctgttgccatggtattttgcacacaagtccattgagcaagcactggagtgcccgtggagagaggcttactgtcatgtatataatgtgtataacttctcccatttcttctgaaatggatgccttttggtctgcattgacatatttcatacgtatttttaccctctgagagttctattcatagacctttgtttttgacctccttgctgctagtcttctagttctgtttcttccaagtgcctgaccatctagctaacaaattagcaactctgttaactagtgaggatctttacttctagccaactctaaatccatacaagaacagtcatacatactgactgaagttctatctattgagaagatttaccttcaccactctccttgtgattggggctatgattctgtagccatccacttcggggtagtaccagcatatcatgcagaaccatctgtaaatcagggccaagagtattttcccctcatattatttcatcataaggagttccccatgaagctattgatgtagaacaaggaggagacattatagtgggagtaggtattgaattctgagccacttgtttattcagtttttgccttttggactttgtgaagacagatcttttataaaacacttgatgaaggatacttgttgctggtgctcaatattatggttggtgtgtcagataacatttggacagctctgaatttgtagacattagtttcgtagatagatattaatctctatctgggactagtaaggaactaggagctgtttttcaaaaggagaatggttatttgcatgagagggtgtggctttgctccaagaccctagcattctgctgtgtgattgtcccaattaggttgccacaggctccttacagcatcattatttgctgtggacttctagtgtcagtgtcattgaaagtgctcttaaggtaaaagtggcagagcatcttgcagtacagtctggtcttgttgcagagtttcttgttttgcaccttactcaaaattggcaaccttatatgtttcttgatacttggattagagcacacattcaagtatgctaaatattggctcccaaatccaagtaggcccactaagtactgtggcttttgtttctgtggttggtgttacaagttggagcaacttgtctttcagtctggagggaatatcctgacatgaccagacctctggacctctgaaacttaaccatggttgcagaatcttgagtttttctggggactcttattctctggtttgcaccttactcaggcatttaatttccttgctgtttccttttcatctggaccaatcagcgtgctgtcatgatgtagtggaccattatgttgatctgcaggatgttaggatgatcaggatttctagaatgtgagatgtggtcttagggaaagattgcaaagatttattattgttcctgccaggtaaaagtggactttttgtatagtccttaaaagtaaagatagaaaaatattggatagaactgtaactacctaccagatatcaggggatttgttgatttgctttaataaagatacctcatttggaaaagcagctgcaatggaagtcgccacctgatagtttaccatccacagtcattcttcaagattcatttacaacagtccagtaaaggggacgaggtcatttgattacctctgtatcttttaagtctctctctctttttttttttttttccaatacagggtcttgctctgtcactcaggctggagtacagtggtgtgattttggcttactgtagccttgccgtcctgggctcaagtgattttcccacctcaaggcttctgagtagctgggatgacaagtgcatgccatcacgcctggctgttattttttagtagagatgagatcttgctatgttgaccaggatggtctcagacgtttaggctcaaacgaacctccatcctcagtctcacaaagtgctaggattataggtatgaaggcactgtgcccaacctcaaatcttttacagtggcattaatctaaaaaatttcttcaggaatgtagcattgctttagtttaatatctttgtagagaaggaaagttctaggggcttatacttcatgttttctatattactggcccacagagaagagcagagagctaatctggggattgttttcagttgcctgttttatattatgcattcaggaactggggaagtaactattacacaataaggatttacagacccatagaactctctgagacagctttgggctgaaactttattaatcgcttgaccatcctacgtgccctctttcttggaccacagtgatgttttaggtcagttcagtgccatgtttttgtaatgcctgaaagatcttttcccccatgcacagtcactgtagtgaatgcccataggtctttctgagggaaggtttggagtatgatttacagtaccaactatagttggggtatcataggatcctttctcaaggggagtcatcctccctttcaataaaaagctctgatctgtgaacagattaattaggtctagaagttttcattctccctcttttttttttttttttttttagcaattcaagtcatgtttttgtctacaagtttttccagtattgtatagataaataataatttactaggctgccttgagtatactagacaagagtagaaaccattcatgggtgaactggggacaggatataaagatgcaattacattatagacttatttctctgggagaatagtacttagcatttttgtggtctaacttcagtaattgttgtaatattaaataatcatggctaacatttatcgaatattgctgatggcgaagctgggcccagaatccagatgtgtgactataaggcctgtgtttttagttgctattgctggattatggtgacaacagcaacaaaaacaatgcatctgctaagctgaactaaatcctcatataccccagtaatggtaattgtctaaatatattcttatggatggaggtatttgagtgcctactctgtgcttaacattgtactggatgaataggaaaaatgacagatgattttagttgtccttaatttttggtgatatatataagaacatgtgttactgtctggttctgaattgtcttttccagaatagttagttgaggtttcatttaaaaaattaaaaaattttcattgataaataattgtatatatttatgaggtataatgtgatgttgtaatatatgtatacattatagaaagattaaattaagctaattaacatatctatcaactcacctacttaccatttctttgtgatgagaatgtttaaaatctattcttttagcaattttgaaatatacaatacgtgggccaggcgcagtggctcatgcctgtaatcccagcactttgggaggcagaggcggacagatcatcaggtcaggagatcagcctgaccaacctgatgaaaccccgtctgtactaaaaatacaaaaaaattagccagggatggtggcgcatgcctgtaatcccagctactcaaggaggctgaggcaggagaatcacttgaacccaggaggcagaggttgcagtgagccgagattgcaccactgcattccagcctggcgacagagtaagactccgtctcaaaaaaaaaaaaaaaaagaaatatacaatacatgattagtaactgcagtcaccagatcactaaaattaattcctcctaagcttcccaaagtgttgggattacaggcgtaagccactgcacctggcctttactgcacattttctttacccagtcacccattgatggatacttagattggttccatatcttggcttttgtaaaatattttatttttttttataactgcaagtttctgttttaaatgataaactaatgaagaaaactgacttgaaactgatgagtgttctttatttgataatggttaagttatgattttggttaaaactgttgagtacattttcctttgcttatactcccattttctttcagtgggccacagttacatttcatcttcctcatcatgtgttgaagtccattgccagtgccattgtaaatgaactcaagaaaataaatcaaaatgttgctgccttacctgtggcgtcctcagtgatggacagattgtcttacctcttacctagtgcacgtccagaactcggagtggggccaggccgttctgtagacaggtatgaaccttgctaacaaaggtgacagtgagatagaattgattagtttttgcattaaacaaggaataactagaaaatctggttatgatttttaaaaatttcacaatttctagcctaattttgaaattaaaaaaaaatcaatatgaattagaatctgaaaaccagatttaaagtaaactgctacttgaattgctatttttaaacactatattttagtacactaaaggtatttgaagggattataaagccacattttggaaattccagtttagtacttgcttagtaaatattttagtcaaattaaaattactataattatttaatgattaataactatttttccattgatgacattttgtgacctttgagataaattttgcctaacttaccatgccctaatgtgagtataaggaaagtgctatcattttataatgaaaaaaaaaaaaagaccagtttaaaaaataataggaataattttgagttaacaattttttatgctgctcgccctggatttaaacagtattacaaaaatcatacctaaaccatcattttctttggtagaggtttttttgaatgcctattttgtttaattaattaaaaaaccagtgacacattcatttaaatacttaaatgatttgctatttgaaatgacgattgaggttcttacaaaaagtaccaaggtttagaaatgctgtactgaaatataatacgcagcaattttgattagatttttgtttgccttttcatgtagtatttatttatttatttttgagacggagtttcactcttgtcgcctaggctggagtgtagtggcacaatcttggctcactgcaacctctgcctcccagattcaagagattctcctgcctcagcctcctgagtagctggaattataaccgtccaccaccatgcatggctgatttttttttttttttgagatagagtttcgctcgttgcccaggctggagtgcaatggcacgatctcggctcaccgcaacctctgcctcccagattcaagcaattctcctgcctcagcctccttggtagctgggattacagacatgtgccaccataccggggctaattttgtatttttagtagagacagtgtttctctgtgttggtcaggctggtgtcgaactccctacctcaggtgatctacctgccttggcctcccaaagtgctgggattacaggcatgagccatggcacccagccaaattttcttttttttatatttttgttttgagatggagtctcgctctgttgcccaggctggagttcagtggcatgatcttggctcactgcgagctccgcctcccatgttcatgccattctcctgcctcagcctcccgagtagctgtgactacaggtgcccgccaccatgcccagctaattttttgtatttttagtacaggtggggtttcaccgtgttagccaggatggtctcgagctcctgaccttatgatccacccaccttggccgcccaaagtgctgggattacaggcgtgagccactgcacccggcatgcctggctcattttttgtatttttagtaaagacagggtttcaccatgttggccaggctggtctcgaactcctgacctcaaggtgatctacccgtcttggcctcctagagtgctgggattacaggtgtgagccactgtgcccagctgtagtatttatatttttacattttcattggatgtgacttgtaatttcctaagcatctttctgaagtacatttataaatagtatgtgcagatgttatcaaaggcactactgaataaattcattttaaacttctattatttttagtatggctcttctagttcagtagcaatatttattaatttatcttttggtaaactgatttctgcgtaatcacttaccctctttttgttagttaagtgattttgttgttacatatataacttttattagtcgtattaacaattgggcagaatttttatattctgtagtagtaatctcttgggcaacatgcagactatcatttttaatcagattatctggtgatatgtgctatggctgtcattaaaatattctttgggatatgcctgagatgggaaaaaagaaaaatacgtaattagaacaagtgcttcttgtctgagatctatgcctattttgagattataaaagagtcagctctgcagagctattttctttgcaaacagttgcagtgtttctaaagaaatcagtgcaagctgtggtaaatgttatattttaggaaatgcagccattagatgggatattcagtatttttagaggtgttaaaaatgtcctaaaatattaattttgatacagactgtggtgtttttttcattaaaaatcaatctaggagcctctgaaggctttgatgaacttaggtctgtggaaggtttgagttagggtctattggatgctactgctgttttattgggtaatataacgaaatgagataggtcttctgttctaagactgatcctaaagacacatataatgtgaaactgagaatgcatttctaaccaaacagctatttgtttaaaaacctgaatacaactacgagtaaacctaaagttactagcaattttatagaaaatcatgtgctaatttaagggaagaatttagaagagtattttcctgttttctttgtcatgacctttaccactttttctttctgttatcagttgtaattttatgttaggatgaataagctttgcttatcaatcctttcttactaaaaatcttttggacttctcaaaaagtttactatcgtcctttaaaaaattactctggtactttctgttatagtttgactcttagtgagctgatatattttaatatgaaaacatatgtaatctacccctggagttgtttatcaactgcagccaccaatcaggttttctccttccctttctgtttaagggaaattcccaaaaattaccgtttttagtttaaagtaaaaaattgaacttgttcatcagaccatttgcagtttttgctgataacccagtaaaattattttttgcattgttaaatagaagtttcactgtgatttgatgcctaacttcaattacataaagtatgtttacttttagatcactgatgtatagtgaagctaacagacgggagacatttacctcatggcctcatgtaggctataggtgggcacaaccagatcccatggctcaagctggattttatcatcaggtaaaaaaagaatataaaaaaatacttttctcagtaggcctttgtagccctcagcaaaattatcacatttttttaactttttcagaaacttattttgtgcaccttgtatgcttgcttgtatgcatggatgcttgtttttttggcccaggctggagtgcagcgccacaatgttggctcaactgcaacctccgcctctcaggttcaagtgattcctgtgcctcagcctccttgagtagctgggaatacaggtgtgcaccatcacacctggctaatttttgtatttttagtagagatggggtttcaccatgttgccaaggctggtctcaaactcctgacctcaggtgatctgcctgcctcggcctcccaaagtgctgggattacaggcatgccaggccaggaaaaaaattgtttaagcaattaacaactgagtattttctttaagattagatacaacttttttaaaaaacaattatttttattttttgtctttgagacagggtctcactctgttgcccacgctggagtacagtggccctatcaccactcacttcagtctcaaccttcccaggcacaggtgatccgcccacctcagcctccctgagtagctgagactacaggtgtgtgccactgggcctggctaacttttgcaccaacctaattttttttttttttggtagacacagggtttctggtgttgcccagactggtctcgaactcctgctcaagtgatctacgcacctcatcctccccaaagtgttgggattataagtgtgagacactgtgctaggccataattttttttataaaatcaacaaatagtattcttcagatttggtttctgacaagtattctcttttgatgcatgtttatttccagtgtttgacatctgcattcataacacagtagtagatgcttagggtaatgcaataaaagcagttttacagtttcgaaattctcattttagttgggatacaaattacccatatactagataactacagaagcagcattacaggtagtgcattgcaacttgaatatctgtgcattaaagaactgattaagttgcataggtagaggaagaattagtcaagaaaaacagtcatagttttgtgtaggaaaagaggagagtataaagtgtaaggattaacacgatacagaggcataagaatgggacattataaaaagctttgctgaattagagggaagttaagaaaaatgattttagctagatgtaatatgttatttaataggaaacttaaactgagtggtatagagtggcttaccactgttaccactgctaaaagaatctaagaaatctaatacttatatgtcagtttaaataaagcatggttatttaactttatttatttatttatttgggacagggtcttgctctgtcaacccaagttggagtgcagtggcatgatcacagctcactgtgccacagctcactgcagcctcagcttccaaacaattctcccaccttagcccctcaagtagctgggattacaggcatgtgccaccattcccagctaattctgtttattttttgtagagatgagatttcactgtgttgcccaggctggtttcaaacttctgggctcaggcagtttgcctgccttaaccttctaaagtattgtgattacaggtgtaagccactgcgcctggcctaatttaagaattcaagtacattttgaagtacgttaaagtaactgtcatttagaatctgaagattgattattccttcgttatcttcaagtattctgaacatctttactaaaattaaaccagaaaactatatatatatatatatatatatgaatattttattcaaagtttgtcagatttcctgttacagataggtaagtttggagactggctaatattagaatcagtgaaataatttctctaaattaaggattgaacatggaccatttttctagcaacttgtctttcttttaatttggtgtaattttctaagagtctctgttaagtgatgccttgattttttttttttctttctgttgagttattgttcattatattctgtctttgcagagaggtcaaataataggtttcctagaatactctgattctaggaaatgttaggggctgattattttaatcttctaaaatgtatagtaaatttgcatctataacgtaaatgttcacaaatattaatattagttttcaggtatatttcagttcaggttttgaaaatatatacatatatatataaattgtgcctggcccttgaattgaaatatatatagcattttgtcctatgttgtatgaattagattccatattatgtgaattagattgactactttgctttccctttttacttgcccttcttgttcagttgtatgtgattgagtatttaataataaacccattggctggtgcagtggctcacacttgtaatcccagcacttagggaggccaaggcaggaggatcgcttaagcccaggaatttgagaccagcctggatgctgtaaggagaccatgtctctacaaaaaaaataacagaattagctgggtgtcatgaaacacttctgtagttccagctggggggctgaggttggaggatcacttgtgcccacgagttcagggctatagtcagctatgattgtgccattgcactccagtctgagactctgtctctttaaaagagaaagttttaaagagactctgtctctttaaaaaaacaacaagaggctgggtgcagggctcacgcctgtaattccagcactctgggaggctgagaggggtggatcacaggatcaggagattgagaccatcctggctaacacggtgaaaccccatctctactaaaaatacaaaaaaaattagctgggcgtggtggcaggcgcctgtagtcccagccactcgggaggctgaggcaggataatcgcttgaacccggggaggtggagcttgcagtgagccgagattgcgccactgcactccagcctgggtgacagagcgagactcagtctcaaaaacagcaacaacgacaacaacagaaacaaatagtgtaaaccagccagactctttctcttatacttaatatttcagatgctttagtatagcaatgagaaaagtactagatcagggattgcatatatgtgtacctctctttgatttagtggtcattttctgaattttcaaataatgcaggcaattaataaatatttggaggtttcagtgtattgttggacctaatattataggctaattttcttattttcagtatagaattttacttaaaattatgaacttttaaaaataacttttattataaagctattttaataatgatttaccttttctgtctcttttctttataattttgcagcctgcctcatctggagatgatagagccatgtgttttacttgtagtgtatgcctcgtttgttgggaacctactgatgaaccttggtgagtcttgatgtttctgggcataataggctaagtcagtcgtgtaaataatgcttctaaattttacttttctgcttatgatataattttttgcctttttgccacctatatttttgtcattgtcctgagaatgagctagccctgtctatactctggcacaccacttggcatacagtgtctgtaagtttgactttctaaaaattgtacacaagggaagtaccaaacagtagaaccacgctctaacgaaaaccggaaagctatggtaaagtgaactccagcgtgagcttcagcagttgaatcttggtctgttgagagcatgttgtcagtagggaatccatggagagagccttatagtatacatttctaattttgaagtaattttagggagtctttgatgtctctgaattttagtgcatgaaattttagaacctggttaaacattagagatcatgtattgaaacttcatttttacaaataactattctgaggtcttattaatagaaataatagtatattattatagcaaatatttatataagatggtatactaggtaccattctgaatactttatgtatttttaaatcatttaattctcatgtttccctgtgaagtaggtactattgtaatctccattttataggagggaactatgaatattttccagtttaacctttacagtcactctatgagataggagttactatcccattttaaaatgaagagaataaaatttgctgaagggcatatggctagtgatagagccagggtttggttttaggatatgttgcttattttgtatgaaaattagtttgaagtctctgaatgttaaatcagctgatgtgcatggggcaaacttgctaaaacgtattgcagtgtacctatggagttcagattggaaaatactgtatgaaaaattcaagttgtatctatctgcaggcagagagttgaatacagtagtcccccttatttgcagggcatgcattccaggacccattggatacctgaaacagcagatagtactgaaccatatacatactatatttttttccctatacatccataacctatgataaagtataattcataaattaagcacagaaagagattaataacaataactaataaaattgaacattttttttcccttcagatggagtcttgctctgttgcccagactggagtgcagtggcgcgatctcggctcactgcaacctctacctcccgggttcaggcgattctcctgcctcagcctcccgagtagctgggagtacaggtgtgcgtgggccaccacacccggctgatttttgtgtttttagtagagacggggtttcgccatgtttgccaggttggtctcgaactcctgagctcaggtgatccacccacctcagccttccgaagtgttgggattacaggcgtgagccactgcgcccggcctaaaattgaacaattttaacaatatactgtaataaaagttctgtgactgtggtcagtctgtctgtgtttctctctctccaaatatcttactgtactgtactcatctattttgggaccatggttgaccatgggtaactgaaaccatagagagtgaagctgtgggccaggcatggtggctcacgcctataatcccagcactttgggaggccgaggcgggtggatcacctgaggtcaagagttcaagactagcctggctaacatggtgaaaccccgtctctgctaaagatacaataaattatctgggcgtggtggtgtgcacctgtaattccagctactcgggagggtgaggcaggagaatcacttgaactggggaggcggaggttgcagtgagccgagattgtaccattgcactcaagcttgggcaacaagagtgaaactccatctcaaaaaaaaagagtgaagctgtggataagagggggacctgttgcatgagcaattttcagtttaagttgagtttctgtttggaattgtctttccccgtaaaggctgtgtgtgtgtgtgtgtgtgtgtgtgtgtgtatatatgtgtgtatatatatatatgtatatatatacacacacacacacatatatgtgtatatatatatacacacacacatatatatgtacacacacacacacacacacatatatacaccattttagtatatattttttaggtccctatgccaatcctcaaaaagttatttaacctatacctgaaaagttatacagtattatcaaatattattttctttgtaaatattttctatggaaagttgattaaaatttctaacttgggatactgaaaacccatgttttcttgacatggccagggattcagggagtctacctcttctttgcaccagcatttgggattcctcaaacactcaagaagttgatttggtctcttaagacctggggcaagtcttccaaatgggtaggagggaagaggattgatggaggctggggaacctaggcaccttctgaattgtaaaggggaaaggaaaaatttgaaagggcgaatgggactcatattttgactgtgcgagttgatagagagttactttggagggaggttgaagttaaaaacataaaaaatggaccataccctagtaactagcaattccacttctatttacgtaccctagggagttaattgctcttgtaggcacagaggcataaagtggatggtcactgcagttaaaaatcggaatccttttaaatgccaatcaggaggggaatagccaaatagaatgtgctatgttcatataatagactgtggtccaacagttaaggggaatgaacagtaagatctctgttaatcaccctcagtaactttcagatatgttactgtatcaagaaatctttcgtgttaatagaatggtagatgattggatacatgataaaatgtatatgtgtcatgtacagtgacaccaattgtttaacaatttaagaccctgtattttatttttaaaattttttttcatacatacttccacatcatgtattttctatatgtacatttatgtatgtaaacttaaaaaatattttagaaatgtatcacttaaatttataatggtggtttcctggaggtgggattggaaattattgggattagattttaaaattgatgtgggtctttagctttattttatatagccgcgtgtaacttatataaataaaattttattgaaaaagttaaaactcaggaaagagagagagacggaaaggggtaaggtacgctagatttagctgggagggaacctggcccaaatgtcatttgcttggaagtgcactgtaaaaggatttaggaaagacatctacatattaaaaattgcccaggatttatagatggatttatatatgtaagttgtaggtgcattgtaaaaagaaatacatacattttaaggagtagcatgttttatgtgtaaagttctttctttgccatggaaataaaacaatgagtttaaaaacaatggttctttaagaaacatttatttttaaaattttatttatttatttatttatttttttggagacacagtcttactttgttgcccaggctggagtgcagtggcgcgatcttggttcactgcaacccttgcctcccaggttcaagagagtctcgtgcctcagtttcccaagtagctgggactacaggtgtgcgccacaatgcctagctaatatatgtatttttagtagagatggggtttccccatgttggccaggctggtctggaactcctgacctcaagtgatgcacccatctcagcctcccaaagtggtgggattacaggcgtgagccaccacgcccagcctattttattttttagatacggggtcttgctatattgtccaggctgaagtgcaatggctatacacaggtgtgatcatagcttactgcagcctcatattcttgggcttaagcagtcctcctgcctcagcctcctgactaactgggactatatgctttaccatcacgcctggctcatgggttcttgttttggtagcaggatcctgacatttctaatgccttataattatagctaatagaaataaaaataaggaataaccagaaagaaatataaaggaatcataaagttgagcagataggtgctaagttgatcctgcttacaatatttgagataattcttaaagtcattataccagtcttgatatgaggtcctagtattttatttttatattttaatttaaatttttaaattttttattttttagagacagggtcttgctctgttgctcaggctggagtgcagtggcacgatcgtagctcactgcagccttgaacacccaggctcgagggatcttcctacctgagtctcccgagtagctgggaatacaggcacatgctaccacacccagctaattatttttatttttattttttgtagcaatgaggtctcactatgttgcctaggctggtctcaatcttctggcctcaaggatccaaccaccttggccccccgaagtgctgggattacaggtgtgagccacggtgcccagcctgtattttatatttcttaaacttgttatgtttttaatttaacatttcttctcgctcagtaagcatttatttgaaagaagtagtgtataatttatgaactttacattcctaaggctcttaggaaataaattttatttaaaagttatttgtctgatttgatcctatagtgaatacataaggtatatttctgtgttcttaatatatattattttattcatactagagatctttctgctttcagatcttttttttttttttttttttgaggtggagtctcactccgttgcccaggctggagtgcagtggcgcgatctcggctcactgcagcctccgcctcctgggttcaagcaattcttctgcctcagcctcctgagtagctgggattacgggcgcccaccaccatgcccagctaattttcgtatttttagtagagacggggtttcaccgtgttggtcaggctggcgtcgaactcctgacctcatgatccacccgcctcagcctcccaaagtgttgggattacaggcatgagccaccgcacccggctgccttcagatctttactaaaaaactttttagtaaaataatttagtaaaatatttagtaaaataactttttgtgttatgagtggcatttatcgagtttcagctgtatatcatttatagttgtggcccctgatagatatggagaattttaaattgaaacatagtagttaatcattcaaagctgtaggaaaccagtgtgaggaaataacaggagtttaaacaattttgtagtatgtaatatagcattgtattggtttttcagttttttctgagattgactttataatcagttaaagtgagtaacaactgctattgttgaatgtttggaatattgaatgtgtgaatttgtaaacggttgaacatgttagagtgatcttcataaaactgaatgatttggttatattaagtctttaatgatgaatactttaagttcagttaaaaaaagatgatgatcctggagttctgttttaatgtacaaactgaattgctttatttttagtaaacttttcctttctaaatctatgcaaaggtctgaacacgaaagacattccccaaactgcccatttgtgaaaggtgagcacacacagaatgtgccattgtcagtcactcttgcaacaagtcctgcacagtttccttgtacggatggaactgacagaatatcttgctttgggtcggggagctgccctcattttctagctgctgcaactaaacgaggaaagatctgcatatgggatgtttccaaacttatgaaggtatgtttgaattttgaagtaacaaattagtaattgaaaaaagatcagttgtaaacttaggcttttcatttgtttaggtgcacttaaagtttgaaattaatgcctatgatccagcaattgtacaacagcttattctatcaggagacccaagctcaggagttgattcaaggagaccaactttggcgtggctggaggactcctctagttgctcagatataccaaaattggaaggagataggtatgtgagtttgttttagtagtatttaatagatgttacatgttttcctaaattttatattctcatagttctaataattaaagaggaggaaaaaaaagttacgcagttaagagatcagagagtaaatgtttggttagaaatctgaaatctgtgattcttgaagaaaaatcttcattcagaaacaccgtagtttataaaatatgcttaactttctatcacaatctatgtcaattggaaataattgccacattgaacaatagatgatgaaaagtcaacattggaaagtctaaataatgaaatgaaattctattgtagtttcaccttctgctaaatcttttcatagagcattcgaactagatgatttcagtttccgttttttcattagcacctcaaattatggcagtgctaatgaataataataatgggatgacctgaggtgaggcaagaggatctaattgtttaaaacagtgtaccagtagtcagcagtgagttgagataccataattattgctatagaaatattttggtaaaattgctgttctggattctccttcactcaacttctctgagagattcctgatttttgtggtggggtgggagagtcaaagtatcaccctctttcacccacttgtttcctaagaaccactgtggttttgactgaactgggctagtaagattctgtaggtggaggggaagaagattgtgtaggcagccatgtgaaatggagctatttaactgtgatcagatgtcttgatagactgagaatatctgccatttcacttccaggggctccttatgttactgacatgtgatgggtgttactctgtagtcagtgatttatcattttacttcacaacccctttggtgggatgtcctttcattaaggaataatgtaaagttttattaatggaaattatttcattaatggaattagtggaaaatttacaatatat

SEQ ID NO: 177 - DNA, 5882 bp, Homo sapiens
acagaaaccttgatacaaaggctaagtcttatagatctgccacatattcacaacctttcattttttcatgttttatttatttacttttttttgagatggaggctcactctatcacccaggctggagtgcaatggcactatctcagctcactgcaacctccacctcccagattcaagcaattctcctgcctcagcctcccaagtagctgggattacaggcatgcaccaccaggccctactaatttttgtatttttagtagagatggggtttcaacattttggccaggctggtctcgaactcctgacctcaggtgatccacgcgtatcggcctcccaaagtgctgccattacaggccaccacgctacaggctacaggcttgttcacaaccttttatgaaaaaagaagaaatacatgaatgtggggggaatgaattgtatcccccctccaaaatgtatatgttgaagccctaaccccacaatgtgactatatttggagacagagcctatgaggagtgaataaaagttaaatgaaatcataaaggtgagatcttattctgataaggctagtacccttacaagaaaaggaagagaccccagagattgctctctcgactctaccctaaagaaaaaagaccacgtgaggacagagtgagaaggcagcctgctacaagccacgaaagaggcctcactaaaaaccaaccctgatgaacccttgatcatgagccttcagcctccagaactgtgagaaaataaattgctgttgtttaagcctcccagtctgtagtattgtattttttgttatgccagcctgaactgactgataagtctcccaaaggtatcaatctaaataaagcctctcaaaacttgcttttctacaaagtcaaattcagaattacaaagcaaataaaaaggtatggccgggcgcggtggctcacgcctttaatcccagcactttgggagaccgaggtgggcggatcacgaggtcgaggtgggcggatcacgaggtcgggagatcgagaccttcctggctaacatggtgaaactccgtctctactaaaaacacaaaaaattagccaggcgtggtggcaggtacctatagtcccagctactcaggaggctgaggcaggagaatggtgtgaacccaggaggcggaggttgcagtgagccgagactgcaccactgcactccagcctgggcgacagagcaagactccatcttaaaaaaaacaaaaaacaaaacaaaacaaaaggtgaccaccctcctttcctggatcagtactctcagccgtttatatattctactttcagcaagtataaattaaactgaccttctatcctgccatgccaaacccctaccccttaaaaattacctcctcctcaaggattttctgaaactaaggatggaataaccatgcaccaatagatcaagcctaaaacttagaagttacagctttccctgtcactcatcccctaaaccccaatggccactgtatccattggtgggctcccggcagtacacacattcacatacacacaccacccgcacacaatgtgtccctcttctgttgacctggaatgcacttgcttaatccacaagattctacacttaaaggccatgtcaggcatttttgcctttccattgtctgagcagatgcttaggaaaggtttatagttgaaagtcaactgctgttcaacattgtttaattttccaaaaaccttcctttatacctcatccccagcaggactcagcatctccctcccccagggctttacctgaacttagttataacatattacaatcatttttctaggtctgcccatcaccttagactgtgaactcttgcaaagcaacagttcagggaaaggcatggagacctcagaatgtactggcatagacacgatatatccaggcattcaagcctatatggggatgggggagggggcagctgaaaccccagtgattgtggtgagggaacaagtttgatctaattccgaaggcttaagttgggagtaggtttgggtatatgagacttcactcctcaaggcctccttcaaagatacacagatgcaactttgccttcggctgcccatgtgttttctgagcttattctacctttaacactaccaagaaagtaagactcaaaaaatccggaattaaagcaccagtctttaatatttattatatacttttttcttttttatttttatcagttttcttttatttccttttttcccctccacctcttcccatctgatatttattatatattttattaatttaagcctcagtttcctcatctgtaaagtgagaagcatgaactaactaaaggatttctaaggtccttcccatttaaatattctccaaggctataaagagagatttttttgcttcactaagctatggcttagaagaggctttccctctgcctctgtcagtgactcaaactgttctatcttgccataaggctgagaaaagacaataaagaaccatttaagatgtccccattgtttatagtactataaagaaatcttttggaaaaacaactactcaccctgggcaaacatcgtgtttcatatgtgaaatacttgtatatagatagctagtctgcctgttaaaataatgctgcctcctgtattaattagggttgtgttacaagaaacagaaaatctgactctgaatagctaagaggctaaaaaaataaaaggggggggacaaatttttgtggctatcataattcaggatatactggctctactgagctgaaaggtgagtcatttccactgaagccacaggtagcaatacaacaggggaaggtgagaaagtacttgtggatgctacaggaagtgacaagtacctccaacagcaattgcttcttccatcttttttcccttttcttcttattacttaaatggattgctttccaaataggttggttcattgccattgttttattctgtaaacgtttaacaaatattctacctgaatcagctaaaaatcacatacccaacatttagattattaaaagttcattctcattttaagattgattttccttctaaatctctctagatttattacagaagcattagagaaatccaaaacttctcatttggttaagctgtcctcctgctaagatgagatgatgttctgtcttttctcaagttgggtctatgcttgtaacttcccaattacttaagttgaaaagaaaagggatcatctgtttctgctgtgatacagagtcaaaataaaaataatttgcccagtaatatactctttgacaaggtctccagccttgcagctgcattttgctctttgtaaggccgttcaaaataacacaagggccacccattggcaggtgaatatctgaaaaatgttagaataattacggggcactcttaacaagtcaatcactcaggcatttttaaatactcttctcaccttatataagaatgcaaggcactgggggaaagtttctttctaacagttctcaagtgtgtaagctggagccagtctatctgggttcaaattgtcaagcagtatacatggccaaacacatccatcatttcgtgccctggcctttccatgtgtaaaaatggggataataacagtacctgacttacaaggctgtttaaggatgaaataaattaaaactggtagagcacttggctgatggtcatcattccagatacttttgtgaaacgttaataatttcttcccaaagatatttcctatcttcttcaatttgtgtttattgagtgatatagtttggatgtttctcccctccaaatctcatgttgaaatgtgattcccagtgttggaggtggggcctggtgggaggtgatcggatcatgggggcagatctttcatgaatgggttagcaccatcctcttggtgatgactgagttctccctcagttagttcacacagatctggttgtttaaaagggtctgggacaaattagccaggcgtggcgccgcatgcctgtagtcccagctacttgggaggctgaggcaggggaatcgcttgaactggggaggtgaaggttgcagtgagccaagatcacagatcgcaccactgcactccagcctggcgacagagcgagagtccgtctcaaaaaaaaaaaaagagtctgggacgttgtccttctctctctcactcccactctcaccatgtgaatgcctgttcgcctttgccttgggacatgagtaaaagcttcctgaggcctcaccagaagccaagcagttgctgaggccatgctttctgtacagcctgcagaaccatgagacaattaaaccactttttttttttaataaatcacccattctcaggtctttctttatagcaatacaagaacagactaatacatggaggaaacatgatattgattttgaaatattatgacgtactcttagatttagggaaaataaaaataagaaagagagatggctagctgggattgttggaagagcttctccatcttttctatgttacaagatcttagacctagattgtctacccaaggatatatgaaatacccaaagcagagtactcaacattctatcttagaatcttagtaacctcatagtctagaagttcataattgagattagcatccatcccaggacatttcaaaatgcaagggcaggttttggcctgtcaaaatgactgaggacgacaccaggatttaccgctcagggactactagggctactaaattctctataactccggtagtcccagccacttgggagtcctgtaaaactccattcttcatggagtttcactgaatgaagaatcatcctgtccaaaatgccagtggtgctccttttaagaaacacaggacctccaatctttcactgttaggtaccctggggtcatgcagccaatgtgaacacatccaaaaaatatgcctcaaaaagcatcacactctactcttgcctagttcaaaatgctaaacagttcttctttatactgagccagtgaatgtttgtcctctggtcttcatcctgcctgctgtggcccacagaatttgtgtggttatgtgaaaaatgaaactttccaatcctcaaaaccaatgtaaagtatttacaaattgctgtgtcaaagttgctgatctaaggagcaccagatgtgtctccaaacagttatttcttggtctctctctctcattcttgctctcactttcactctcccctctctctctggctgttggtctctcaataaaaaggagagtaaagcaccacagctcagagaggctgcatccacattcactctgcagtgaaaagtagcttcccctaatgggatattaagtattttctcaaccagaattctcattggcagccagggctcctgattaaagagtagctctaccatgcctatgaactaactgagtttaacaaacccattacctttaattcgcatgtttaagatctacacaaagcccaaagccgggcgcagtggctcacatggctcacgcctgtaatcccagcactttggggggcccaggcaggcagattgcctgaggtcaagagttcgagactagcctggtcaacatggtgaaaccccatctctactaaaaatactaaaaaaaattagccagtcatggtggcatgtgcctgtaatcccagctactcgggaggctgaggcaggggaattgcttgaaccagggatggggaggttgcagtgagccaagatagcaccagcctgggcagcagagtgagactccatctcaaacaaacaaacaaacaaacaaaaactacacaagtaatgagaaatttcaataatgtaattatggatgagagcaatgtgtcatctttgctgttcaccgtaaaagaaacagaggctaaaaagataccaaatcaaagaacttatccactacgctgg

SEQ ID NO: 178 - DNA, 57192 bp, Homo sapiens
tggtcatacataccaagtgatatccacttaagcatatctttttaattcccttgacaccctcacgctcctctctaaatggggagacacaattaccctattaggcaacatgcccctgaggtcctgctgctccagcaggcctcttctaggtgagcgtcttctctgggtgtcaccagggcatcctggtctgattgaagcagccctgagagccaaccagccctgagcagtggttcccacccatcctccatccagggtccccaatggtggaggcttttaaggaggtaggaatgggactatgaaggctattttcaatattttgaaaagtcaaacaggagtaaaacatttaggacttgaaaagattacattgaccaactgaactatcaagattttagccaggcgtggtggcttgtacctgtagtcctagctacttgggaggctgaggtgggaggatcgcttgaacccgggaggtggaggttgcagtgagccaagattgtaccactgtactccagcctgggagacagagggagaccttgtcttaactaaaacaaaacaaaaataaagattttttttctttttaacctaaattctgttgtctcagaatggaatggcatactgttatctgacctggccagaagctctgattggtagttatgaatccctttgaattattaaaaaaattaggcaaattagtgcatttgctgggtaggagaggtttttcaagatctaatatgtgagagagaaagtgaaaactaaaggaattcttggagatcaggaagtggagaatctctggcctgtggcgctgctgagcctaacttcctggcttcacatcagcagtggaggcttccctgggaggtgttcttgcagtttgccctgtgaccgctattctaggggctgtatttttacagctgacccttctcacttgcaaacataacagctgctatgtgttgaatttggggagtttccatattttgagactgtaaaattaaattgatttttagttctgagctcttagtcttattttctttttcttttctttctttctttttttttttttttttgagacagagtctcaccctgttgcacaggctggaatgcagtggcgtgatcttggctcactgcaacctccgtctcccaggttcaagcgattctcctgcctcagcctcccgagtagcagggactacaggcgcccaccaccacgcccggctattttttgtagttttagtagggatggggtttcgccatgttggccaggctggtctcgaactccttacctcaaatgatctgcccgtctcagcctcagaaagtgctgggattacaggtgtgagccactgcaccgggcctgagctcttagtcttgatccatcttgcttctcagctgtaggggagcagggagggaagggaatgtgaaatatcctaaggtgtgtgttttttaaaattaaatattgttgatcttttatcatggcttctatcagtcaacagatatttattgaccctttgctgagttcatggtgtgggagtcaaagaggtacaagccaggcttttaggaggcagacgcagtatagttggggagataggacaggaaagtcactaggactgcaaggcagtgggtgtgcacgtggtgcagtaagttctgcagggtttcaggaacatcaggagcaagagagagctccagggaagagttaggttttgaggtgcgtcttgaaggttggagctccaagtgcaggagagaaaaagctttccagaagggcctgtggcatgaccacatccaagtctctgatgaagagtaccaagagaggtatagcaactaatgttaattgcgttatctgtgattttcagggcgcttttgtacctgcccttttgatgcccataacaatcttaggaggtgactattatcccattttatggatgaagttgtcaagactgtagctatgctcaggatttatctacatcttgaggtttacagtacacttcataaggctggaatcagagaggaagaagtgcatagggtgatgcagaggcattctgctttatagaacatatctctactttcatattgagcagtttccaaaagcggttttgctttttgtctgtgtccttacaactacttctcagatagcatagtttctttcactgtaccatcctggggccttactgtactttcttactcttaaactggcttctaataaaatccgtgggaatgagattttacttgtagatgaacttgcgactccaatcccaacttaccattgggaaaagagcaggtaagagataagtcctttctttctggcctttactctttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctttactcttaatttccctttacaatttagggaagagttggtccccatttgcttttttttttttttttttttttttttgagacggactttcgctcttgtcgcccaggctggagtgcaatggtgcaatcttggctcactgcaacctttgcctcccgggtttaagctattctcctgcctcagcctcccaagcagctgggattacaggcatctgctaccatgcctggctagtttttgtatttttagtagagatggggttttgccatgctggttaggctggtctcaaactcctgacctcaggtgatccacctgcctcggcctcccaaagtgctgagatataggcatgagccactgtgcctggcccccatttgcttttattcagctatctggtgaaaaaaattcagtattaaactagaaatatttatatcttattgttgcaggacaaagttgttgagtttctaataacaaatatgtaaactgctgtgggatatttttgttttgttataatttgctgctagctttcaagcatctgtgtttatcctaccttaatcctctttgaaagaggccatacttaattttacccaatgctttattaaaaggaaagaaagttggatttttaaattttttatttattaattttttgagatggagtctcactctgttgcccaggctggagcgcagtgacatgatctcagcttactgaaacctctgcctccaggtctaagaaattctctacctcaacctcccgaatagctgggattacaggtgcatgccaccacacccagttaatttttttgtatttttagtagagacaaggtttcagcatcttggccaggctggtcttgcactcgtgacctcatgatccacccacctcggcctccgaaagtgctgggattacaggcgtgagtcaccgcaaccagcctgcattatgttttaaagcaccagtttggaaccaatcttttagaggtaactgttacaagtttctgtacccaaatattggtttatctgtactctgtttcttccttcccctttctcctttttttttttttaattttttttttttttgagacagagtcttgctctgttgcccaggctggagtgcaatggcgtgatctcagctcactgcaacctctgcctcccgggttcaagcaattctcctgcctcagcctcccaagaatctgggactacaggcgcctgccaccacacctggctaattttcatatttttagtagacacaggtttcaccatgttggccaagctggtcttgaactcttgacctcaggtgatccacccaccttggcctcccaaagtgctgggattacaggcgtgagccaccgcgcctggcccaatttttgtatttttttataaagatgaggtttcactatgttgcccaggctggtcttgaactcctggcctcaagccattcacctgcttcgacttcacaaagttctgagattacaggtgtgggccatcacacccagactcttctctttctttcaacggtaacctgtggaaatacaatgttatcatccagtaccatgatcgctaggctgaagtaatagtaagccaagctctcttcagcccttagcagtgtgggcccagaaacagggtggtcttatggaagggagcataggatgtgggtcctgaagagaaggtgttcactcctggccccatcgctagttgcatcacttcatcttgcctggatttcatctgtaaaatgggataatgcctactccacaaagttgatgtgctttgaaatctttaatacaaacatttgttattggaaactaaatacaaacgaaccaaatggaaaactagatttttttcataaaaatgtttcgggatatatatcataggcctttgaacgtaaatatcttgaactttaaacaatcattagccattaaaattttaatgtgtattaaatggatattattagactgtcaaagtgattagcaataggtggtttcattgtagaataacctattttaaagtattttagggccaggtgcgtgggattacatgcctgtaatctcagcactttgggagtctgaggtgggaggattgtgtgagactagaagttgaagaccagcttgggcagcatagtgagactccatctctacaaaaaaaaaaaaaaaaaaaaaaaaaaaaaaaattagccaggtttggtggcacatgcctgtagtcccagctacttgggaggctgagatgggaagattgctagagcccaggagttcgaggctgcattgagctaagattgtgccacttcactccagcctgggccacaaagcaagaccttggctgtacaacaaacaaaacaaaaggaaaaacaactatttgattttagtcagggtgtaagaatatgtattattgttcccaaaaaaatctgtgtaaaaacttcatagtgtgaaacagtggcaactgcttgattaaaacatcatttagaaaagacactcttccctgttttgaaattgactcctcaaaaggacagctgaacatggcctcttctccaggtgtcgccatgcactccctctgggccaccatacacacttctgtgtggggcgtgctcccacctccagcctgctcagctgatcttttgttcagcaatgcctgtctacttccccatgagatccacctggcactcctactagtcttaaaccattatctcccttgaaaaatgagttctggctcactccttactactaaggctgaggggcaaaggagattatataaatgaaagcaccatgcatgtttgaggtggtttccttttcttcgttgttgttttttgagacagggtctcaccttgtcacccaggctggagtgcagtggcacaatcttggctcactgcagcctcaaccttccaagctcaagtgatcctcccaacctcatcctcctgagtagctggggccacaggcatgtgtcactatgtctggctaattttttgtatcttagtagagacagggttttgccatgttgcccaggctggtcttgaactcctgggctcaaatgatccacctgcctcagcctcccaaagtgttgggattacaggcctgagtgggattacaggtctgagtcactgcacctggccgaggaggtttgtattattacttgtgaatggaggaataacttgagctttagaaaagttaaagtgacaaagatcaagaaaatttccccccctgcttttttctcttatattttaatatttccaaatgagctataacatatgcagaaaaaagcttaaaacattttatatagagaacaagtatgaattaaacacccaggtcaaaaaatactctcgttgcccttcacccatctcatattttactttctgaccacaggcctagaagtaactagtaactagaaacagtaaacttttcctgtacaacttcagtctggtatatgggtcttaaacaatataattctatttgcctgactttgaatttttcaaacagaattatgctataatatgtagattctttcgtgtcttgttttgcccaatattgtaaaggttacccatttgctgtgcggctaaagttcattttcgttgctatgtagtgtttcataattggatatattgaaatttctcctctacggtagcatttctagtctcagattataatgaagtgtgctgtttggagcattctggtatatatctcctggggttcatgtgcagcatttctctgggtgtttctcaaccttcttttcattatcactcctcctagggggataatttaatgccaacagtttagaatttaattaatactaaagaatagggtttgtcagatagggctgagctttggagagccactaaacactgtcatatctaagatttcttttgcctgccaaagaccaatttttgctcctttgggggtgatatcaccctctttgtgaaggcatactgtaagttatttatctcatactagaattgttgggtcgtagaaaatatgcctcttctggaccatggacttaaatgtaaaacccaaaactattaaaaccctggaagacatccagacatcctggcccttacttctggacataggaacaggcaaaaatttcatgatgatgccaaaaacaattgcaacaaaagcaaaaattgacaaatgggatctaattaaactaaagagcttctgcacagcaaaagaaactatcagtaaatagataatctacagaatgggagaaaattttctcaaactatgcatctgacaaaggtctaatatccagcactacaaggaatttagacaaatttacaaggaaaaaaccccattaaaaagtgggcaaaggacataaacacacacttctaaaagaagacatacatgtggcgaaaaagcatatgttaaaaagctcatcatcactagtcattagagaaatacaaatcaaaaccacagtgaaatacatctcacaccagtcagaacggctattatgaaaaagtcaaacaatagatgctggcgaggttgtggtgaaaaaggaacgcttatacactattggtggaagtgtaaattagttaaatcgttgtagaaagcagtgtggagattcttcaaagacctataaacagaaataccatttgacccagcaatcccattactgggtatatacccaaaggaatataaatcattctgccataaagacacgtgcacacagatgttcactgcagcactattcacaatagcgaagacatagaatcaacttaaatgcccatcagtggtagactggataaagaaaatgtagtacatatacaccatggaatactatgcagccataaaaaagaagatcatggatggagctggaggcctttatccttacaaactcatcgaggagcagaaaacctaataccatatgttatcacttataagtgggagctgaatcatgagaacacatggacacatgggaacaacacacactagggtctggtggaggatggagggtgggaggaggaagaggatcaggaaaaataactaatgggcaccaggcctaatacctgggtgatgaaataatctgtacgacaagtccccatgtcatgggtttacctatataataagcctgcacatatacccctgaacttacaagtttcaaaaaaagaaaatatgcatcttcaattttattaaatcatgactgttttccaaagcagttcactgacttacatgaataccagtagtatatggtagtttctgtggtcccttatccttgccagaatcttggtactgtcacattttaaaatttttgccaatctgtataacagtatcatattaggcttttactttgcattttcctgatcactgatgatgttaaacgtcttatgtatattacttatttggattcttcttttctgatagtttctctacttcaactccaaaaattttcatatgttatgcttgtgtagcccctgtgaaaagaaagcacagtaggatgacctagttattcacttgaaaagtatgatggagcccagcgacctttgttctaatcccagatgtttgacttggtcagagtcccacacctctggccctcagcatcctcatttgctaaataaaagtattggctgggttagagcagcagttctgaaccttggctgcccatcagaattatctaggatgctttaaaaaaatgtttagaccacatctgcaccagaaagcctgattaaattggattaaaggttactatatccatttcaacattctgtgataacgatagaataagtctttaacacctagatttcatggtttcaatcatcttccttgtctgcaccctgaattaagtatgccagagactctttatttgtaagactataatctacttttgtaaatgcgttatataaaggaggagactccttaatttagtccgtaggggaaacttggcgtcatcattcaaaatactttattgtatctggtttacttttagcactaagaagattttcttacattgatacctactgtgacaaaacacacatccaatgacagtgttaaaatgtcataaatgagcctttaaaagaatgaggcacatgatacatcatggtacttgagcagactgcaagcctgaccagactgaattcatgaattcctgacttttgacttcttcctgtaagatgctaccccactgccagggactcaacctctaaatccagtcaaggggctacttgggcctggaaccaaggcacagtcaaggtgaaccagctatgctccagggggaggtggttgaaatcactggtctcctggactgggccatgagtgatggttattggggctggggaggtatgagagacatcgtgttgtccatctacctctgtgtatcttcaaaggtctctgtaataaaaagttttctgaaatttactgcctgacatcaagtcagtggtgttttttagtgtccgtctgtcacatgtaaccatatcacatgtgatcagtatctgacacttgggtggcaccttgtctttttcagagggcatttacttgcatttactcacttgatcatcatagcagtcattttcagtgaaaaaccttttgtagccatccataccctggttacaagtgatagaaaccaaaagcttgaactctttttagcataaaagagtaatttattggctggacacagtggcttacgcctgtaatcccagcactttgggaggctgaggcgggtggatcatgaggtcaggaattcgagaccagcctggccaacatggtgaaaccccatctctactaaaaatatagaaaaaattagcctggtgtggtggcaggcatctgtaatcccaactactcaggaggctgcaacaggagaatcacttgaacctgggaggtggaggttgcagtgagccgagatcacaccattgcactccagcccgggcaacagtgcaagactccgtctcagggaaaaaaaaaaaaaaagtaatttattgcttaatgaaaccaggtcatgaaatctgggcttcaaggactctagatgggggcatttagtgtcaagaccatcttagtgttcatcagctctgttctttgttggctttattctctctcactaccaacaagttcttttcttccccatatagcaagaaacatggactcgggcagttccaaaatctcattcttacattaagaaatctttcctagtggctccaaaaagaaaatcccagataaggactgtgattggccaggcctgggtcacatgccatctctggacagctggcagtagaaagggaagggctgccatgattggccagcctgggccaggggcaggtcatactgattggcagcctccctcagaactacacggttggagtgatgggggatggtcctcctcaacaaactgatgcagatggatgggtgttgggcatatatgatagaagtccattgtaagttcagtctcctcttagttctattcctgtgtctgttcctgtcccttccaaacaatgctgcttttctatcagcaattcattattaaggagttgagtgaaagtcatgaaattccagtccccagatttgtccccaagcttgactcactctgctttctggatttacccccatcttctcacctaaccacagataccagaaaagaagtctttattcactgaggctttgaaaaaattagctgcacagtcttccttaccaccacctccaaacaaagaactttctctgagattggagcacagtgcctcctcctttctccttgctacacagaagcctcattctaggcttttcctccttccaggctcctccatgctctcctgaggccacctcttggggcggggaaggggagtgctctctctggctgcttctgctcacccagggtggactcaggagctggagcccctgaggtcagcatgaggcttcatctctcagcccagatggccaggctcagtgacagcatctctgcttcaggacatgtgcctttagtctcctccatagtctaaaaacttacttgccgtgctgaaacttgttgataaaaccaaatctgtaatcaggaacataaaccaacacaatacaggccttgcacaaatgagcagttgtggggtatcatgggcccctgtggattatttgactgaagagaatgatggaggcaaagctggttgttgttgaacaaattgctgccagatgtagatttcaataaacaccacactgttgttcccctgcccgaaggtgctatgaatttcttgaggcaacagaggcatcagtaaacggggcagtggggtgggtaagggggtcgctgttccaatatgaatggagcctcctagtgttttctgtccctggatgtttgtccacagaatccaaggcaggccctgggggtctctctcccctgcctgacattttacaccagagtaatatacttaaactgtagcaaccagactctgtggaacctaaaagaaacctggaattagggtaaaaatgtcacacaaagtctgtattgagggttaactgtaagacatgatgaacaaagcacatcatccttcccttcattgaacttacaaatgggagggagatgagtgctaaagcagtaattacaaataaataacagacaagccttcaaacatcctgtgaaggaatgcagcgtgagcttgtaatgcagaggccactgtctctgccttcaccatctgctaactaataagctaggtgggccaaaatatgagcctattagctgggcatgatggctcatgcctgtagtcccagctattcaggaggctggggtgggaggattgcttgagtccagaagtttgaggctgcagtgagctatgattgccactgcactccagcctgggtgatggaacaagaccccatctcttaaaccaacaacaacaaaaaaccctgagatttggggcctgtaaggccccagagtcttcactacccttggtggctgtacttttaagggaatgaaaaggagagagagattgagattgagactgagagggtgagagagagtatgattggttttagttagtatacaaagaagcttctcatgttccatacaatggagtgattctagagagaatgattttcccgacccttcccttgggttatggctcgctaaatcaagcatcagatgaacgcttggcataaatctaacgtgtgtatttggatcaccagagaactatgtggttttctaatcccgttgtcccagttagatgcaaagcttctggaggacaagggccacacctttccccctttgtgccctcaaacactaacaggcgctttgccatagtacttggaaaaatatatattagttgaatgataggacaaaaaagcggttgtagatggaaaacgcattaactgctgagaacacgttttcattttgagttgtctataagagtttaaggggcagggaagccctggagttgaagtaaattcaacagcatcaagttttgtgtttggccctcaataaactagtctctctgtacccctggcagggggtgggaggagtcctgggggagctcccttccaaatcttacagggtggtctgtttcttctttggataataatgatgtaatggctagtctcttgagaacttgctgtgttccatacattgtactaagcatttatttggattatctcattaaatcttcacaatcactttatttaacagatggagaaattaaggcacatggaacctaagtgttcaaggtcatggagccagtaagtgttagagccaagtcgtttggctccagagcctgtgttcttaactactactttgtagtgtctttcttacatattagttgggcctgtgtattgctagttgaattcctcttcccagtggcaggccttcacgtgtttgaccatggttttcatgttctccaaacctcagttctctagatttgtactttggtaggtcatcattttccacagatcctacctctttaggtcagaaaatcttgccagtttataaagattctctgggactaactcccacaaagcaaggtcacaagagatcaatgtacaaatgaagcagttcagtgagttttgtctaccattctccataagtacatgggagacaactgatgattggaaggtttggtgttcacctcatggagctgtgatatctcactcaccacacagatctgctcttctgagggaccatcttgccaatttccagagagttgcagggatattaaatttttgcacattaagcttcctctttccaagctgcacatgggccctgctaccgtttgtgaacagtcttctagagtgatataggttctagctttcttagttaagatcgtattttctgataccactcccttgtcactttgcctgaaatgagaaactcccaacctcaactgcttttctagtctcttccaatgaatgccttccaaagggctggtgtcctccagggtgtattagttgttactaatttcatcctccaaggctgatctgattttcaagatctgtagagagaccttagtatattgccttgcctgtaccaaatacagtcattatggcacaggaaaatctcaaataccttattggaaacccaggacaaatatttatttgaccttaatgaaatgaaaaagacattggatgcatacatttaaagaaaacccaaaactttggaatctttaccaaggagggtatcttttgaaaaggacaggctggaacaagaacttgataaaatagaagtaaaggttgacacttttttttttttttttttgagatctatatcactctgtcacccaggctggagtgtagtggcatgatcttggctcactgaaacctcggcctcctgggtacaagtgattctcatgcctcagcctcctgagtagctggcactataggcatatgccaccatgcccagctaatttttgtatttttagtagagacagggttttaccatgttggctagctggtcctgacctcctggcctcaagtgatccacccgacttggcctcccaaagtgaaagtcggcattactagccctgttcagcacatgagacagggcactggatggtgtctacctaatgattttcaacccaggggcccttggcccaagcgtatcactggtataaagggcctctgccagctaatgtgagggtgagtgtggctgttgtgtccatgagagaactcctgggagttctacactcagcaaacgtttgttgttggactatgaaggcggacacagattttatacgaatttgtaatgctaacatctagcataagaattggcaaccatagaaaatattacgtgtatatatatgtttatagtctcaaaaaaaaaaaaaacaaattaaaaaaaccccaggctgccctgtctctctctatctctctctctatatatatatacgcctttacatacacacacacacacagacacacacacacacagacacacacacacacacatatacatatctcttaaatgagattctatttttgtgaagtgttcagaatagacaatccatagaaacataaaaacagattcatggtcaccagggacttggggggttggggggttgtgggagggaaatagggagagactactaatgggtactgggcttctttttgggataatgagaatgttctggagccaggtgtggtgcctcacatctgtaatcccagtactttgagaggctgaggcaggcagattaccctgaggtcaggcattcaagaccagcctggccaacacagtgaaaccctgtctgtactaaaaatacaaaaactagctgggcatggtggcacatgcctgtaatcccagctacttgggaggctgaggcaggagaatcacttgaacccaggaggtggaggttgcagtgagccatgatcacgccactacaccccagtctgggcgacagagcgagaacctgtctcaaaaaaaaaaaaaaaaaaaaaaaaggaaatgttctggaattagatagtggtgatggtttacacagctgtgaacatattaaaagccattgaactgttaaattggtgaattcatgctacgtgaattatatctcaataaagctgttactttaaaaatgaacaagaaagtaaaacccataaaaaggtcctctaggcacttcagcaaacagcgtggtagggaaaagaccaaggagttcttagccctggaggaatggaaaaccagttaacatggtttattcacccaggcctgagatccataatgaaggccatttttaaagttgagtcaccacaggcttgaagactggttaggattggggaactgagggttagagagtaaagtagaagggatggcacttttcttgataggagataattattgcagatattagtgttaagacctattctttttagtatttttttaaacacaaagtaacacctccatgttaccagcaatatttcacatttcaccagtgttcactaagcacctattgtgtgccagttcctatctgctggaagtgcacgattccgtgggctgtagcgagcacagtagcagtccattgggcccaattactgctgacctgagcaatctgttaaaacccggaaagggtattggaagcagacagtccttcctttcttaccaagcctggagaatctacagctctgtccaccacgcctttagagaggcacacccaaattggaagattgtacagtaaaaagagggaatgtccagttcaatgttgagggggctgagagttctctgggttccccaggtggagaacagacggggggcgtgggccttgccatgtggtctgagcactgaatgtcctgaaagtgtggaaaggcctgtccccaagctttagtaactttttttccacctagaagcaagccaagtagtttcagagtaattctcagggtaatccagagccatcttcatgaaagataatactagaaaactcagagggataaaaggatatgcttgctaagaagattatttcccgccgtggctgtccctgcaagccaacaatagcacacccttcgtcaggatgtaacgagtgagagagaacagctagaaaagggtggagaagtaggcgggaggaagctatttaaaagaccctaaagtgctgcagctgttttggctaatttttctcatctcagtgatgttccaagctctttgtcttctatgtggggcgacatcatttagctctcttatgagtcatccttcccacaaataatctctcttggagtagcccttatgaaaacagacaattcacattgcattgtgtgaattggcaattgtgtgtcccttccctgggtgggccatcctgcgtctgcctgcatccacacatgtaggacttctaaggcctgagcaaaccctcagtgatgggggagtgcaaggggtgggggggacatctggagcctgaagcaggcatggaaagccaccaacagtgtgccctggtcagctgactgctccatcttaaaggtttctggataccgtagttgttacctttcctcacaagggttttatgagaattatctaggaaaaagcagacatcagaggaaattccgtgtaaataaatgtgactgccacttcaaacctcaatcttgctaaactgagcttttctttttagatagtcttttcttctgtctggctagcaggtctgaccagcattttaattaaggcttccctagagagacactgagctctttaagatagaaactagactgggtatctgctggtttttctgcctaggaaaatgtactctaatgggtaccttgatttttacccagagaagcccagggtctcactctcatcccatgtttttctggtggagttgactccgcccttggcccatggttggggcaaggtagttgggaccccaggcaatcagcacatcgtgtttccctggccaaaatgcttgggtcagaaatgggcacatgacccaatcttaaccaatgaggtatgatgaaactttggctaagaggctgcgattagaatttggaatttgacggcatgagtctgggctggggcagccttctagtgattgtgagtggagagccagtttgagtatggagaccacacatggaagagagctgagcctggctgggctgagagagcaagaggatggtcatggtattgttctctaagcccagaaccaggcttccctgaaggtaccattatcccggtctttctgggcatatgaggccacatttcccttttagcttgagtaaataaaggttgagatttctgtcccttgcaaccacaagttctgacttgttcaggggcagcgtttcaatctacctaacatctagcagaatgcctggcaggtagaaggaagctcagtgtgtgtttactgaatagattctcattgagttaaacagatgttcatcaaatgctaatgaggttaatggctaccatattggatgatacagatatagaacacttccatcattacagaaaggtctataggatagcactactatagagaggacaaactcaaaccctgcctcccagaagctctatttttgagggtttttaaaatattatcaaaactagatagcataacatatggaaagatagcctgacttactgatttataaaagttcagctttatttctctcgagtacagttatttacatataaattctaatgaaggagtttaacaacaattactatacagatagagtcacacattatacaaagtaaggtatgcctaaatattcttttacatatgaggaactggaatttactgggcctagaaactaaagcagtgtagaatgccttgttgattttttgcagccttttcatgaagcaagttattgattttaagtagaacttaactacagtagtaaagtcctaaaatttctcacagaacctattccatgtccttacccagtaagactagcacttgccacccagaatgatgacaattctagaataatgtggtttagagtagtcagtttctgcaggtgattcctggacatcccagtgcacctgttctgcttttgctggtccacatttggtggtccactcatacctccttcagagtagggcatctgagcctattctggcctccagcatactcattttgtataaaagccatccctgtgtacaattccttcttccggtgacatccatttttcctaaaagtgatgtgagaacaactgatcgtgagcttgtccatgtattgttccttgttggcctgaaaaccaggagcacttgtaaggctgaatggattctgcccagaccggggctgtcttaacccctcagagttagcccgagctggccacaactacatcttcagcctaatatctttagttctacagttatggatcccaccttaatcaagctgatttactcactgtcccagagcacctctgaccttgggctcacacccttccctactcatcaaccccacagatggttaattacttctcaaaacttacctcaaatacctaacctgtcttatgttctttcaaaccatctaagccagaaattctgtatcccttctttgaaccccgatggcattgtctatattcttgttttgttgtagtagctttatttagatgtaattcatatgccctacaactcactcttcaaaaatatacagttcaataattttttttaatattcagagttgtgtaaccgtcattgtctgtttagaatatttcatcacccccaaaggaaaccctgctaaagagcagtcatctctcagttcccctcacaccaccctctggccccctaaccctgagcgatgactaatctttcgtctcttcggatttgcgtgttctgaacatctcatataaatggaatcctgtaatatatgggctcttgtgactggcatcttccacttaacatgctttcatggttcatgcatgttgtagcattatcagaacttcattcctttttaaggccaagtcatattccattgtaggatctgccacatattgtttatggattcatcagttggtaggcatctggattgtttccacttttttgctgttatgaattatgctgctgtgaacattcgtgtacaagttgttgtatgaagtacacgtttttgttgttttgggtatatgcctaggagtggaattgctgtattgtgtcgtaacttttttgttctattcttttggcaatatgatatattctgatacttaaacccatggtgtttcgcttaacactaatacaccttgcctcccctaggaaatataaacccttgagagctgaaaagaagccttatttctttctactccccccactaccgaccactgtgtctaacaaaagccacaattactgtttggactcaaaaatgtgacggaaagaagtagacacttgtgaagtttttttcctctctttctactttaaccctaaactgtgtcacattttttcgcgttcacactgtatgtgtacccttttctgaaagtgcttgtcctctctgaggccccagtattggaggctactggatgtgtaagtagttggtatacagcacctctcaggtgtgaccattccaagggaggagatcagcttccagcatgtctcctccagacaacaatacacactgtcctcctgctgaacagtcagttgtggagtaataatgcacctctgcaaggctttgcagggtttttactcatgtatcaccaaggatgaaaatggggcaggacacagtagaagccgttaaaaggaaattatgtcttcttgccttttctcccttgatcagaccctaagaaaacagcttacccaaatgagcggaaagatgccaggtttataaaatggagtctagcagctgtctttggttctaccttgggatgaggttagaagtattgtttcccaaactcttgcggcgggaagatctgtactaggtgggactgccggtaaatcactggggaggagaagcagctgctgtgaactgagtggtgtggcaactctggcttttgattccccagcagcagatggcaactttgagtaatgacacacacaagatagaggctgtgcttccttatctgaaatgggaatttcaagtgaaagataactggagtctcttcttggggcataattgatctttcatgagccattatccagggtttttacagtacctacaaaaattgttctgtacccaggagttcaataaacactaaatgtgtgaaagaatttgcattctttgcctccggatcagggggaaacatttccggaacatacattaagaacttcaaattgcatagcatttagtaggcacaaagtgactatactagttaaggggtgacagatcaatttcaatttgtgtgcccctcgcttatgggtgtttggagggttgtgttgggaaggattgctgaggccagttaataaataaattaatacattggttatgtctgtcatgaacacctaagagactgtgcagtggtagcgcttgtgttgaatattttccctagaccttgagctccttgaagggcaaggactgtgtcttagataatataccctcaggaccggacctagtgcattgcctggtatggaggaagtaaccggtaagtatatattggttgaatgaatgatttgatttcctagtttttggaattggcccatgattctaagtgaatgagctcacctcagatgccttaatagtaaatgaaattttgcagcagaaatattttctaaaatacattgatttttatggaactagtgtcttgttttcaaaacagccctctgttttgctacaacaaaacatttcaagagtttcaaatttaaattggctactcaaagccaatttcttcatttttttcctatctcagtggtctagaggggcatcttggtgttttaagtggaacacaggcttagaagtcagacttgggtttttttgttttgttttgttttgatggggtcttgctgtgttgcccaggatggagtgcagcggcaccatctccgctcactgcaagctccgcctcctgggttcacgccattctcctgcctcagcctcctgagtagctgggactacaggcgcccaccaccacgcccggctaattttttgtatttttagtagagactgggtttcaccgtgttagccaggatggtctcaatctcctgacctcgtgatccgcccgcctcggcatcccaaagtgccgggattacaggcatgagccactgcgcctggcctagatttgggttttacttacagccagctcagctattaacacattgtgtgaccatagctagttacttctccatgctggaactcagttccctctaaaaaattggagaactgaagcaaatgagctctgtaattctatgaaaataaacgcacaggataaaaaaagagaacttgtttcaacaagataattctctgtctttggcctagttgaggggtccccaacccccaggccatggaccagtactggtccgaggcctgttaggaacccgatcgcgcagctgtaggtgagcggggcaagcgagcattaacgcctgtgctctgcctcctgtcagatcagcggagcattagattctcataggggcgggaacacaattgtgaactgttcatgcgagggatctgggttgcccgcagcttatgagattctaacacctgatgatctgaggtaggacagtttcattcatcacccccccatctatggaaaaattgtcttcctcaagactggtccctggtgtcagaaaagtttgggactgctggcctaggcgatcacttctctcatttcagcttcactttctgacacaggagcaataatcctaaagtgaggagggggagtcactttaaaaaaaaaaaaaaaacagcaaaaacatcagtcattatggtgaaatgtcaacacagtaagtcttttctaatatctctgcagaatgctacatgagatttgccctgattcatagatggctatggtatgtgtaatacataaaaatataatgtatcatctcagacatatgtcttggctgacattcagcaccaagaatctgacaaatgtttttatatttatgtacattctgcctgatttcaaaaacagatttaagatagctatactcaacatcatagaaataattaattctggacgtctttagaatgagaataaaaacaggagccaagtgtttttttttttttaagtgattatgttaggaaacttaaactctgagagcttccaaaattcaacatgaattgtaacttcatggttcctggaagccagagccaacagggaagtaatgggctgcctagctcttcttgtctgataacagccagagtaatgggctttgtggggaaaaggaaatatactggcacaattctacctcaggcctgttctgatagccttttgtcgaggcaatagccattcgttcataatgaaaccattgaattacaaacaagagtggcaacatagaccaagccttatttgtttgtggggattttactagttgtttggtagactttagccaggccacgtatagtaacagtagatgatgcttaatgtgccagatgctattctaaccgtattaacatattaaaaatccttacaagagccctgtgtgttaggaacagtgctttggggtctgtgctcttatccactgcaccatactgcctcttacatgtctcaaatcgtacagagatttatcttactgcagtcacacagctcagcatcccaactctgggtgatctcaggaaagaacatctcatttaaagcaataataaccagtttaaatgtaggcagcctcagtgctacatgaccaaccagatggatcagctgtttacttattgagtccactggttcttttggcgttgttttaaggtggcttcttgaatgttaaaggaacaatctaggctctatctgaacctccttttgcatctttcattggtgacatgaggagcatacataggccatgtgtcctcttgtccttcggtatcttatctacctttgggctgctaaatatgccaaatcagcttctcttgtgtgccagctcactcagcaggggtggctgcctagaagactgtgttgagaagggctctcaggcctggctcagatgtcgtgagagaaggggtcatgactgagcaacaatgcctgatgtgggcaagggagagggtagcaccagagcgttgcctttgccagccatggcctagttcaagatgagggcttgcctctatgctgcatggcttctgaggttattttccctcagagtacttcccattcaagaggagaacagaatgtagcaattcacagaattcattccataaaaatgaattccctccctgtacaagacacacaataggaagattaataagtcaaaatccctgccccctcccaaatttcatcccagtcaaggacatataaattttgacaaataatatctatacagtgagataatgattattcttataaagtactgagggaacacaaacaaaagagtcactgtctatgcctggtaagggcagacaggtcaggctgcatggagaaggtgccagttgaccctaaccctgattccatccatgtgtatggagcccagagggtgtgtgttttgagaaccacctggtatgaccaacatcctcaatatgtctttgcaaccttccttttcagaatatatacagtaccaccagtagtaagtcatctttttggagtcttgatataatgacacacatgagagaatggatgaatccaatctaccacaatgggtcaatattttagaattttagctgtggcaaagacctttagggaaggcaaagggtggggcagggtttgtggaagccatggatatagggtgtcagtgctgggcaggttgaatagacttttctaaaatgaagtggaaaaataagaaatgcagagacagcctgcactggcattttacccaaggccattctgtgtcccttaggaaatgtgttctttacagggatttgaaaactatagggaatagtgattggggtcagaaatggcatcactggggctaagaaaccaaagataaagtcactttggagctaacctttgtattcagagagctttgtcctaatcctgcttagaatttccacggcgtcttttcttcccttaagagaaatcaaaaggctttcacttttcccctctctgccctgtgaagacaggcattcaaaacctcgttttgcaggttaaggaaattgagttcatggtctaagatcacagtgaattgaacagactcaaaagcaagcatttaatctctctcactctctctcttaaatgtagttcttagaatgagaattcttagtggttttaagaaaatggtaatgtttgtactataattaacccccagaaacagaacatcaaaaccaagacactttggcaatcgtcttatccaatgttctcattttaaagatgtggactctgggccgggcgcagtggctcacacctgtaatcccagcactttgggaggccgaagcgggcggatcacgaggtcaggagattgagaccatcctggctaagacagtgaaaccctatctttactaaaaatacaaaaaaaaaattagctgggcgtggtggcgggcgcctgtagtcccagctactcaggaggctgaggcaggagaatggttatgaacccgggaggcagagcttgcagtgagccgagatcatgccgctgcactccagcctgggtgacagagtgagactctgtctccaaaaaaaaagaaagaaagatgtggactctgaatctaagggacaactccaaataactcgaggatatctggtcattaaaacctactcggctctcaaggtttccatttctaactggaagccattgccttcaagagctgtttaagagcgtctgccacccttctagaactcagtttaaggacttctgctggagccttggaaggttcagggccctctcgtcaccattgctaagggctgttttatgttcttttatgagatagtctgttaggtgcagccacaagaaggagacacaggagaggctcaggaagacaaagtttatcgtggtcacaagtcctagaggcaggagacatggcacaccatgcaggtccacaggggaaagacaccagggcagtcaggaggcagaagacaggagcaaggggaaagcattaaggtaaagccatgatgggggtttccttggaaaagtcaaggcagggcagcgtgaacactttagggttggctagtttgaataatctcaggggccctaagctataggaatggtccctagttgactgtacctggccctgggatgatgaaagcagaggaattttgcctcttcgggtgttgggccagatagaggaggtgtggctctgaattggttagttcgcatgtcagaagtgtactcctggctgggccctttgctggctctaagaattaactatcctctcgccacccccccaggggcagtcttcccagctagaaaggttttttaaaagatgttcaaacatcgtaacatacataaatatgtaacacaagggccctggctcctctcagatatttttatttatttatttatttatttatttatttatttatttatttatttatttatttatttttgagacagagttttgctcttgttgcccaggctggagtgtaatggtgcgatctctgctcactgcaacctctgcctcctgggttcaagcgattcttccacctcagcctcccaaggagctgggatgacaggcatgtgcaatcatgcccagctaattttgaatttttagtagagatggggttttgccatgttgatcaggctggtctcaaactcctgatctcaggtgatctgccctcctccgcctcccaaagtgctgggattacaggcgtgagccaccatgcccggcccctctcagatatttctatccattgtcatactcccactctttccctaactactactgacttcagcttgcagcagaaaattcagcctttgtaagcttgagaggactcaggttgctgaccaaaagcagaagaggcctcccttcaaaatgtatggaatgttgcaaaaagtagacagtgatcctcaataatcagatacttccctcagaatggtctgctaaaccttcagtcttgttgaaccaattggttcagtactttgtaacagaacttgggaatttctccaccctggatgggatatttcttatggcctcccatcccaattcatgtcagcccttcccgcatttagacttggttactttcaactctttactcctggcatcatttttaaatgattcaggactcttggtttcaagtgacataaacccaccttgaattatcataggtggagagtgttggagcattgaacataatggaaagaaaagttagcttttttctacagttctgataggaacaggttctctccctgcagactggcgtcttctgctagacaggaagtgtgactactggcagctccagagcctcataatccatagcttcagttgcctggcatgcactggccctggacttctcacaccccaaactctcatatgtgggcccagctggctctcttgctcattttgggaccagtcaagttagactagagaggcagagtctgtaaaggaacgtggttggtgtgggggaaaaagcagtttccataagaaggtggtggtcccaggaagacaggatggtggcaaaaccaaaggtgtttgtgacaaacctgagagcatatcaggaagaggaatgattaaatcatttaagtgacaagagcaggttgaaaaacaacaggtgtagtatgcttttgtaaaaaaattggccaggcatagtggctcatgcctataatcccagcactttgggaggccaaggcaggcggatcacttgagcccaggagtttgagactagcctgggcaacatggtgaaaccccatctctacaaaaaatacaaaaattggccaggcatggtgttatgcacctgaagtcccagctacttgggagtctgaggtgggaggattgcttgaacccaagaggtcgagactgcagtgagccatgacttgcactactgcgttccagcctgggtgaacgagcaagaccctgtctcaaaattaaaaattaaaaaattatgtattcagtaaatcttttctaattgactttccattaatggaatgtcccagttggttaactccgcaccccctcggtaaagtacggggggaggctgaacattcttagctggcagcctggttcctaggacaccagcacacttctgctcccaccagctgaggcctgggctttccaagagtcattcttgtttcttgccaaacctgggaatgccagatggacttgttgttttaattataccatttaattaaatatcccccaaacgaaagacaaatacagaaagttatttctgtgaaagtcattgcgagtagctagaagcagtggctttttgcagaggggacagggcttttaccttttattgccgaataggttctggagtctgaccccctattttcaaattatagctctactgcttctttgctgtgtgacaccttgggcaagttgcagagtcatcctaggacttggcccctttactataaaatggaaatagcaaccttgtttgggtactgttaggattaagtaatataatgtatttgaagcactttgcacagttcttgggcacatagtaaacactcaacagatgccacatctatcatcatcgtcatcaacaatcacagccttattaaagatgtagagagaagtcattggctgtaaaggaaaaattttttttcttatcaaatcaatctctaaaaacctaaagtgtgtgtgtgtgtgtgtgtgtgtgtaaggacacctccagagagttctagagctgagtgaaaacctggtttattaaaatgagcctgggccgggcacagtggctcacacctgtaatcccagcactttgggaggccgaggcgtgtggatccagatcgagaccatcctggctaacacggtgaaaccccatctctactaaaaattcaaaaattagctgtgcatggtggtgggcacctgtagtcccagctactcgggaggctgaggcaggagaatggcgtgaatccaggaggcaaagcttgcagtgagccaagatcacgccactgcactccagcctgggtgacagagagagactctgtctcaaaaaaaaaaaaaaatgagcctgtaagtctgggtgcacatctgtaatctcaacactttgggaggccgaagtgggatgattgcttgaggctaggagtgtgagaccagcctgggcgtgagtgaaaccccatgtctacaaaaagttagtaaaaaataataataaaaaataaaaattagctgggcgtggtggcacacacctgtagtcctagctacttggagaactgagggggaaggattgcttgaacccaggaggtcgtggctgcagtgagcagtgattgcaccactgcacaccaacctgggcgacagcgagaccctgcttcaaaaaaataaaaataaaaaagcctgtagcccctcttccttccctaatatatttggcttctataaaaattaaaaacccagggataagaagaaggggagagaattggaaagcccctggttagctttaagggcctctcagtgcagcagaacccatgctggctctattcataactttgctctctggatcaatattctgaaagttggtacattcttttcatttgtgtctttcacagagggcagtaaaatttagctctaattatatttagggcatctggattctagtcagcattttctggctccgttttagaacctaaagtctgcggcttattcctaatgtggaaaatggaataatcccccaggcatgagaagaactccagcattgaggctgctgttcctctagcgagaagctgctgcagacatcacaagacttgttatacaaggaaacatgattacagtggattaaagaaacttgccaggggcttgaaggatttattgctttttgaattctgaatgagacataaatatgtttttcccctcttaattttggaccccatacgggtaaggtgagaaaattcttcagcaaattctagaatgcttagctgctaaagatcagttggttttgtgtccacgtcatattgcaaagggcatgaatacttgcttggcagagacacaaaacagtcactcatttctttctgttctgccaagttagttactgccttgtctcccagtgggagaaaaatgtaactccttggggactcttctggaaggcagcatggtgtaatggaaaaagcactgtagtcacaggcacgaggcctagactacagcgtcggtgcttataagttccattatttacaacaggtttcttaaactctgtaagcctttgtgctcttactgctcttttcggaaaaagcagttctcagagggttgtatgaaggattatagcacctttatgttcaatatcatctatagaaactcaactgttggatgcattagcatcagaatgacagcttgtagtacactcatttgtgttcacagatctcagaaatttttatgtcctaaatggagggacttttaaaaataatgatggagctgggcatggtggcacacacctgtaatcccagcactttgggaggccgaggcgggcagatcacctgaggtcaggagtttgagatcagcctgactaacatggtgaaaccccatctctacaaatacaaaaaattaggtgtggtggcgggcgcctgtaatctcagctgctttggaggctgaggcaggagaatcacttgaacccgagaggcagaggttgcagtgagctgacatcatgccattgcacttcagcctgggcaacaagagtgaaaccccatctcagaaaaaaacaaaaacaaacaaaaaaaactgatggcttcttaaccctatcacttctgcagattctttggtttctcaggaagccaaagagatagcatggggcagtggttagtaacaactctggagtcagaccaacctgagtttaaattcactacttattagctgggaagtctttgaacaactcacctaacctgttgttctcattttcctaatccgtaaaatggacataaaatattacctcaaccgtaatttgttttgtttcgttttgttttgagatggagtctccctgtgtcgcccaggctgcagtgcaatggtgcgatctcggcttactgcaacctccgccccccagcttcaagcgattcttctgcctcagcctcccgagtagctggattataggcatccaccatcgtgcctgactaatttttgtatttttagtagaggcggggtttcaccatgttcgccaggctggtcttgaactcctgacctcaggtaatccacctgccttggcctcccagagtgctgggattacaggcgtgagccaatgcgcctggccctatttttttattcctttgtcctgtttcctatgtgggacttatcaccgtttggcattattatttatttgtgttctgtctaccaccccagccccactcaaatataatccccataaaggcaaagacattatatgtcttatttactgctttatatgtcttgcctaacaaagtaactggtacattattgttacttaatatttttacctttgaatttttttgccaaaataatacagaattagaaagaattcctcccccagtgtcatggctaaatttatatacagtagctgacttggaaactgggcagagttgttttgcgtttggaaatactggtgttcttacagttgagtttctatttccaaaagatgcttactcagcctttgatggcacagtttgacttgtgacatcagaaggttgacaggcagaagtctgagtcagaaattcagctatagaagagcgtgactttcatccctgctcgccctttgaggtatggctggacacagctcagaaaggtcttggatttcaatttgtctaggaaggtatttagcaaattatttttaccatttggattttggtaccaatcacccgaggaatctgcagtctctgcgtaagtgaagaatgagaatggaaggggtaagtggagctagtgggagagcacaggccagcccgccacttccctggaagaactgatggctttttccaaggcctggatcatgcctcgcctatcctcctccccactccatgtccccagtccatcctctgacttttatttacttaccaccttggaagtcataagattctgaagttttccacagctgctgggacttaggcactgggccactgaggacaagctgacaggtcagtgtttgggctctggatttcacatcattcattagccctctcgatccccacagagagggacgttcatgctatgaactgtgtcatggagaaaacacagccctagaaagaggaactcttgatcccccactacttcattctttcaagccctgtgacctgttcctctaaatgcctgtgggaccacaggtgggcttgggatggggatgcttcctgaatgcccagggactgtacgcaaaatgttacgtgtgtgtattatgggcagccagggaggctcggtttcatcagactctcaacagataccatctttggtctaaaatagatttggaaccatgaccctgagtggacctaatgtatttttgtaatgtttgtagactgcacatttgcccctctggccctccaggctgtgtgtgggcagattgaggatggaaaagctgaagcggtgcacagctgcccaatcttgttgggttgttgcatgatggctctctcatctcttcttgagtttgcttatttacacaattaagctaggcccattgtgaatcaagtcctgacctgtcaacagaagatgagatggttgaagagggtagcaggcaattctgtgaacaaaatatagctatagatctggctttaagagtaaaataaggccgggtgcagtggctcatgcctgtaatcccagcactttgggaggccgaggcaggtggatcacctaaggtcgggagttcaagaccagcctgaccaacatggagaaaccccatctctactaagaatacaaaattagccaggcgtagtggcgcatgcctgtgatcccagctacttggggggctgaggcaggataattgcttgaacccgggaggtggaggttgcggtgagctgagatcgtgccactgcactccggcctgggcaacaagagcaaaactccacctcaaaaaaaaaaaagtaaaataaaatcatgccaccaacaaacctacctattagtccactgattttctttcctctgtgacaaaatgttcatctccatactcttaaaggagtgatgatacacttggcctttcacctgaggaagtataggatgggagctgcatgtcccagctcaggagtattgacgttcctcttctcagttagccctgtccactgcagcccagctaatgtcttacaggctattagagatggtgtactggggccaagcatggtggctcctgtctgtaatcctagcactttgggaggctgaggcggggtagatcatttgagttcaggagtttgagaacagcctgaacaacatggtgaaatcccatctccactaaaaataccaaaaaaagtagccaggcatggtggcatgtacctgtaatcccagctacttggaaggctgaggcaggagaatctcttgaacctgggaggcggaggttgcagtgagtgagattgtgccattgctctccagcctgggtgacggaacgagactccatctcaaaaaaaaaaaaaaaaaaaaagagagagagagatggtgtactgggctgtgcgtgcttcagctacccaacaaagcacctctaccttgtgcttacaacgaaattcagttaactgtaagatctggaaatccctggcaagtgaaaagctgctgcctggtgtgagtatgtctttgttttctagcagtgcaaattacttcatcttcagcaggagtgtggcacctctgtagtcacacatcacttaacgatggggatgcattgttaggcgattacatcagttgtcatagaatgtccttacacacccttaggtggcatagcctgctacatacttaggctatatggtccagcctattgctgctatggtggaaacctggatggcttgtgagtgtactgaacactgtgggcaactggaaaacaatagtaaggatttgagtatggaaacatagaaaaggtaccacacaaatgtggattttgtaatcttatggggccaccctcatatgtgcagtccattgttgaccgaaacgtcattatgtggtgtgtcactgcttactgagtgctgataacatgccaggctatgtgcagggtgctctacaaaatctatcatgtttcatcctgtccttttcctgaagtaaatgtcagcattcccattttacagatggggaagttgaggctcagaggtgtgtcagtgaacaggtctaagaaaatgtgtgggctgacataatgtgagggccacaggggccaccagaggacatggagtagaggccttccctgaagggcctcgggaactgagccgagccaggagaggagatgggatttaggctgaggagagaacacttgggaggagctcggactccaagtctgaggaaggcaccggcatttattactttcttgccgtattactctcgttcagtctttctcctttgaggtgcagatagtccccttctccagaattattctccagtcatctgcatgggatttgttttcagtgttttttgaattagaactgtagacacttccctcctagcctggcttttctccatcaaactccccatagccatttctcattgactagagcaggccctagcgagcccagcccttagtctctgtcccctccaggctaccctccatggtagcaaccaggcggcccttttggaaacacacatatgaatatgttactcagggacttccaaaggctggctagcctttgcttcagaatgagatcagctcttcagcatggcagcggcagacagctcctaccgctggccccagcttcctctcaagctggccctggcgctctggactcctcacacttctgcctggcaaacacctacttggtcttcaagccttcattcttcatagaggctacttgggttctgccccacacctgtcacctgaattgtcattatgtgtgagctccttgagaaaaaatatatgacttggtcatctttataccctcagtacctagcataacacctggcatgtagtcagcacttagtaaaaacatttaaaaaatttttactgtctccattttgcagatgaaaataagaaactttaaatgaataaaatgtttgactcttggggtcaaggccataataattagaaagtctcctttcactgtgtgttgtctcatttatattccccaggtgatggtcaaatggtataagaaatgcaggtggctccccagtctcggtgtctcacatattccaactctttttttttttagaactcagaaaagtacttcatagattggctttttagatttcttttttttttttttttgaaatgtagtctctatcgcccaggctggagtgcagtggtacagtctcagctcactgcaacctctgcctcaggttcaagcgattctcctgcctcagcctcctgagtagctgggattataggcgtgtgtcaccatgcacagctagtttttgtatttttagtagagatggggtttcaccatgctggccaggctggtcttgaactcctgacttcaagtgacctgtccacttggcctcccaaagtgctgggattacaggcgtgagccaccacacctagcctttttcagataatttcttcaagattaaactctacaaaattattatattagtctcttttgtttggaggttagactctcacacagatttaagcaaacatgagaatgtatttgttcttaaacctgaaaaattcatggagagttctaatgtaacctccactagatccaagtttttaaaaatgtcaatagcaaactttccatctccccctcttgcctgggttttccctgtatcgcttcatttttaggcaggctcttgcctcctgctagcaagatggcaattggtagctccaggcttacgtccccaagcttagtgactcctgtggaaggagagcgttgttcccaatggcactagctaatgtcctgcttgactcatccaccagtgaccctgtcactatggtagaggaagggggaactgtaactctttttggtcggatctgggatatattcttatctctagggttaggggtggaatagtcccacctaagtcacataatctgagagccagggagaaattggtgaaaaattagaaaaccggtgagtttatcaaagggctgagcaagcagagcaacagatgtccactgtggttatcttacctttcttttttgttgctaatacgtctgttatttcctagaatggtatgatagaccccaagcaggtggcttgtgtcgtccttttttggtaaatgcctacctcccaggacttttgaaaatggttcaactgctgtctttgacttttttaccccagcctttgtgattggtctgatagctccagtgtttgtgctggagacttggaatgccaaatgcgctgatttgcacaccgtttttcatgaaatcttatttttcttgataagatcagggaatccttaaaattcccagtggttttgagctagaatcctattgtgagttctctgatattacatagatttaaagcaaatgcatttttcaggagcatactttcctttcactttttttttgtaactaatcaatgatttctgacattcagtgactgcttgcttctgctattaggtgactttctgatattcagccctgactgccacttgtccctctgacctagccataaaatactaatatttgcagctccctcttatatggtgaggaataataaaacattatagcactttgggctttgtttcatttcttcccattgatagcttttttcctgccactgtcagcatagctatttcccagcatgtttttccctccagttctgcagccacatagtattttctgactgctatcacctacccaggaagaaaattgtcacttactgagtacctgttttctgttaagtataccaacaggactttcctgcaaatcatcccatttatttttcatagcatccctttgtgggatggatatcattatccccacttaaaaagatgtggaaagtaaggctaaagggaggataaataatttgccaaatgttttagaacggatggaaaaactcgggattcagttctgagtctactaaccctgaaaggccgttctccaagaataaggctagaagctttaagatactggaaaagtatgagaccccatttctgacctaaaggcaaggatcaagactaacacatttgaaacaatgagagtgaatttaagatagagtcacttctgagtgctgtgtgatatcatctatttgcagtgctgttgaaattcagaaaacagttctgcctccagattctatttatctttgaacctgactgggaatatatattaatattaaatcaagactttatttttaaatgtaaccctagtgccagtttcataatataccaattcactatttggttactgtgctgtgctcagacttctgttgaaccccaaaacatcagcgagccctcaatttctgtgcatacgttcaaacctcaggtcccctgctttgtagatcccgtgaactccctgataagcacaggtcacatttaccaactcttcattatacatctgatttggcaagacagtggccaggggaaggtgttaatctgtgcccaggttatatgccacttagttgagttcagttcagacttaccaagtgtgtagtaagccaagtgccaccacctggcaggtgatttgcagggctcactgggggatacgacatattcatccagtgtcttctgaatgctcagcactcttctaagcactggggacagtggcaagacagacaaggcagggcctctgttttcatggagcctacttttctagttctataaataaatgaaaaaagtcactttcagctagtgatgagcacagtgattaaaataaaacagaggctggtgcggtgtttcacacctgtaatcccagcaccttgagaggcccgaggtaggtggaccacttgaagtcaggagttcgagaccagcctgggcaacatggtgagactctggctctacaaaaaatacaaaaattagctgggcatggtggtgtgcgcctgtggtcccagctactctggaggctgaagtagaaggctcatctgagcacaggacttggaggttgcagtgagccaagatcataccactatactccaacctgggtgacagagtaagcccctatctccccatctcaaaaaaagaaagaaagaaaacagagtgtttggatgaattggtgtggagggtgggagtcgagaatagatgtcaggagttaatataaactggcaggttgtcagtaaaggtccctcagagtaagtggcttctgagctgagcccggaatgcaaagaaaggagccagacatgtgaggagctgagatgaccctcgtctaggcggagggaacatcccatgtgaaggcctaagcagggaataagcatgctcagtctaaggatggggtgggagtggggggccggagccagtatggcagcagtgcagtgaattagtggggagtggtaggaagtgaggttggcaatagagggagcacgtgacacgggctcttgcaggctgtgagacctagcttatgttgtgtttgaagcaggagagtaacaggagtgacttaacttttttttttttttaaatcctggccactgtgtggggaatggattgggttatagaggagtagaaataagaaggtttggggtgaatgctgggcaaggtagattatattgttattgttattgacatcatagaccaggccagggaatttggatttgctcctaaagctaatgatgtgtaacaataatagctcccatctcttgaatacctactgtgttccagtcatgcgggtttatgtgcattccctcctcaagtccttatacacacccacaaagcccctatccactgggcttattattaatgtcacttcttataaaggaggaatctgaggtggacagagcctaggttctgagcattccttagtgaggaaagggaaccagagctgcatgatgggcagggggctggcgagatgcgtcaggattcacatggcaggacctggagtttggcagggactttgaggtgcaaaagagaagacccctgttgggagcacacatcccagggcggcctgcatgtaaactgctgggaaaagggctgcgggggaggcttagataaaacagacgcggatgctaccctctgcagtctgcagatcagcaggtgatcaggtagacctctcacccaaagcagaacatggcaagctcctgaaggagaatttgttgatactgttaacttagcatgtcagaaaaatgtcccagtgtcagaattgaattcctatacctgctaggtcagttttaagctaaaatgatcttgcaaaacctgttgacccattgataccctgtaccctaagtaggcagttggtattatttcttaactttggttcgtctatgtccatctctctgtctctgagacacacacacacacacacacacacacacacacacacacaccccctcccagagtccgagcattctagagtttcctaacagtgcagttgtcctgtctgaaatgtttacattggggaaaaaatgaacccctgctgtgattttatttccccacaggctctaggggtcttttcatagccgcaaggcatcatcacagcttcccaaggactagggtgtttatgtgtgcacagaaaccacactgcaaagggtcaggtcctctcctttgtaccctaaggtgtagagaaagctggacctcaaaactgatgtcacctgtaagaacagtttttgctttggttctggctttttcttttccttcttccttgagagggcttactatgttgctgttagttttctcccagcattcattcactctagcaaaatctggctacatatcagtttgtagaaaatgggcacaattctaggaatagctgtcctaatgtgttagctcaatgccgtggatgcgtcaacaatggctggtagctgccaccagttgacctgaactttatgtggtttttctttttttttttttttggtttttccttagatgagaactactgtttgctagagctgagataaaaccatttcaattagaaccttgtatcagaatataattactcctcccagagatagagtcctggcctgaaaagtgagtacaaaaaataaatagggacaaatagaaggagaatgattactggtacaaggtagatggaatggtaactcactttattctcaatgatgttatacaaatcaaataaaactctattcccatttattttattttagccgagtattcttgtccaaaatgaaaatcagatgtttttcttctttttcatttttttccaaagcaaatggttacaaacacttacttaatataatttactggagcttttttctgaaagaacatttatgttaactttcttttatgcatgtagtaacttttgatcaaaacatgactccactcccttgtttaatgttgagcatctggattaaaggcttcttttaatcttaaatacagattatggccctctttccctttaagcaaactgccataaaaccctggcacctttccagttttccttattaaagccctctttattacagtgttttccgatggcagtcattaaatgattgttatgcacaatgggcacttgattataattatttaactggcaatcagttattgcagcaatttggtggtgtaattaaaagggagcatgtttgtacctgccagcatctttgagatcttcggctctggatgaagcaggagaggcagaacataaacaaatggacggaagaatcaagcacttctgtgaatggaatcttttattcctcgcccatctgattcttggctgctttgttccataaggtagatgaacaatgatgataaaataaaatgtaaataagaatttttgtgctacaaactcctgaatcgataaatacgttcagtaatgaatgtaagtttctccatgtgctgtgaaatgctaaatggatagaagtgtatttatataattctatttcttttaaacacaagcatcagcatgttttctccctctaatttataaatgtcagcacttatttcttgatatataaattgatacaggatgccacaaacaaaaagttgccgcaaaagataagggcgtttgttagacacagctggaaagctttttagtcactatagaagttagcaggaatgtgattccaaagttaagatggccctcctgagttattcagaactctttcagttgtaagttgcaaattttaaccaacctgaacaagggggaatttttttgcttatgtagttggaatgttactggaactactcataggattacaggaagaactgcaggaaccaggactcagggctaggaactgggaatcagtacagcctagacgcattctctgtccatgtctcagctgagcttgcctgtgtttggcttcattctgagaatagtcttacagcttatttctccctgtggcaggaaacaggcctgatatcagtagccccagactcccatcttcttagcttaactccagtggaaagcagtctctatcttctacctttcataagtcagtctcgggaaaggattctgattgcccctacttggctcatatacccatccctggactaattcctgttgccgagtaaatagcacagtatgattatcctgcctggatcccatgtaatacctgtgggtagggcaaggaagttggagtcctgtgaccgacagtcttgttagagacattattagtatgaccccatcggtggtagctaatgactgagaaaaacatggtgattattttcaaaaatgagtatgaaaatctaaagtatccaaacttaaaaaaaattatttaaatgttttcccagaatgaatctctatctctcttttagaaacatcccattttgtaagaccaaggtatgaaagtattcatctgagtttcaaatgattgcctaatcttacctgtaatcattattgagaaccaaacacccattaatggtgtggtctaaggacaaggtcctgaagagatgagactggcgcatattaaagatgcctgctatgatgatgtggctgtcatggctacattatcatgagggatttggaatctggggttccagagagcacgtttttagccactatctctgactattaaatcacttacaacagctttggataataaaattctctgtttctctcttggtttggttccatattagaatctgcaagtgcaaaggcaaaacagtcagcaaaacagcagacttaaatagaaaaaagccccaaaaggaaaggaaaacaattgaaaatttaaaagaaaaacacccccacccccaaacatgatctaatcagtcttccttatggagaagttatgaatcatcctacttagcaaataagacaattgaatgtgcaagcccaaacttgaattaaagttattctcaacttcctgtttctcttattaacatgcatttattatttaataagtatttatgtatataattgagatatttaagctctgggtaacttaagtggctgtagagtactacctgaacacacaaggagaaataaactttgaatatgtgcctgtatatttacaacacacacacacacacacacacacacacacacacacacacacacacacacaattttttactttgtggatactggccaccacttgaagagtttcttgggaatctaatcttctcaatggcaggctccagcattgcctttgccagtagtttagttcatatggacttgatgccaattttcttttcacatatatgaaataacagtttggcacatagtaaataaaacagtgattccacagagaagactggcacctttcaaaaagtgaattgggcaggttcagagctaattttttctttaggtgaactgagtttaaattaaatgttgcaagagattaccatatttgtgtgaatttcaagaagtcaaaggccgtggcaataaagtattttcattttatagagtttttcttggaaaggccacacaccatatgacagcagagtgcttaaaacccagagcctggtgccagcacaaaatccaaacatcgtaaagttacttccaaagcccagatattgaccgatcccctctcttggagcagtgcatctttcaactagtccaagtccaccagcccagaatcaccctcccagcctcagatttcaagttggaagcccaaagtaaggcatgttttctaaaaaggaaaggaaaagctattggatagcaattgtcaagagtcaaaaaataaataaataaaaataagaataaaataaaatcatccccaatggaggagctttagcaaaagaaaagggagacatgccattggtcactgctgcatgtatgcattgtccctcggttggtttttaataaacccagctaacctccctccaccaaattgcctgtatctctccttctccacttagggctgtgtaccattactagaatatgaaatagtgatttgaaggggtcatttgttcaggttttccaggcttctgcactgcctgccctggaatcaattttttttttttttttgagatggagtctccctctgtcgcccaggctggagtgcagtggcacaatctcggcttactgcaagtcccgtctctggggttcacgacattctcctgcctcagcctcccaagtagctgggactacaggtgcccgccaccatgctcagctaattttttttttgtatttttagtagagacggggtttcactgtgttagccagcatggtctcgatctcctgacctcgagatccacctgccttggcctcccaaagtgctgggattacaggcatgagccaccgcacccggcctggaatcaatttttaaaacctgtctgggtgtgggtggcttatgcctgtaatgccagcactttgggaggctgaggtgggaagatcgcttgaggccagaaggagttcaagaccagctgggcaacacagcaagaccctgtctctacaaaaacatttaagattggctgggcgtggttgtgcatgcctatagtcccaggtatttgggaggctgaggtgggaggattgcttgagagcattattgggagggggtgcgatggtttgcggcagggggccgaggctgtagtgagccatgatcacatgactgccctccagcctgggcaacaaagtatgagaccctgtttcaagaaacagacaaaaaaaccttacaatctgtgctcactggtttcctcgacttcacctaaagggtatctgggaaggttctgcctcccctctgggctgggaatgtatgcagaagacttctttgaaagctttgctcacaaggacttgaaacccaggcttctcagtgaatttccataacaattcactgccaagtcacacaaatctgtcaaggaaggctttcctgggagagcgaggagggcctatccactgggtgacagctcggcaagtagcctccagtcctggccggctgggcctctcttcttcccagtccagcattagacttcactaccacctgctaatacatctgaggagagcaagaggtcctggtcacagcagatgatcagagttggtgccaggagtgtaaacaagtcataaattactcttaattcttctaggcaagggatactattagtcttcagttgtggaaaaaatgtactccctttaatgtcttatttatgtaatagttgatcctcttgtatgactataaatttgttttcttcggcaagcatttcccaagcatgtgctttgtgcagagcactgtgtaagcacctactgttgagaacaaatataggagttagggtttaaccggtacaaggtttcagctgggggcagataagaagttctgagatggatggtggtgacggttgcacaacagtgtgaatgcacttaacgctactgaactgtgcagttaaaaatggttataattgtaggttttgttagatatattttacgatgataaaaaaatttagggttcttacacttttttaaagtcaaggtgaactatgtatttgctgtaagttttaagtttcacatatttcccctagcaaaatgtaagtgtatgtgacttaccacaaagacctagaatttcacatttcttatattttacgtgcaggtgctgaggtcattatttctcagatttgtcctgttatgagaatattacctaagatcttatctaagttaacaaattattatcctttgcatcagaaataagagcaggatctcctctaatgaattgtataacctttcctgggttgggccttggacttaatgtcagcaccaccacagtgccaagaatgacgagagctttgttgagcttggagcacagggcttcagctcctatcttgagacttggtgaagtggataaagccctgagctttaggctctggttcctgcctctgcctttgagtaggggtgtggctgtgcaccagtcatttaatctttgtggaccgcagtttatttatctgtaagatgggagtgaaggccaaaggcctttggcctggcaagagttgtcaggcccaaacacgggaatgtttgtgagagcacttagtgctatgctggggacctagcaggtggtaagtcagtgtcatgccccttgcccttgaggctcctcctgtgacaaagggctgtaatgaaatggggcttcaaggagcccttaattctccacgtgtgggagctcatgagcggtcctaagaatcctcttctctctctcctgatgccccggttccttctctcatcactgctttctgtgctccgctctgtcccgcttccttccaactggaaagttcatgagagaagtatattgatgttctgtgagaaggggaatggctctccctgagcccttggctgggcgccacagcagctgtggaaacacaacagcgctcagcatctcctggtgtttgggctccgagctctttcaagaaacaccccatgtcctcaccatcttactcttcagacccaccacctttcccttaggttggaatctcttcccttggcttcttctgacctcttgtccctcagtctgtagccagcagcaaagaaagatgcttattactaccgtatctttttggtgggtactttggcctgctgactccttcagtagaatggaaagttgtatctgggggctgtcacccttcccttcctccttgtaggtccccctgctccacctgggtctagggtacagttgggccttactgagagctagaattccatttgttgaaagactagagtactttgataggtggtgtaattgatcagcctccccgaatttatagtatccttgtatatcttataaacatctgagtgatagagagctgacctcttccatactagcaccatgatttataggggatatctagtgccaggctactaatccagtgcttttcaacccttttattatcatttttgtacctttttttttttgaggtttatatcatttgtatacaattaagtgcatatatcttaagtatacatctcactgaatttttgttatctatatacctatgtaaataccacccagattgggagatagaacatttccaggacttgagaagcccccccttgagccccttacagtcagtacccctaatgataactacaattctgacctctatcaccctagttacttgggattctcaacgtttttccacctatacccacctctaagtcccacctctcctatttaatatgtaagaatgcaaaattatcagctattgtggcaaaaagaaaccaaagtagtggtaaatttagaaatcccttttctgctctccttgcccctcacattttaataagcattctccccgtccccctgcccctaacccaggtcatggagaggtaaagtgatatccccatcctctctggtcagtcttggcatcacagaagcttgacgagaagagaaacagacaccagggcagcttcatcctattttccagctgcccaaaatcaccatatagtctttctaagaagaatcagactgtggttcttagaattgtcagatatccactgagctcccaacacgcacagatcttgctttcctttttctgtcaaagtaggattatctttcccttgattatgtttgagttttcttgggggtagggaatacatttgaagaggagtaaccactgcactccccttccgatgtgcgaatgtcaagcatgttgaattgtcagtggcaaggaatgtgatgagcaggttattttacaggaggtacacagaaagcccccattttggcttcttctgccatattcaaatccttgtatatagaagtggagcttaatctgtttatcctagagtaaaaatatctacaagacactattattatattgacactggagccaaataggaaatcggaggactcacagatgttatctgctttaatgcagtgggttttgtacacaatgaccctgcagccaatcaggatggactctacggtagaatttaaagaacatcttattggcacaatgtttattccttgggcttcgtaggctacattgtgttcccagcattctgagggcaagaaagatggagagagagaaaatgaacctagcaagaaagtattgggataaattccatcattaccctaaaaatataattatagcactctttgatatagggtagaatttggtataatttgacaattacttatgggcatgtattatatgggtagtattgcacaaaggatagtttgcagcctaagaggaaggtgataggccaaaacggttaagtcttcaggctgggcacagtggctcacacctgtaatcccagcaatttgggaggccgaggcaggtgaatcactggaggccaggaattcgagaccagcctggccaatacagtagaaccccgtgtctaccaaaaacacaaaaatcagccaggtatggtggcgtgcacctgtaatcccagctcctcaggaggctgaggcaggagaattacttgaacccaggaggcggaggctgcagtgagccaaaatcatgccactgtactctagcccggatgacaggagactccgtctcaaaaaatgaaaaaacaaacaaacaaaaaaaccacaaaaacgacaaacccaaaagggttaagtcttcaaagctgtctttttcagcattttaatccataatttaggacaaaattggcacatctagcagattcttggtgatccaggatattttctttttcttttattttattattattatactttaagttttagggtacatgtgcacaatgtgcaggttagttacatatgtatacatgtgccatgctggtgtgctgcacccattaactcatcattcagcattaggtatatctcctaaagctatccctcccctgaccccacgacagtccccagagtgtgatgttccccttcctgtgtccatgtgttgtcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcgttgttggacagttgggttggttccaagtctttgctgttgtgaatagtgccgcaataaacatacgtgtgcatgtgtctttatagcagcatgatttatagtcctttgggtatatacccagtaatgggatggctgggtcaaatggtatttctagttctaggtccctgaggaatcaccacactgacttccacaagggttgaactagtttgcagccccaccaccagtgtaaaagtgttcctatttctccacatcctctccagcacctgttgtttcctgactttttaatgattgccattctaactggtgtgagatatctcattgtggttttgatttgcatttctctgatagccagtgatgttgagcattttttcatgtgttttttggctgcataaatgtcgtcttttgagaagtgtctgttcatattcttcgcccacttttcgatggggttgtttgtttttttcttgtaaatttgtttgagttcattgtagattctggacattagcccttcgtcagatgagtaggttgtgaaaattttctcccattttgtgggttgcctgttcactctgatggtagtttcttttgctgtgcagaagctctttagtttaattagatcccatttgtctattttggcttttgttgacattgcttttggtgttttagacatgaagttcttgcacatgcctatgtcctgaatggtaatgcctaggttttcttctagggtttttatggttttaggtctaacatttaagtctttaatccatcttgaattaatttttgtataaggtgtaagcaagggatccagtttcagctttctacgtatggctagccagttttcccagcaccatttattaaatagggaatcctttccccattgcttgcttttctcagtttcgtcaaagatcagatagttgtagatatgcgacgttatttctgagggctctgttctgttccattgatctatatctctgttttggtaccagtaccatgctgttttggttactgtagccttgtagtatagtttgaagtcaggtagcgtgatgcctccagctttgctcttttggcttaggattgacttggtgatgcgggctcttttttggttccatatgaacttttaagtagttttttccaattctgtgaagaaggtccttggtagcttgatggggatggcattgaatctataaattaccttgggcagtatggccattttcatgatattgattcttcctacccatgaggatggaatgttcttccatttgtttgtgtcctcttttatttcatgagcagtggtttgtatttctccttgaagaggtccttcacttcccttgtaagttggattcctaggtattttattctctttgaagcaattgtgaatgggagttcactcatgatttggctgtttgtctgttattgctgtataagaatgcttgtgatttttgcacattgattttgtatactgagactttgctgaagttgcttatcagcataaggagattttgggctgagacaatggggatttctagatatacaaccatgtcatctgcaaacagggacaatttgacttcctcttttcctaattgaataccctttatttccttctcctgcctaattaccctggccagaacttccaacactatgttgaataggagtggtgagagagggcatccctgtcttgtgccagttttcaaagggaatgcttccagtttttgcccattcagtatgatattggctgtgggtctgtcatagatagctcttattattttgagatatgtcccatcagtacctaatttattgagagtttttagtatgaagggttgttgaattttgtcaaaggccttttttgcatctattgagataatcatgtggtttttgtctttggttctgttttttttttttttttttttaatttatttttttattgataattcttgggtgtttctcacagagggggatttggcagggtcatgggacaatagtggagggaaggtcagcagataaacaagtgaacaaaggtctttggttttcctaggcagaggaccctgcggccttccgcagtgtttgtgtccctgattacttgagatgagggattggtgatgactcttaacgagcatgctgccttcaagcatctgtttaacaaagcacatcttgcaccgcccttaatccatttaaccctgagtgggcacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcatacctcccagacggggtggtggccgggcagaggggctcctcacttcccagtaggggcggccgggcagaggcgcccctcacctcccggacggggcggctggccgggcggggggctgaccccccaacctccctcccggacagggcggctggccgggcagaggggctcctcacttcccagtaggggcggccgggcagaggcgcccctcacctcccagacggggcggctggccgggcggggggctgacccccccacctccctcccggacggcacggctggccaggcgggggtctgacccccccacctccctcccggatggcacggctggccaggcggggggctgacccccccacctccctcccgggatggggcggctggccgggcggggggctgacccccccccagctccctcccggacggggtggctgccgggcggagacgctccttacttcccagatggggtggctgccgggtggagaggctcctcacttctcagacggggcagcctgccgggcggaggggcatcctcacttctcagacggggtggttgccaggcagagggtctcctcacttctcaagacggggcagccgggcagagacgctcctcacctcccagacggggtctcggccgggcagaggcgctcctcacatcccagatggggcggcggggcagaggtgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgctccttgccctcgggccccgcggggtccgtccgctcctccagccgctgcctcccgggcggcactcgccggcgcggcggcaaagactgagacagctccgctgcccgctgaactccatcctcccggcggtcgggcagcggcggctgcggtcggtcgcggcagcggctccgcttcatatctgcagctggggcccgcgggtgtcagcgccgcgactgtcccggctccgcactgccccgggccgcagcgcagcggcgccaaccaccacccgcggccaccatggccggacgggctccctaagccaccgaccccagcccgcgggccttcgagccttctggggcctccggcgccgtgacctcctctcaagatgtgaatgattcttctggttctgtttatatgctaggttacatttattgatttgcatatattgaaccagccttgcatcccagggatgaagcccacttgatcatggtggataggctttttgatgtgctgctggattcggtttgccagtattttattgaggatttttgcatcaatgttcatcaaggatattggtctaaaattctcttttttggttgtgtctctgccaggctttggtatcaggatgatgctggcctcataaaatgaattagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcagaaattcaacttcttcctggtttagtcttgggagggtgtatgtgtcgaggaatttatccatttcttctagattttcccagctgtatgctgggagaaccactgctctcttcaaagctgtcagacagggacatttaagtctgcagaggttactgctgtctttttgcgtagaggtgtttgtagtattctctgatggtattttgtatttctgtgggattggtggtgatatcccctttatcattttttattgcgtctatttgattcttctctcttttcttctttattagtcttgctagtggtctatcaattttattgatcctttcaaaaaaaccagctcctggattcattaattttttgaagggttttttgtgtctctatttccttcagttctgctctttagttatttcttgccttctgctggcttttgaatgtgtttgttcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcactgtgatctgagagacagtttgttataatttctgatcttttacatttgctgaggagtgctttacttccaagtatgtggtcaatgttggaataggtgtggtgtggtgctgaaaaaaatgtatattctattgatttggggtggagagttctgtagatgtctattaggtccgcttggtgcagagctgagttcaattcctgggtatccttgttaactttctgtctctttgatctgtctaatgttgacagtggggtgttaaagtctcccattattattgtgtgggagtctaagtctctttgtaggtcactcaggacttgctttatgaatctaggtgctcctgtattgggtgcatatatatttacgatagttagctcttgttgttgaattgatccctttacaattatgtaatggccttgtctcttttgatctttgttggtttaaagtcttctatcagagactaggattgcaacccctgcctttttttgttttccatttgcttggtagatcttcctccatgcttttattttgagcctatgtgtgtctctgcacgtgacatgggtttcctgaatacagcacactgatgagtcttgactctttatccagtttgccagtctgtgtcttttaattggagcatttagtccatttatatttaaagttaatattgttatgtgtgaatttgatcctgtcattatgatgttagctggttattttgctcgttagttgatgcagtttcttcctagcctccatggtctttacaatttggcatgattttgcagtggctggtaccggttgttcctttccatgtttagtggttccttcaggagctcttttagggcaggcctggtggtgacaaaatctctcagcatttgcttgtctgtaaagtattttatttctccttcacttatgaagcttagtttgcctggatatgaaattctgggttgaaaattcttttctttaagaatgttgaatattggcccccactctcttctggcttgtagagtttctgctgagacatcagctgttagcctgatgggcttccctttgtgggtaacctgacctttctctctggctgcccttaacattttttccttcatttcaactttggtgaatctgacaattatgtgtcttggagttgctcttcttgaggagtatctttgtggtgttctctgtatttcctgaatctgaatgttggcctaccttgctagattggggaatttctcctgaataatatcctgcagagtgttttccagcttggttccattttccccgtcactttcaggtacagcaatcaaacgtagatttggtcttttcacatagtcccatatttcttggaggctttgttcgtttctttttattcttttttctctaaacttcccttcttgcttcatttcattcatttcatcttccatcactgataccctttcttccacttgattgcattggctcctgaggcttctgcattcttcacgtagttctcaagccttggctttcagctccatcagctcctttaagcacttctctgtattggttattctagttatacattcgtctaaatttttttcaaagttttcaacttctttgcctttggtttgaatttcctcctgtagctcagagtagtttgatcgtcagaagccttcttctctcaactcgtcaaagtcattctccgtccagctttgttccattgctggtgaggagctgcgttcctttggaggaggagaggcgctctgctttttagagtttccagtttttctgctctgttttttccccgtctttgtggttttatctacttttggtctttgatgttggtgatgtacagttgggtttttggtgtggatgtcctttctgtttgttagttttccttctaacagacaggaccctcagctgcaggtctgttggagtttgctagaggtccagtccagaccctgtttgcctgggtactagcagcggtgtctgcagaatagcgaatttttgtgaaccgtgaatgctgctgtctgatcgttcctctggaagttttgtctcagaggagtacccggccgtgtgaggtatcaggacagggacatttaagtttgcagaggttactgctgtctttttgtttgtctgtgccctgcccccagaggtggagcctacagaggcaggtaggcctccttgagctgtggtgggctacaccaagtttgagcttcccggctgctttgtttacctaagcaagccttggcaatggtgggcgcccctcccccagcctcgctgccaccttgcagtttgatctcagactgctgtgctagcaatcagtgagactccgtggtcataggaccctccgagccaggtgtggaatacaatctcctggtgcgccgtttttaaagcccatcggaaaggcgcagtattagggtgggagtgacccgattttccagttgccgtctgtcacccctttctttgactaggcaagggaactccctgaccccttgcacttcccgagtgaggcaatgcctcgccctgcttcggctcgcacacggtgctctgcatacactgtcctgcgcccactgtctggcactccctagtgagatgaacccagtacctcagatggaaatgcagaaatcacccgtcttctgtgtcactcacgctgggagctgtagaccagagctgttcctattcagccatcttggctccagcccctccaggatattttcttgacaccctttgctgagggactcgtgacaggggttccctgtttactcagtccgttgtgctcaactcctcgcgggagggagcacgtgaatgaataagttcaggaaccagctgctgcttcgggcactggcaggagcaaactcccttaacttgggtccactcactccaccctcactggagggaatgcataggtgagcaagtgcaggaactagccggtcactttagcactggcaggaccaaactcttgtttgctcaggcccatcgcactccaccccttgcgggagggagcatgtaggccagcaagtgcaggaactgactggccactttggtgctggaaggaacaaactttgtgcagaccccacggcagtgtccaggtgggggtgcctgaaactccaaggccccagagggcatgttacaatgctctcttagctccgccgtccatggacagcagcgtgttatcagcttagtgggccctttgccttgtcacatggggcagatgccctccaccagcaagggcaaagggccagtgtgacagcctttttgggtacccacacttggtggatcccaaattgttgtccaatgccaaaaaagaatgaggtcacgtagacgaattgaagttatggtgaatgcagacaattttattgagtgatgagatcagctctcagtggagaggggagctggaaagggggtgggaaggccaggtcactctcccctgaagtcaatttgcctctctgcccctcttctccaaagtcaagttgcccctctctttgccatccagccaccatctctgaaggcaagtcgcctctccccaacatccagctgcttctcctctctgccagctgagcctggagtctttatagacacaggatggggggacagggctggccataggtagttttgcaaaaggcaacattcaattggtaaaaagacattattcagaaagaatgactcaggagagagcaggcaaacaggagaatagaagttctcaccctgggccaagggtttcaggctacttctggcttgaaggtggggtttccactggggacctgcccctgtctgcctagagtttctctgccttctgcctccctcaatgggtgatgctaaaccaggatgagtagtaaaatcaggatcagagagatcaggacagataagagtctaagcctaaccaggtaaaacacagcaggcacaaggtaggtaaatacttagatacaaaaaacaaaagtttccgtgatacagcctaggggaaacatgactaagtagtcctgtgaagaagaggtttttgatgcttgcaagcacaatctggggcatcacaaagagattcggtaccaagttaaacttctagaagttgaatggagagaacccatgcctagaggactgacttcactgcagattactacacttaaaactactgaggggtattgagaaccatgactggaaactgtgttataagaagcattcttaaatgtaaggagtagtagttaggtgaaagagaaaaccaaagagacaccaatatcccatcctcaaatgcaagaaggtgttaccaaaatgccagggattcagtctgggtcctgctgcttgccacacagaaagccaatcactgagacaatgactgttgccagggaagaaggctttaatcaggcgctgcagcaggcaagatgggagatcagtctcaaatccatctccctgactaaaatcaggggtttatatgccagagaagaaatgaaactacatgcaggaaaacaggaattagggaggggtaaggaagaggagttggtcaacaggaagcaggtggtcacttaggcaatcatgatgggtgaggggtctggtgtctcattgtccagctgtaattatcagctccttgataccatctgggtaggcctgatggttggttttctgagaagggaactcagattaagacaaatgtaactttaagtttgaaaactgggagagtccatttctgtgttaattcaaaagaaatcataaacatcggttctatgggacagctgggccggtttcaatgggctgttctgtatgtgaggcaggtgccctagaaggcaaagctaggattaggaagaagttataggaaatagtctttggttccatttggcaaagtcctttttcatcactttaagctgttgagcagagcagaatagatcatctcttgatggaacacagatatggaggactcacatttatggaggttgtgtcagatactagtcatagggctttggcagccatttgtcagaggtgttgaggaggggactcatgcactctgtaaaggcttgaacaggccaggcatggtggctcacaccagtaatcccagcactttgagaggccaaggtgagtggatcacgaggtcaggagttcgagaccagcctgaccaacatggtgaaaccccgtctgtactaaaaatacaaaaattagctgggcatggtggtgcacacctgtaatcccagctactcgggaggctgaggcaggagaatcgcttgaacctgggaggtggaggttgcagtgagccgagattgcaccactgcactccagcctgggtgacagagcaagagcaaggctccgtctcagaaaaaaaaaaggcttgaacagatgttctctaaggccctgtccaaacctgacagtctatgactgcttatgtgctcatgtaatcaaagcagacagggcaggctcagttgggtacgtggcttagactccccagggaaggaggcaggg

SEQ ID NO: 179 - DNA, 78682 bp, Homo sapiens
ttatagggaagccctgagcatggattcaggttaaatggcattggatcatggcgggtaactgcaagagaagcaactacagggttgtgaggggatgaaggagccagaaggaacagatctcaggatacagataacagccttgaatccgccaggcacggtagctcatggctgtaatcccagtactttgggtggctgaggcaggcaggtcacctgaggtcaggagttcgagaccagcatggccaacatggtgaaaccccgtctctactaaaaactaccgcgggaggctaaggcgggtggatcacaaggtcaagaaatcaagaccatcctggccaacatggtgaaaccccatctctactaaaaatacaaaaattagctgggcgtggtggcacacgctgtagtcccagctacttgggaggctgaggcaggcgaatcacttgaacccaggaggtagaggctgcagtgagccgagattgcaccactgcactccagcctagcaccagagctgagactgtgtctcaaaaacaaaacaaaacaaaacaaaacaaaactacaaaaattagctgggtgtggtgggatgcacctgtaaccccagctactcaggaggctgaggcaggagaatcgcttgaacccaggaagcggaggttgcagtgagccgagattgcaccattgcactccagcctgggtgacagagcaaaactctgtctccaaaaaaaaaaaaaaagtagcttaaaccaatagccaagggagttagagtcaccagatacttggttctctatagaaattaaagataacatcttgggcctggtatggtggcacacacctatatttccttcactttaggaggccaaggcgggcggactgcttgagctcaggagtttgagaccagcctgggcaacatagcaagacccctgcctgcactaaaaatacaaaacatttgccgggcgtggtgacacatgcatgtggtctcagctactcaggaggctgaagtgggagaatcacccgagtccaggaagtggaggctgcagtgggcaatgattgtgccactgcactccagcagctgggagaagggagtgagaccctgtctcaaaaaaaaaaaaaaatcagtgagaggaagcaaggactgaccttcacagggtccagatgcctggcacagtgaggccaaccacccacaccaaggtttgcagcgagaaaaaagagggcatttatttgcagggcgccaagcaaggagaatctggcagctttacatccagaactccctgctggcttgcaggtaggcgtctttaaaggtaaggaggcggaggttacggcaaagtcataaatcagtatggaggctatacgttggtttggccctaaaaggtgggatatcttaaagtgggggcttacaggtcataggtggattcaaagattttttttttttatttctaattggttaaggaagagaaaactttgtttaaaaatgcggagttggccaggcgcaatggctcatgcctgtaatcccagcactttgggaggctgaggggggcggatcacctgaggtcaggagttcaggaccagcctggcaacatgataaaaccccatctctactaaaagtacaagaattaggtaggatgcggtggcgggcacctgtaatctcagctacttgggaggctgaggcaggagaaaggtagaacctgggaggcagaggttgcagtgggccaagatgatgccactgcactccagcctgggcaacagagcaagactctgtctcagaaaaaaaataataatataatataaaaataaaataaaagtacaaaaattggccaggtgcggtggcttacgcctgtaatcccaacactttgggaggccaaggcggatgaatcacccaaggtcaggggttggagacaagcctggccaacatggcaaaaccccatctctactaaaaatacaataattagctgggcgtggtggtgggtgcttgtaagcccagctactaaaaaggctgaggcaggagaattgcttgaacccggaaggcagaggttgcagtgagccgagatcatgccactgaactccaacctgggcaacagagcgagactccatttcaataaataaataggcggggtggggtggctcacacctgtaatcccagcactttgggaggccgaggtgggtggatcacgaggtcaggagttcgagaccagcccggccaagatggcgaaaccccgtctctactaaaaatacaaaaattagccaggcatggtggcatgcacctgtaatcccagctacttgggaggcagaggttgcagggagcagagatcgcactactgcactccagcctaggcgacacagcaagactccatcttgaaaaaataataataacgataaataaataaattctaagaggtagcacttagccatcagaggtgagagaaatacactgatcatacgggtggcaacgctggaatgagaaccatggcgtcctaaccccaagcaatcagtggcaatgggaaatagacctagcggtgttcctaatggattgacagctacccagtgatgtcgtggcttgatctacacaacaaaaacaacaataaaagaggtcaagagcaggccaggtatggtggctcaagcctgtaatcccagtactttgggaggccaaggtgggtggatcacccgagatcaggagttcgagaccagcctggccaacatggtgaaactccatctctactaaaaatacaaaaattagccaggcatgctggtgcgtgcctgtagtccccacagcaacttgggaagctgaggcaggagaatcgcttgaatgcttgaacctgggaggcagaggttgcagatcacgccactgcactccagcctgggggacagagagagactctgtctcaaaaaacaccacaacaaaaaacaaaacaaaaacaccagcacccacaaaggctcagcggcatgcagcagtgtggtgcgattggagtccctctggttcctagaattggagtaaggggtctggcctctgtcctccaggtgccggggagggaaggaagtaggggaaccacacactcagtgtcacaggagggtgtggcatgggtgctgggaaaaggtggtgctgccatctagggcaggagctggttccacgttgacttggggggatcagagaatgcagattccaggagacagagtccagagttttcaaaggaaatgggcaggtggtggccactgagggcagtgcctaggttcctggctgctgagcttcttttatttttctttgtatcttttttttttttttgagagagtcgtctttctctgtcacccaggctggagtgcagtagcgcaatctcggcagactgcaacctctgcctactgggttcaagcgattctcatgcctcaggtttgccagaagctgcgtttacagacgtgcaccaccatgcccacctaatttttgtatttttagtcgaaacagagtttcactatgttggccaggctggtctcaaactcctgacctcaagtgatccacccgccttggcctcccagtgttgggattacaggcgtgagccactgcactcgtcctggctgagcttaaaaataacaccatatttcattagatctagggcaccatcacctgtaagatgcatgtttctcttaggtactactaagaaagagaaatcaggccaggcaaggtagctcatatttgtaatcccagcactttggcaggctgaaggggtcggatcccctgagcccaggagtttgagaccagccagggcaacagagcaagacccatatctacaaaaaaaaatttttttttttaaattttctttgagatgaagtcttgctctgttgcccaggctggagagcagtggtgtgatctctgctcactgcaacctctgcctccccagtttaagcaattcttctggctcagcctcccaagtagctgggggttacaggcgcatgccaccacgcctggctgatttttttttcttttgttttttcctttgtatttttagtagagacggggtttcaccatgttggccaggctggtctcgaactcctgacctcaggtcatccaccaaccttggcctcccaaagtgctgggattacaggcatgatccaccgagcccagcctctacaaaaaaattttaaaaatcaactgggcatgttggcacacgcctgtaatcccagctactggggaggctgagtcagggggatcacttgagcccaggaggttgaggctacagagagctatgatcatgccactgtactccagcctcagcaacagagccagaccctgtctctgaaacagaaacaaacaaaaaaagacagaaagataaatcactgacagttaattttgccaacatttttatcttgtactttttcaagcattcagagaagtttaacagaattgtatcatgaacacatgtacggccacctcccagatgctactactggcatcttaccctatttgtcctgtcatgtatctatcccttgatacattcatccatccttttttctttttttttctttctttaattttgagacagagtctcactctgtgtccaggctgaagtacagtggtgctgccttgcaaccacccccggctaatattttgtatttcgactagggatggggtttcaccacattgcctgggatggtctcaaactcctgacctcaagccattcccacccaccccctttgcttcccaaagtgctctcaaagcatgaatcactacacctggccagaatatatatatatagttgttgctgttgtttttgtttttgccttttttgagatggagtctcactctgtcgcccaggctggagtgcagtggcgtgatctcggcgcactgcaacctttgcctcctgggttcaagcgattctcctccctcagcctcctgagtagctgggattataggcatgtgccaccacatctgggtgattttgtatttttagtagaaacggggtttcaccatgttggccaggctggtctcaaacccctgacctcaggtaatccaccgccacggcctcccaaagtgctgggattacaggcatgcgccaccgcgcccggctgattctatatatatttaaagggctttggctcacacatgtgtctgcatttgttaaccatcagtgaacgttcactcaaaagttatgcattgcaccgtgtaaatttcccctgccaaaaacgaagcggtaaacacatattcaactctagttaatagtatgcatgctgaagtgcttatcgtgatgtttgccagctactttgaaatgcatttttaaaaatgatggggcaggtgtggtgactcacgcctgcagtcctagcacttcaggaggctgagtcaggcagatcacttgagtccaggagatcgagaccagcctgggcaacatggcaagaccctgcctctagaacaactacaaaaattagccaggtgtggtggcgtgcctgtggtcccagctagccgggaggctgaggcagaaggatcacctgagcccaggaggtcgaggctgcagtgagctacgatcatgccactgcaccactgcactccagcctgggtgacagagcaagaccctgtctcaaaaaaaaaaaaaagaatcgcagaaagttccatcatgcctgttccactcaatcttcactgcctgttctgactagctttgcctattctagaacttcttagaaatggaatcattctagattccttagaacgtgtttgagatccatgcaagttgtgggcatcagtagttcacttatttttattgtcaggtggttttctagggcataggtgccccatagtttgttgaatccttctgctgttgatcaacacctgagctgtttccagtgtttggttattattgacaaaaaaaaatcattgatttcttttttgttgtttttggtttttgttttgttttgtttttttgagaccgagtctcactctgtcgccaggctggagtgcagtggcatgatctcggctcactgcaacctccgcctcccaggttccgtgattttcctgcctcagcctcccgagtagctgggattacaggcatgcgccaccacgcccagctaatttttgtatttttagtagagacggggttttaccatgttggccaggatgttctcgaactcctgacctcaagtgatcaacccacctcggcctcccaaagtgctggcattacaggcatgagccactatgcctagcctttttttttttcttttttttaagatggtgtcttgctctgtcacccaggctggagtgcagtggcgcaatcacagctcactgcagcgtcaacttcctggggccagacgaccctcccagacgaccctcccacctcagcctctcgagtagcttggaccacagctgtgcacacagcgctgtgagattacagtgagctatgatggcgccactgcacttcagcctgggcaacagaggaagactccccctctaaaaaagaaaatgcactcagtgttgaaaagacgctttatcaaagaagatatacggatggcaaataagcacaggaaagcatgcacaacattactgaccacgaggaattgcaaattaaaccacaacaggccaagtgaggtggctcatgcctgtcatcctagcactttgggagtcccaggtgggtggatcacttgaggccaggagttcgggaccagcctggccaacatgatgaaaccctgtctctactaaaaatacagaaattagccaggtgtggtggcaggtgcctgtaatcccagcatctcaggaggctgaggcaagagcattgcttgagcctgggagtcggaggttgcagtgagctgagattgtgccctgcacaccagctttggtgacagcgagactccatctcaaaaaaaaaaaaaaatgtatagaactatacacctaacacaggtgaattttgccgtatgtaaattatacttcaatcaaccaaaaaaaagcacctgaaaatatacgtaactacaccaacaaaaaagagagaggccacatctccacatctttgtactgtgtgtgtgtgtgtgtgtgtgtgtgtatgtctgtcgtgcatagcagaggggggaagaagtgtgttcggaggcacacctgctgccataacgatggccggcagctttaactaccatgcatttttaatcacagaagggttcagtgctcgaatttccaggagctgaccaccaggtctgaaattcagcctggcccttctctgacatgtgcagcctcttgtccaatcctgccctgtccgccccactcctctagtcctgatcacgggacttgaggtgtttcccggaacaatagtcccattcccgcctcccaggaggggagcccatgccaagtcagccagcctaggagggtccccttgggtccaacatgctgggagttggtggcctcttgtggccagaaatagaattatcacatattaaaaatgatcactggccgggcgcggtggctcacgcctgtaatcccaacactttgggaggccaaagcaggcgaatcacgaggtcaggagattgagaccatcctggccaacatggtgaaaccctgtcactactaaaaatacaaaaattagctgagcatggtggcgcacgcctgtaatcccagctactccggaggctgaggaaggagaatcgctcgaaccggggagtcggaggttgcagcgagccgagatcgcaccactgcactccagcctggcgacagagcaggactccatctcaaaaaaataaaaataaaaattagctgggcatggtgggacgctcctgtagtctcagctacttgggaggctgcggtgggaggatgacttgagcccgggaggtcaaggctgcaatgagtcataattatgccactgcactccagcccgggtgacagagcgagaccctgtctcagaaaaactgaaagaatttttttttttttgagacggagtctcgttctgtcgcccaggctggagtgcagtggcgcgatctccgctcactgcaagctccgcctcccaggttcacgccattctcctacctcagcctcccgagtagctgggactacaggtgcccaccaccacgcctaaataattgtttgtatttttagtagagatggggtttcaccgtgttagccagggtggtctcgatctcctgacctcatgatccgcccgcctcggcctcccaaagtgctgggattacaggcgtaagccacggcgccgggcccaagaatttttaaaagatcatagtaggccgggtgtggtggctcatgcctgtatcccatcattttgggaggcccaggtgggagaatcgcttgagcccaggagtagttctggacaacagaacaagaccctgtctctattaaaaatattaaaagatcacattaagggttgattctgcttatggctggggtgggaacggcatttccatacagggttagaggcctgtacattagtgcaaccttttcagcagcacaagtcaaaatctaaaatacacacacccggccgggcgcggtggctcacgcctgtcatcccagcattttgggaggccgaggcatgtggatcacgaggtcaggagattgagagcatcctggctaacacagtgaaaccccgtctctacttaaaaaatacaaaaaattggccgggcatggtggcgggcacctgtagtcccagctactcgggaggctgaggcaggagaatggcgtgaacccgggaggtggagattgcagtgagccgagacagcgccactgcactccagcctgggcaacagagcaagactctgtctcaaaaaaaaaaaaaaaaaaagagaaaaaaatacacacaccctctgacctatgggaatcacagaagtcttgcccaaacagattttcctctagttctaagtaaaagagacaagaatattcacatctttgtgttaagtgaaaccacaggaacacaattggctatatccagaatgcgggacattctgtaggacaggggcttcagtctcgccaacaaatccctgacataaaaacgggcagtgaagccgggcgcagtggctcatgcccgtaatcccagcactttgggaggctgaggcgggccgattgcctgaggtcaagagtttgagaccagtctggccaacatggtgaaaccctgtctctactaaaaatacaaaaaaattaactgggcgtggtggcatgcacctgtaatcccagctactcgggaggctgaggcaggggaattgcttaaaccaggaaggtggaggtttcagtgagccaagatcatgccattgcactccagcctgggtgacagagagagactccatctcgaaaaaaaaaaaagtgcactgaagagaccattgattataaagaaacttaagaccaggcacattggctcacatctataatctcagcactttgggaagctaaggcaggcggatcacctgaggtcaggagttcaagaccaccctggccaacgtggtgaaacctcatctctactaaaactacaaaaattagctgggagtggcagcatgcacctgtagtcccagctactccggaggctgaggcaggagaatcgtttgaacatgggaggtagaggttgcagtgagctaagatcgcaccactgcgctccagcctgggcaacagagcgagactctgtctccaaaaaaaagaaaaagagagagagagaacgagagaaagagagagccaagaatatctccacgggatcatagacaaactggggggaggtggtcaggaattctgtggacctgtgcttggcagcacccactcgaagcaatcagattaacacctggagtagacccaaaacattccccacacgcacccagacccattgtcacaggtaccaggggcttagcataagctgtggccagcacggaacaaacgataagccgctctggcacagcggtgactcctaggaagccaggcttaaagatgacgtcagagccatccccggccatctggaaggctgcctgcccaaagctgcgccttctcgggagaaatcacaggaagaatgccaagctaccagttcctgactgaccagggcaaaaggggaaattctctgaatggtgatagcagcctccaagccacacacacgtccagtgggaaagggcaaaaatctaactggccaaggggcttaaacacaacttttttttgagagagagacaaggtgtcactctgtcactcaggctgctggaatggagtggcatgatcatggctcactgcagccttgaactcctgggcccaagcaatcctcccacctcagtctcctgagtagctgggactacaggcatgcaccaccatgactggctaatttgttttattttttgtagagatggggtctcgctgtgttgcccaggcccgtcttgaattcctgggctcaagtgctcctcctgcctcggcctcccaaagtgctgggattacagacatgagccaccgtgcctggccaagcacaatctttaaccattaagtggcttatgctgacccaggggcgacccctaggtagccaagttaaaaggtaaaaacaggaagaaaaaatctgagcagggacatctgagtctgcatagtgtgagatgaggatcgtagtggtgaaacttgttcagcccagtcacaaagtaatacatcacctagcaaacaacagtaaccacaacccctgactggagttgggggaatcaagtgtcagagttgctaaaatacattatctaaaacgtccagtttttggccgggcgtggcagctcacgcctgtaatcccagcacgttgggaggccaaggcgggcagatcacgaggtcaggagattgagaccatcctggctaacacggtgaaaccccgtctctactaaaaatacaaaaaatcagccaggtgtggtggcaggcacctgtggtcccagctctcgggaggctgaggcaggagaatggcatgaacccaggaggcagagcttgcagtgagccaagatcacgccactgcaatccagcctgggcgacagagcaagactctgtctcaaataatgataataataataataatttttaaaaaaatccagctttcaagaaataattatgagacatgcaaagaaataggattggctgggcacagtggctcatgcctgtaatcctagcactttgggaggccgaggtgggtggatcacttgaggtcaggagttcaacaacagcctgggcaacatgacgaaaccccatctctactaaaaacacaaaaaaattaactgggaatggtggcgtgagcctatagtcccagctactcaggaagctgaggcatgagaatggcttgaaccccggaggcggaggttgcagtgagctgagattgcatcactgcactccagcctggggacagagagagactccatctcaaataaataaacaaataaactgcaagacttgtatatttaaaaccacaaaacattgttgaaagaaatcacagacctaaataaatgggaatacgtcccatattcatggatcagaagacttaatgttgtgggttttgtttttgtttttagagatgaagttcttactatgttgcccaggatggacttgagtatctgaactcaaatcatccttctatttcagcctccaaagtacctggcactacaggcatgtgccaccatgcccaggacttaatattaagataccaattgtctcaaaaattacttacagggtcaacacaattcctatcaaaattctgactgtagttttgcaaaaactgacaagctggtcctaaaattcctatgaaaattaagaaacctggaatagctaaaacaatctggaagacagacgtaccaagttagaggtctcacacttcccagttttaaaacttactgcaaagctacggtaatcaagacagtgtggtactggcataaggatagacattagatcaatagaatagaaccaagagtccagaagtaagcccttatgtttttgacaagtgtttcaatttgagggggaaagaattgcctttgcaaacaaatggtgctgggaaaactggatcgtgaccattttttctgatagcaactcaactgttaattttattgaatgtcccttgtatgtgatgagttacacttttcttgctactttcacgattctctttgactttcaacactttgactatcatgtgcctagctgttaatcgttttttagtttatcgtacttggagttcatcaaactttttgaatatttagattaatattttttaaatcgaattcaggaagttttcaccctctatttcttctaatattctttctccccctcttctcaatcctatccttctgggatttgcattatgcatatacagatattcctcaacttacaatagaattatgtcttgataaacccattttaagttgaaaatatcataagtcaaaatgcattcaatacacctagcctggcaaacatcatagtttatggccgggtgcagtggatcacgcctgtaatcccagcacttggaaaggctaagacaggaggatcacttgagcccaggactttgagatcagcctgggcaacataggaagactctgtctctacaaaagaaaaaaaaattaaattaaacaatatggcacttctggaaatcagattcctctctccccactccctggggtttgctgttgttgttgcttgttgctgctggtgtttgtttagtgacttttctggactttgtaaaatctgtgttctttgttctgtgcaaccactgaagactttgcttagttatctcagtggtcagctaataactggacagagatattcctagacgtctacttgctttggcagcacatacactaaaattaaaatgatacagagaagattatctgacccttgtgccaggattacacacaaattcgtgaattattccatatttttaaaaaaatgatttaaaaaattaaaaagtgatctttttaaatgctttagaccattaagtttcccagcatttgctgacaaactctgtgtgtgttgaggcatgttttcaatactccagcaagcaacttacaactctgccttagccttcatttcctcttgtgcagacactcaaggtcagccagaggtgagagtttaggaccttctcaggtcttcctgggtgtgcgcacagccctgtacatgcacgtagcccactagattctcagaaacacagcaggggttttttaaagtatcttattggcatctcttttcccagttattcctttaaaaaatttttgatcaagccaggcgcagtggctcacgcctgtaatcccagcactttgggaggccgaggcgggggatcacaaggtcaggagatcgagaccatcctggctaacatggtgaaaccccatctctactaaaaatacaaaaaattagccgggtatggatgtctggagcccattcctttggcttcaacttttcagacagtgttatcttgtaactgtccttgaagtgagctgctaagcagaggaaaacttgttcttcttttctttttaacccttgccttgccacggttacaccacatcaggtagttgaaatgttaaacaattgccactgattgttttggacaaatgccttgggcatagggctatttgcacagatactggcaaactcttggatcaaataaagacaagctttgagaatagcatttttcagcaaactggcagacaagtcaaatagtgacagtttttgggggatggggcttttagggagctccaagcccagcctgcctcttccagtgactggcaagatgcttgttttcacagctaccatggttaaaagccagcctattttcatggatctggaagagagggatgcttttagagcaaattaaaatggcacaaaatcagtgtttatactgagattcagccctcttacttgaacatatactcttcaaattgttgcaagcctttagataatttccaggtctgaagaaattgattttgaccatttttgtcagcattctctttgcttatatggaggagtgagtttttggagattcttgctccactattctggaagcatttccttttatccattcaatattttttgtttccattgccattctttacatttttaaaattttattgtaaattgaccatgtgtgtatttatggtgtacaacgtgatgttatggcttatgaatacaacgtggaataattaaatcaagctaattaatacatccatcacctcaaatatttatattttttggtggtgagaacatttaaaatttattttcttaacaattttttttttgttttagagacagggtctcactctgtcacctaggctggagtgtagtggcatgatcacggctcactgcagcctcaacgtcccaggctcaagaaattttcccacctcagcctctcaagtagctgggactacagctgtgcgccaccatggctggctaatttttaaaattgttttgccgagatggagccccactatattgccaaggctggtctctaactccagagctcaagtgatcctcccaccttggccttccaaagtgatgggattacaggcgtgagccaccacgcctgacctcttaacagttttgaaatgtactatacagtgttgttagttatattcaccaggctgtgcaatagctctcaaaaaagcattccttctttctaactgagattttgtacctttcttttttttttttttttttttttttgagatggagtctcgctctgtcgcccagcctggagtgcagtggcgcgatctctactcactgcaagctccgcctccagggttcacaccattctcctgcctcagcctcccaagtagttgggactacaggtgcccgccaccatgcccggctaattttttgtattttttactagagacggggtttcatcgtgttagccaggatggtctcgatctcctgaactcatgatccgcccgcctcagcctcccaaagtgctgggattacaggcataagccaccgcgtctggcctggccttttttttttttttttttttttgagatgtagtttcactctgttgcccaggctggaatgcaatggcgcgatctccggctcactgcaacctctgcctcccgggttcaagcgattctcctgcctcagccttccgagtagataggattataggtgcaagccaccatgcccagctatctttttgtatttttagtagagacggggttttgccatgttggccaggcttgtcttgaacacctgacctcaagtgatccaaccaccgcagcctaccaaagtgctgcgattacaggcatgagccaccgtgcctggctccccactctatcttaatagcattcttaggttgtgagatattcaagctcttctgtgttttttttttgtttttgtttgagatggagtctcgctctgtcgcccaggctagagtgcagtggtgtgatctcagctcactgcaacctccgcctcccgggttcaagctattctcctgcctcagcctcctgagtagctgggattacaggcattagccaccacgcccggccaatttttgtatttttagtagagatggggttttaccatgttggtcttgaactcctgacatcaggtgaaccacccacctcggcctcccaaagtgctgggattacaggcatgaaccaccgcgcccagccatagcccttctttttaaagaaactaatgctcagcgaggttaagtgactgatgtaaagtcatatatccccggagaaccaagccagggtttgaaccccaacacacctgtttgatatgagtgttctgcatgtccagcccttcctccactcatgtaccctttcactccagtccttagttccctcctccacaccagctgtttatcccacaagtttatttaggcactgatctgtgggaggattgctcagctccgaagctagcaaataaggagactccacgcacctgcagatgagggttctgctctcaggttgaaagcagaaagtctcttctctctgagctgggcatcgggccggtcacctggaggaatcccaaagtgatgatagaaggccctgagcatccttcctgctctccatgccatcaggaatgtcagctgatgctgtctccaggtgagccaagacatgcaggtgcattcctgcgtcacacgcaggtcacgtccctggcagaaacccagcctgctctccaacaacacccttctggcagttcccaataccacgcagatgatagagcaattaaacaaaagctggatgagtgagcagcggctctcagctccagcccatcctggccaccagaaaaggaggaccagggtttagttcttgaggtgaaaccagcccaattgtccccatggaactgatgtttatggtttctttgaataaacatagaaattgatcctcccagtctttttttttctttctttttttcttttttttttttttttttgagacagagtctcattctgtcacccaagctggagtgcagtggtgtagtctcagctcactgcaatctgcctcctgggttcaagcgattcttctgcctcaacctcctgagtagctgggatgacaagcaccctccaccatgcccggctaagttttgcatttttagtagagatggggtttcaccatgttgtccaggctggtatcgaactcctgacctcaagtgatccacctgcctcgacctcccaaagtgctgggattacaggcgtgagccaccgcgcccagccattcacatctcttttgactgagagctttacactaagatgaaggaattttgacaatgggctcatgcgtttgggattcaccatgtgccctattacccagatggatggtagagtggcctacagaaggctactgaagcaagcctatggaaggctcagtcatgactgcagctaagagaccacatcctgtaagactgggctgttgttcaataatatgcagtacacacctgcaaaccaagagtggaggtggtagtttttccttgcatataacatctaataactcacttaaggaacttttgttttcatctacccaactcagggcttactggagtttgagatcctaacacacaaggaattcgctttttttttttttttttttgagatggagtttcgctcttgttgcccaggctggagtgcaatggtgtgatcttggctcaccacaacgtccgcctcccgggttgaagtgattctcctgcctcggcctcccgagtagctgggattacaggcaggtgccaccacgcccggataattttgtatttttagtagagatgaggtttctccatgttggccaggctggtctcgaactactgacctcaggtgatccacccgcctcagcctcccaaagtgctgggattacaggtgtgagccacctcacccaggccatggaattccctgttttatcccagggaacagagttgtggttctggtccattggaaactgagtctacttcgcggtcattttgggatcttcattcactgaaccaatagagagagaaggagtttctgttccagctgggatcatagattgctatgagcaagggaaagttgggttgctgctcagaatgagatcgaggagaactatgtctagaaccccgaggattcactcaggcacctctttatgtatcttcattcaccaataaccatggcgggtgagacatgactatacagtggtaagtaaagaaagagactttttttttttttttgagacggagtcttgctctgtagcccaggctagagtgcagtggtgcaatctcggctcaccacaacctccgcctcctgggttcaaacgattctcctgcctcagcctcccaagtagctgggaccacaggcgcccgccaccgcgcctggctaattttttgtatttttagtagagacggggtttcaccatgttagccaagatggttttgatctcctgacctcatgatccgccctcctcggcctcccaaagtgctgtgattggcagacttattaaagaaagtatgaaagtacattaccaagccaggtgcggtgaatcacgcctgtaatctcagcactttattatgaatgcagtagctatgaacattcttatttatgtcttttagtgaaaatatgcactaattctactgtatatgcacctagaaatgcatatacagtgcatttggccgagtcaaaaggtatatatatgtttaattttagtaaatagaccgtgcgtggtggcctgaggtcaggaattcaagaccagcctgaccaacaaggtgaaaccccgtctctactaaaaataccaaaattagccgggcgtggtggtgggtgcctgtaatgccagctacttgggtggctgagacaggagaatcgctggaacctaagaggtggaggctgaggttacagtgagccaagattgtgccactgcactccagcctgggcgacaagagcaaaactccatttaaaaaacaaaaaaacaaaaaacaaaaacaaaactttagtaggtagtgcccaagttttccaaagtggttgaaacaatttagactttcatcttgcagtgagccgagatcgtgccactgcactccagcctgggcaacagagcgagactccatccacagtgtatgagagttccaattgcgctctatggtcatccacacttgggattgtcagttgctttaattttagccaatttggtggatgcttagtaatacctcatttgcccttaatttgcattttctttttttgtttgtttgtttggtttttttgagatggagtcttgctctgtcatccaggctggagtgcagtggtgtgatcccggctcactccaacctctgcctcccaggttaaagcgattctcctgcctcagcctcccgagtagctaggactataggtgcctaccaccaggcccagctcatttttgtatttttagtagagacagggtttcaccgtgttggccaggctggtctcgaactcctgacctcaggtgatcctcccaccttggcctcccaaagtgctgggattacaggtgtgagccaccacacccagccttaatttacattttcttaatgagtattaacgatgaccaccttttcaggtgctcattaacattctgatatcctcttttgtgaagtgcttgtgttcaagtattttgcccagttaaaaaaaaaaaagctgtctatatttttcttattgatgcgcagaagttctgggtataattcctttgtcaaaaatatatatattgcaggccgggcgtggtggctcatgcctgtaatcccagcactttgggaggccaaggcgggcagatcacgagatcaggagattgagatcatcctggccaacacagtgaaacctcatctctactaaaacacaaaaaattagcctggtgtggtggcacacgcctgtagtcccagctacttgggaggctgaggcaggggaatcgcttgaaccctagaagcagaggttgcagtgagccgagatcgcaccactgcactccagcctggtgacagagcaagactccgtctcaaaaaaaaaaaaaaaaaaaaaaaaaaaaaaaatatatatatatatatatatatatatatatatatataaaataaatatatgtatctctaaatcttgccttttcttcctctcttaatggtctcttgaaaatagcccattcttctcaatgttgatgaaggccaatctctcattttgtggttactactttttttcttttgagacagagtctcgctctgtcacccaggctggagtgcagtggtgcgatctcagctcactgcaacctccacctcccgggttcacgccattctcctgcctcagcctcttgagtagctgggaccacaggcaccagccaccacacccggctaattttttgtatttttagtagagacggggtttcgccatgtcagccaggatggtctcgatctcctgacctcgtgatctgcctgtcttggcctcccaacatgctggattacaggcgtgagccaccgcgcccggcctgtggttactactttttaaagaacttgttttgttttgagacaggatcttgctctgtcacccaggctggagtgtagtggcgcggtcatagctcactgcaggcttgaactcccaggctcaagccatcctcccgccttagcctctgaaggagctgggaccacaggcgcacaccaccacgcccagctaatttttgtatttttgtagagaccgggtttccccatgttgcctagtctggtttcaaactcctggactcaagcaatccgcctgcctcagcctcccaaagtgttgggattacaggcatgagccaacacatccgctttaaagtacctgtttagactactttgtttatcccaaaatcatgaaggcattctcgtttccttctagaaattctattgtttttacctctcacatctaggactgtaatccatctcaaattaatttttgaatatggtgtgaggtaggggtacttattccttttattgaaaagaccatcctttcctcaatgatttccaatgcgttcttgaccctataattagaattaacttctgtaagcactcattagatcgttccactttcctgcctgtctttaacggcagaccattgctcttatggacaataatcagataatggtcagttccttgcgtaacaatacgcagcttgatctggccacctcctgtctctcctgccaaatcttgccttgtgtctgcctttccactctgaacatagagttctttggacaggtcacaccctcatcctcaagcccttcccatatagagtgttttcatgcccttagactagttactcaaacttcaggtctcatctcttccaggagccttctcaatagcacagtccctgtcccttaaatataggttgtgtgacttctatatatgcattcatggtcaggcacagtggctcatgcctgtaatcccagcactttgggaggccgaggcaggcagattacctgaggtcggaagttcgagaccagcgtgaccaacatggagaaatcccgtctccactaaacatacaaaaattaactgggcgtgatggtgcacacctgtaatcccagctactcgggaggctgaggcaggagaatcacttgaacccggaaggtggacgttgcagtgagccgagattgcgccatcgcactccagcctggtcaagaaggtgaaattccgtctcaaaaaaaaaaaaaaaaaaaaaaaaaatatatatatatatatatatatatatatattcgctcattgtacccccgagtttctaattatatttatttattttattttttgagatggagtctcactgtgtcgcccaggctggagtgcagtggcatgatctcggctcactgcagccttcacctcctgggttcaagcaattctcccatctcagtctcctgagtagctgggattacagggccgtgccaccacaactggctaatattttacatttttcctagagacagggtttcaccatgttgggcaggctagtctcaaactcatgacctcaggtgatccacctgcctcagcctcccaaagtgctggggttacaggcgtgagtcaccatgcccagcctattttattttactttttagatggagtctcactctgtcgtccgtccaggctggagtgcagaggtgcaatctcggctcactgcaacctccacctgtggggctcaagcaattctcccacctcagcctccctagtagctgagattacaggtgcccaccaccatacccagctaacttttgtacttttagtagagacggggtttcaccatgttagccaggctggtctggaactcccgacctcaggtgatccacccgcctcagcctcccaaagtgctgggattacaggtaagagccaccacacctggccttctatttatatttaaatatctccccattataacttctctgagggaaaggaggaggcctatttagttcacatgagaggtgcgtcctaaatactgttgaatgaatgaataaatttaagggacgattctgtcccaggaacccagacagtatggaccttggagaaacaggacgtttccagtctcagatctagcacttggctaataattatttctgagcctcgattttcaaatctgtaaaattaagatatactattctctacttaggattgtaatgggcatcaaataagataatgtggctgggcacagtggctcacatctgtaatcccagtactttgggaggccgaggtgggagcatcacttgaggccaggagtgcgagaccagcctaggcaacagagtaagaccccccccgcccccaccccatctctacaaaaaacttaaaagttagcagggtgtggtggcatgcatttgtggtcccagctacttgggaggctaaggtgggaggatcgcttgagcctgagtttgaggctgcagtgagctgtgattgagcctctgcactccagcctaggcaacagagcgagaccttgtctttcaaaataataaaatgataaggtaatgcgcagaagcattcagcacagtgattggcacatggagggcccattggggtgtttttgtttttgtttttgttgttgtttgagacagagtctcgctctatggcccaggctggatggattgcagtggcatgatctcggctcactgcaatctccgcctcctgggttcaagcgattatcttgcctcagcctcccgagtagctgggattacaggcgtacaccaccaagcccggctaatttttcttgtatttttagtagagacggggtttcaccatgttggccaggctggtctcgaacttctgatcttaggtgatccgcccgccttggcctcccaaaatgctgggattacaggccaccgtgcctggccattgagtgttattaagaggagggtacgcagaaaacagactcccgccagctctgccccatgcgcatgagcggccgccgctcgccctcagccaggcccagcgcgccccgacgcgtccccacgcctgcgtgatccaccggaacccaagcccaggcaggcggtgagagggcggggcctccgcagtgcgactgcgccgctcgaggccgtgcgtcgcgggggcggggccgcgcaggcgtaccgggtgccccggctctggagcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacgtaaggccggggtcgggggtcggagtcggggtgaggccagggtcggacccgggctagggggagggcctcgctgccaagctcggcggcgtcgcaggctcggcctccccgcgggccaaggcgcgcagaggcgtccccaggggcgggcccggggcgtgcagggaggggcgccctccagggagaccctcgggtgctggcctggagctgcggtcccggagcgggagaggtggtggagagggggctgctttcaccctcttgcggggaggccccctggcttcagacttaactacttctcgcaaagttggggccgaactttggggcttgacttgtcttggccgcctgtggagcgctgggtgtgggtcgcttcctctcctctcgtctcctcttcccgctgcttgctcagcgtctcccactcactctcctttgaatcaggcccttctccttgtcttttcatcgtcttaagacccttctctctctcttgattttcttttcttcgtttctcactgtttttttgtttgtttttgttttttggggtttgttttgttttgagacagagtcttgctctgttgcccaggctggagtgcagtggtgccatctcagctcactgcaacctccgcctcctgggttcaagcgattctcctgcctcagcctcccgagtagctgagactacaggcacgcgccactgtgcccagctaacttttttgtatttgtagtagagacagggtttcaccatgttggtcaggctggtctcaaattcctgacctcaagtgatccgcccacctcagcctcccaaagtgctgggattacaggtgtgagccaccgtgcgcggccctccctgttctttttgggacatcaactttgatgtcttctccagcaagtaacaaacttagcaataaccttggcatctgacctagctagggagaaactgagccaagagaggcgttacggaccagtgccccaggagtctcagagctccagcgggtgggtcatcctcagggcaagagaaggccttaatgccagcccgtgcattcggaacgctgtttgtccccactgatacgggttggatgctgcctgggaggaggacttgtggggatggttaatagatgagcgagctttctggagagagaagggtgagttatggggttggcagggaggagagccatcttggaagtgagtaagaggaagtgaggaaagagaaggagtggggcatttggcatcttactaagtcattggttgagttgttactggctgagtggaattaacatagcagaaggtaagattctttaggaaattaaaagtgaattgtagaatggacaacactcagtgggtggtgtacagcaggcactcaatagcacctccccaaagctgtgaagacagtcgcacagtgggactgtattgagagtcggaaggggcaaatcacctcatccaactacagatgaggaaatccttccgaaaggctccaagctggtctgggttttggaattggttaatagtggagcgggggcaggagtggaatctcgcctcctgagctctcttccaatgttctttctgctctgccatgctgtttttttttctgtttacagagtagaattctgaagacagtgaatttagaaataatagcataacaacgtgtaaagatgaaaactcccaagtactgtagcgttctgtgtgaccaaaagccagaacaacaaacaattcggacaacctgttgcagttcaagtggaatagactatgttaatccagatagggaaaaggacacatcccaaaccaattctaatttggtttttaagcccaaggccacagtattttgagaccagtaagaaatggtagtagtagtagggtggtttatgccttgtataaattagagagtttccaaaacattgtcggccactctttcagtttttcactaattatttctatcagaatgaaatcaaatagagaaaagcattctcttttactgttacttcagctggactgccatgttccctgtgtcacagaagagtgtcactctggcctgaaataggaccttttcacacttggacattttcacacttacccacttctccatgctccccgaagttattacagttcaagagatttctgttactttgagatttcataactttgacttgccagagagaccttgatgtagtgtaaacctaaattggaatgaatagtaagctaggattatactagaagttgactgggctaaaatgacggtaatttgttttaaatctacacttgaaagaaatagagaagttcccggagagagcttttatggcttataccttttcctcccttcttaatctccagaatttattgaggagcacaatttttagcaagtgaaagaatgaccgtctagaactcacatttactgtatgcagtgagaaaatttggaagccagttcacttactagaatatatatgttatagggtcatttcccttttttttgtcttttaaattctttttgtatttgttacataccaaactataactgtcctgcctttctttactggtaatatgatttccaatgtcgtactttttcatgattcctatcctaaaagtgtgcataagttttatttgttttttaccatttgttttttgttttgttttgtttttttacctagagaagtgaaaggggcatcaagagcagctggtcttggccgtcgcgctgttgtctggttagttccaaccctggtttctgaaagtatcaccttggaaggcttatgttagaggacttttttggctttttgaaattgcagtgaaccagttaataagtgggagaggatcacttgaatctgaaatggaaatatcaaggactacatttttccagtggataccacagcttgtgggaagttagtgatgtagcaatgtctgttttaaatgccatgtctaaaagggatggaatgaagaaagggacttgactttccaagtcttgtgtttgtagaattgatgttatgaagtgtgtggagacaacaggagaaacctgttgttttcttccaccatgtctcttctaggttatgcttattgtgctgggaaggtactgctctcctctctttgttcatctgtaaatcaagggtttgggtttttgtttttgagatggagtctcactgttgcacagtttgaagtgcagtggcatagttataatgatcatagcttactgcaactttgagttcctgggctcaagcggtcctcctgcctcagcctcccgagaaaccgggactacaggcgtaggccccacacctggctaattttttttttagtttttgtaggcacagggtcttgctatgtcgaccaggctggtgttgaactcctggcctcatgcgatcttcctgcctcagcctccagagcattgggattacaggtgtgagccgttgtgcccggcctgaagatggtttctaagatccttcacccttaaagttttaagtaattctgcctgctatgcaaaggatatgtttgaggagggcagggggtgacttaggaggatatcatccaacagcagtgaccagtgggaaggagactgtctcgccatcaggacttgtgtgacccacaggacgtgcatcatgcagccaagggagaacttaggtgacgcccagtttctggcttgggttctgggtgaatgtgataacatcgtggtgaaaaagccgagaaggagagaactctgcttggggatactgatgagttggaaaggccacagggatatggaggtggaggatgtgagggggagcggggatgggggtgggctgtccatagccctgaaagagagggcaccagggcctcccaggtctgggctggcagccacagttgaggttgcttttggtttacagtgtcgggctctatccgcctaagcacgcaatcaagtatggcttctccgcaaagatgatgaagaaggagagtctttacggactgacgattagggaagggggagaaaaggaaaataagcaaaaaatctgactcacatcttcatttttgagtggcagtcactgtctctttgatgttcaatgttcaagtttaaattcattgacggagactttcagttaaaaatgatggatcaaacataagcatttattttggttccatccccagaccctaataaaatgttaatcagtaaaatgtcaaaaatatacattttctaattttaaacatttcttaattttttatttttgtagagatggggtttcactttgttgccccaactggtctcaaactcctggcttcaagtgatcctcccgcctgggtagctcagattgcagacgcaagccaccacccttgacctcaaaaagatattttaaaaggcttaaactcatacgatagaaagaatgagaaaggagatattagccagtttggaagctagcgagtggtaaaggaagtgggatctcaaattgctagtgaagaaagcagagaaccaacctagtttaaactgcagaatcccctccaggctcaggaatgggcaggccagggctccagaggcgggcttgtggggccgtgaaatgaggaggatgtgttcaagtgcgtttaaaaagcagtgactctgtccttccctagagaaggacaggcctactctctggggagggtagagcagggtctctgggtttgggcaccaggcacagttgaaggtggggatactggcaaaatgggggattgagccaatacatatttttttggttgtgatttgctagttttcccctttgtcaatgaaagagcccactaatggggacaggcacagtggctcacgcctgtaatcctggcactatgcaaggccaaggtgggaggatcccttgagttcaggagttcaagaccaggttgggcaacacagggagacctcgactctacacaaaacaaaaattagccgggtgtggtggcacgcgcctgtggtccccagctactcgggaggctgagatgggaggatcccttgagcccaggaggttggggctgcagtaaggcgagatcgcaccactgtgccccagcctgggtggcagagtgagaccctgtctcaaaaaaataaataaaaataaataaatcccactctgttgacttaaaaataaataaataaacattttttggcaataaagctatgtattagggaaaatctcctacttacctgttgctctgcctttcccattagtatgtctgccattttatggtcaggtcaattttgaaattgtttaaagccaaatctccaaaggggtgttgaacttgattgttgatgttgagacgaaaatatcaatcatatttatatttaataccattctttaaaaatactcatctaggccaggcacggtggtcacgcctgtaatcccagcactttgggaagccagggcaggtggatcaccaggtcaggagttcgagaccagcctggccaagatggtgaaactccatctctactaaaaatacaaaaattagccgggtgtgatggtggtcacctgtaattccagctgctcgggacgctgaggcaggagaatcacttgaaccgggaggctgaggttgcagtgagttgagatcacatcactgcactctagcctgggcaacagagcaagactccatctcaaaaaaaaaaacttatcttttgctgggcgtggtggcttacacctgtaatcccagcactttgggaggctgaggcaggtggatcacctgaggtcaagagttcgagaccagactgaccaacatggtgaaaccccatctctactaaatacaaaaaatttgctgggcacggtggtgcatgcctctaatcccagctacctggaactacctggaaggctgaggcaggagaatcgcttgaacccaggaggtggaggttccagtgagccgagattgtgccattgcactccagcctgggcgacagagcaaaactccatctaaaaaaaaagaaaaaccaacttatctttactgataaagtgtactcatactatggtatatatatctcaaaaaatatttggaatatttttgtttccctttcttaacggattggaatgcacagttttgtaaactgtggggttaaacttctagctgaggtatttaatatcctaaatcagcttccaaatatctgaacttgattggcaaagtccagttttaacaaatgctgtgtgtagggagcacagcagagaactgggatgtctaacccaaggatcagggactaaggctcgttaattttgcccatgggagaagccccctcgaagctcattttatacataatgctaataagcttggtgatttggtttccaagtcaccaagaaattaggaaggacgggctgttaatgacggcaggatggtcacgaggaaaagtgacaactgtcggcaaaacaagagatggaaaaatatttttataaactcagtgctacaggccgggcatggtggctcacacctgtaatcccagcactttgggaggccgaggcaagtggatcacctaaggtcaggagttcaagaccagcctggccaacatggtaaaaccccatctctactagaaatacaaaaattagccgggcgtggtggcaggcacctgtaatcccagctacttaggaggctgaggcaggagaattgactgaacccaggaggcagaggtttcagtgagccaggatcgcgctgctgcactccagcctgcatgacagagcgggactccgtctcaaaaaacaaaaaaaaaaaaaaaaaaaaaaaaaaaaccataaaataaataaacttagcactacagtctggctgtttgatatggggtacaccaaaccctcaactcgaaagaacttgtcatcccttgttttaaggacacaggaaggtatacaatttaagaacaatttgtttttttaatcagaaaatgggagtgggggagtcctgcttaaaatagcaacccttagttatctggaaaatgttttcctgaacatcagtttcccgaaagttctgggttgctgagattttgttttagttttagcctagggatattactctattcttcttggttcttttattaattttcaaaatagttacaggtaataatacctaattatttcattgatacaacaattgatgtaactaattcagtatagtaaagaagcaaaaaatttttgcaaagaaaaattatatgagctggtagagttttgtttctgttctttttatccttctaagataaatcaatgtgattttacagattaatactgattatagcaactcttcttggaatacatttcttccacatacgtgtgaaagagtagttggaaatctcaagtttttaataaatcacatgatcattaaaatagccctgatcctatcttggggtacaaatacttagtgtgaaatgtgccccttccctgtttcagccttctgttttacctcctcattttcatgttctcccagatgttaaaagtgatcctggtatctgattcctctgtaccccggtgcttcctgcttgttcgctcatctttcttctgctgaaagctggacttgcttcttgttttgctttctttggtcaactgggttctggagaggcacttttctgatgaggaaaccccttctgtggtgtccccgaggcccctgctgggaggggctgctgagctgtgggctccttgagcctcctcgcagaagcgggtgatgagtatggactcataaacgcaaggccatgaaaccaatcctctgctttttccttgtaagccaacgacggggcctttgattccagactctaaggtagctttggagtccgtttcgtttccagcccactgctcagccatggcacagcacaggggtggagccacgggtagtaaaggcctgcagaagcacagagagatgcctgcgcccacctcgattttaaataccttcgtttaaaatttagaaaattcacttacttaacttttttttttttttggttggagtctcgctctatcacccagtctggagtgcagtggcgcaatctccgctcactgcagccacctcctcccaggttcaagcaattctgctgcctcagcctcccaagtagctgggattacaggcgccttccaccatgcctgactgatttttgtatttttagtagagacaggttttcgccatgttggccaggcaggtctcaaattcctgacctcaagtaatctgcccgcctcagccttccaaagtgctgggattataggcatgagccaccacacctggccagcttacttaactctcatattctgacatatactgtgtgtacacatcagaccacttgagaaacctcagtttgttttgaggaaaccagtaaggctgattccttgtgcttatatcccaaacttaaagttttatagagtttgttttttagtattcttattttaattttccctccactttattgtggtgtaattaaaattgtatctgttgaaggtatacagtgtgatgttttatatacacacgtcttttgaagtgatcaccagtccagttaattaacatatctatcacctcaaatagttacctttttgtgacaagcacacttaagatctgctgtctcagcaaatttcaagcacacaataccttattatcaactacagttactatcctgtatgttagatctccagaaaaagttttttggtttcttttcttgagacagtatctcgctccgtctcccaggctggagtgcagtagcaggatcaatcttagctcactgcagcctcaacctcctgtcctgggctcaagcaatcctcccatctcaccctcctgagtagctccctgggactacaagggcaccaccatgcctagctaattgttttatttttaatgttatttttgtagagatggagtgtcagtattttgcccaggctaatcttgaactcctgggctcaagcagtcctcctgccttggcctcccaaagtgttgggattacaggcatgagccaccacatccagcctcagaaaagttttataggatttaagtaataatattgtctgtattttattgaccttgtggcatcttcctgtgccaagcacttgatacaaacagtgtgaaatgatttgctctgtgctgatttgtggagggcacgcggggaacttgctgggaactcgctgggaacgtgggagctggtttctacattgtcactgtctgcacgtatcagctcttatttctgaatttggcttttttgcaggtccctagctgttggtagtaagtccggttataaatttttctccctttcttctgtggataagctggaacagatctatgaatgcagtaagtgtttgctttatttttccccttcttaaaaaaaaaaaaaaaagttgtacttgaattggaatgcgatctaaaattcagacgctgtggttgaagtccagacaccctcttaccagtcctctgcttccaccttcatctccccaagaggtggcaactggtgacacctgtggccgtctgccctgatctgtgcatttgcctacataggagggcaggtaccgagggagctctgttcatgagggtcttcagtacatgagcacataccatgtgtactggtctgtaacttctctcccttttaatgccatttaaaccgtctaaattactgtcataaagggcttccagaaaattgaaaattttacagcccctgtaggaacaatttattttcccgcgttggcattttacagcattgaagtggcccgcgtgtcggagaggcgcatggaacagcgggaggtcatgcgctttggcctcttgctcagtcatgttttgtgtggttctagatggattacttcatctctgggcctcagtttcttttattttttgcaaaacagaaataatgcaggtctgtaagattattgccaggattagagattatgtatgtgtgtacttaacagtgtgcaaaaatagtatttgctgagtaaagcctgtgatggagactgtgactggaagctttggaccctttccacgtgcgtaatttttaattaagatagttatggattcacatgtagttgcaggaaataatacaggtcccttgcatcctttaccctgttcttcccagtgtaacatctcgcaaagccccagtgtaatatcatagctgggatattgacatccacctctcctgagcacactctccagtcctccttgtgctcgtttgtgtgtgcgtaggttctgtgcagtcttttttgtttgtttttttttgagacggagttttgctcttactgcccaggctggagtgcagtggtgccatcttggctcaccgcaccctccgtctcccccaggttccagcgattctgaactttgtgctggtgacttttaattatggtgttctcctggcccgccagcaggtgcggcctttcggactcgctcctgggccctggcctcctctctgcaggtgagcctgcaggtgcccctcacctccatcggggatgtgtctgattcttcccagcagtgtctttcctgttgctgcccccaagagcaagtacccaggccctttgcagggagagagtggggcagcagaatttccatgatcagcgtccctgactcatggctcctggtggctggcttaggttttactcctttctttgtccttagacttgcctgctggtacttactaaatcttccaaaaaagcctttcttctgccacggaggctgggagatgtgatctgggcgataacataggtgtgagccagggctgtttatcccaggcgccgcccgccttcctgaagtcctgtcacctggctgccttcacgtgagccacacgggattgctccccacagtggtttctgcagtggagggcagccccgtctccaggcttttacgaatgactgaaactcagtccagatccagatgaagcgcctgaattgtgctgttaaattgttgctggagtcactgtagtcatctgttttgaaatgcacagaggtttttcccttgctgggggccagtgcttataaagagtggaagaatgccaaaacctggtctttccttttcctcaaattgaagtttagttactggcttctagtgccttatttcccagagatttttagtggaacaaaatgggatgtcttgatagtatcttttagagtggatattggccgggcgcagtggctcacgcctgtaatcccagcactttgtaaggccaggacaggcagatcacatgaggccaggagttgaagacgagcctggccaacatggcaaaaccctgtctctactaaaaatacaaaaaaattagccaggcatggtggcgcacacctgtaatcccagctaatagggaggctgaggcacgagaatcacttgaacccaggaggcagaggttgcagtgagccaagattgtgccattgcactccagcctcggtgacagtgagactctgtcttaataaataataaaaaataaagagtggatgtttcctgaccaacatggtaaggtgggtgcatgaatgtctgtgttcttcttagtgaactttggcccttaaaaatagatgatgaaatggacaaagaatgttttgagggttaatactttaaactgatctattacattgttctattccaagaatattatctgcctttcctctttcacactttttttttttagtagataagagaatgtctctagaaaacaggttagctactaagtgaaatgtcaagattgttttctagcatttttctataggtggactcagaggaaagaatgtttcttcatgtctcagtatttagttcaggctcagtattgacgtctaccctcaaaacttttaacaatccatcataaaatcagatctttgctgtcactcactgtggctgttacagaaagaatgggccagagctggtcttagagaaaaacaagatggacagctacttgttgttcttttgtttacttagaaaagaaaattcacacacacacacaaaagcttggtctagcagtactggaagatagattttctaccatcaatgttgtaatttcaaacttgaaagttgcaggaactgccagataggctttgcacattgtttatgggcgcctcatatatgtatatatatggggacagagtctcgctctgtcacccaggctggagtacagtggcataatcatagctcactgtacccttgacctcctgggctcaagcgatcctccctcctcagcctcctgagtagctgggaccacaggcacatgccactacacctggctgatttttttttaatttttgtagaaacggggtcttactatgttgcccaggctggtcttgaactcctggcctcaagcagtcctcccacctcagcctcccaaagtgctgggattataggcgtgagccactgcatccagcctctcatatgatcagtgctgggattacaggcgtgagccaccgcgcccggcctctcatatgatcattttctttctccatgtgcatttttgttgtcgtcattttttgaatatacataatgcacaaaatgtggtctcttttccctaaaatattctacaacagtatcctacactgttaggcaaaataaatgaagggtatgggtttattatttgtaaaagatcacaaaagtttagaagttggcttttttcaaaagctgcactgtgtgttttctttgcatttgctaaactggattctgagctaggaaaacatctcataaacattccgttctgaaacccagcacaagcagactgctccttagctcagcaaaagtgactacagcctgcgttgattatggaagtgtagctgttgacatataacatcttttatcaaccttcctgcttggccaagaaactaatcatttactttacgggccatcatctgcatcttaaggtttgagaaatggtgttttctgacgttagtcttatttgacaggcagtgcactggttggaatattaatttcagtgagatttatagtaatgtatcctacagaggagaaaccacgagcgtcccttggcctaaatctgtggtgctggaatgctggcctcttaccttgcatcctggcggagccgcagacacacacggaagtggattcaagcagttatttcatggcctcattcttcccttcccactccagagcttcatcgttgccaactataaaccacgccagcagaagcaaaaagcaacattcttttttaaatcaagtaattaatttcttagattttagtcaggcaatctctaggagggaagtttggcagaaagtgtggctgaggccacctagaatgagtgctaaaagcaaggcctcattcctccagtgggatggaagtcactaaagtttacgttcagcctttttttttttttttttttttttttgagacggagtgtcgctctgtagcccaggctggagtgtagtggcgcaatcttggctcactgcaagctccgcctcccggattcgcgccattctcctgcctcagcctcccgagtagcgccaccatgcccggctgattttttttgtgtgtgtatttttagtagagacagggtttcaccgtgttagccaggatggtctcgatctcctgacctcatgatccacccgcctcagcctcccaaagtgctgggattataggcgtgagccaccacaccctgccacgttcagtctttcttagtgtcagcgtgagtgcctcttggcactggtgtcctgggacgtgccatcttgagtcaatacatctgtgcagtctggtttctttgctttcttttgattattatggcatctttcacctagcagcctgatccattgtccaccattatttcatgggagggctgagccaggtttgtacttcagtttactggaaagtgattgttctgggtatgcgggttccatgtatatttatatgtttgaaagttcatctgggccgggcgcggtggctcacgcctgttatcccaacactttgggaggccgaggcgggtggatcacctgaggtgaggagttagagaccagcctggccaacatggtgaaaccgcgcctctactaaaaatataaaaattagccggacatggtggcgcgctcctgtaatcccagctactctgcaggctgaggtaggagaatcacttggacccgggagtcaaaggttgcagtgagtcaagattgtgccactgcgctccagcttgggctgtctcaaaaaaattaaaaataagaaagttcatctgtatgtgaagtgtaatagaaaaatattagagcatcttgaaataatacattagaaaaatggcaacaaacctaaactactagcaatatataaaagtaggttgctttctgaaaggtgtattcctgaaaagatctagtcagatttggtccgtagaacttaatgtcactgcgaagtgcatccttttgtgttatggctgttaccactactactactactgcgtttttttttttaaaacacagggtctcgctctgtcactcatgcagtggtgccagcacggctcactgtaacctcaacctcccgggctcaagtgatcctcccccttcttgcatagctgggactgactacaggtgcacaccaccatgcccagctaatttttttttaagagttggggtctcactgtgttgccaaggctggtcttgaactcgtgggctcaggccatcttcctgcctcagcctcctaaagtgctgggcctacaggtgtgagccaacatgcccggcctattagtcttttttttttgagacggagtctcgctgtatcatccaggctggagtgcagtggtgagatctcggctcactgcagcctccgcctcctgggttcaagcaattctcctgcctcagcctcccaaggagctgggattagaggcatgcaccaccacgcccggctacattttgtatttttagtagagacggggtttcaccatgttggctaggctggtctggaactcctgacctcaggttatccatccgcctcagcttcccaaagtgctgggattacaggcgcgagccactgcacccggccctggcctattagtcttaagtaatgacaaaaatatgttcactccagagtgattggtcgttcatttctgccttttgcagagccacctctcctacttttggttactgactcttgtaaatgtgatgagagttatagatctatctcccccagaacactcagtgtttagcatatggtttcagcgacgttagagattcaggaagcccatccagttatccacggacacctggtctttgcagttggccgtcacacttagtttctgtcctgcctctgctgctgcccatgtccccacaggaggaggtggctcactgtgcaacctccacctcccgagttcaagtgattctcctgccttagcctccttagtagctgggactacaggtatgtgtcaccacgctcagctaatttttctattttttttagtagagatggggtttcaccatattgggcaggctggtgttgaactcctgacctcaagtgatccacctgcctctgcctcccaaagtgctgggattataggcatgaaccatcgtgcctggccttatttacaattcttacatcaactcaaactgagttcttttttttttttcccccatgcagtcatgtgctgccactgttttttttttttttaactacctgtttctgccgtttgcctgtttttctgttgggttatttatctcctaatgacttaaagcaaattagccatttgttaggggttgcaaatattttttttttctggactgtcatttgccttttgaccttgtttatgattcttttcaccattctgaagtcttgaatttctatgtattcaaatgcattggtctttttttctaaggcttctaaatactagaaagggtttttcctgctcccagcatgtacataaaacatttcccaaggtggtcctgtaatactctggggtcatgttctaccttcaatacttggagtgtattggatgtaaggaatccctcccttgcattaaggggctgggaaggatgcttgcctgtgtccttacttatgtagaggggcttactctgaagcatttagggtgaatgtcagaaggagcttctcttccaaacttcaataaagaaaaaatcattgaagcaaaatggtagaaagttaatatttgttggattaggtgttgagtatatggaggttcattttactgttctcttttatgaatatttgcagttaaaaacgagcttttctgccttcatcctcccatccctgtttaaagcattctgaaagctctgctttttctcattaacattttagaaaaaccatttccaagtgatggttggtggtattaccttctcagcacctgcacgtaagcaactgaagacatcatttttctttctaacattttattaaaggaaattttcaaactgaaaagtggaaagtattttacagctaacacctgtgtatccaccacttagattcttcccttgacattttactatacttgtcctaacacacacacacacacagacaccatctatcttttttatgtttatttctttttttgagacagcatctagctctgtcacccaggctgccaggctggagtgcagtggtgcaatcatagcttgctacagctttgacctctggggctcaagcgatcctcctgcctctgcctccagagttgctgaggctacaggagtgcaccgccatgctcagctaatttttcgatttttttgtagggacacgatcttgttatgttgtccaggctagtctcaaactcctgggctcaagtgatccacatcagcctcccagagtgctgagattacagacaaaccaccacacctggctttattttgtgtgtgtgtgtgcatttccaggtagacggcaggcatcagtacatttctcctcaatactgagtagagttcaatgtttgtttttttcttgtaagataaaatttacttacagtggaatgcatctatcttgagtgaacactatgtgagttttaacaaatgcctgcatctctgtgaactgaaaccctatcaaggtttaccatcactccagaaagttctctcatacttccttccagtctcagctcccttctgcccacattccccaagaggcaaccagtgttctggtttttttctactgtagattagttttgtcttttctagaacttgatatgaatggagcatctactcttttgatgacgtttcttttgctctgcattttttttagatttatccacatcttatgtctcatttgcccagtatgtgaatatatgacagttgttgatgtattcttttcatgacagttatctgggctctttgtagttcagctattatgaacaaagctaccatgaacattctcgtacaagtcttttaatggacagatattttcacttagataaatattgtagtggaattgttggctagatatgtgtttagttttgtaagaaacccccataaccttctcctaagtgactataccatttgtggttctgtcagtgctgtatgagagttctgattgctctatgtcctcactaactttttttttttttttttttttgagagagtctctgtcgcccaggctggagtgcagtggcacaatctcggctcactgcaacctccacctctggggttcaagcagttctcctccctcagcctcccaagtagctgggattacaggtgtgcaccaccacacctggctaatttttgtatttttggtagagacggggtttcaccatgttggccaggctggcctgagactcctgacctcaggcgatccggccatctcgacctcccaaagtgctgggattacaggcgtgagccaccacacccagcctcctcaccaacttttgatattactagtttttttcttttcagcccttctgatgtgtgtataatgataacttcatggttttaatttgaatttctcaggtaactaatgatgttgaacattttcatgtgcttgttggccgtttatatatcttcctctgtgacatgtctgttccagtcttttgttgctttttaggtttggttgtttatctttttattatagagttgttagagctctttagatattctggataccagtcctttgtcagatatgttttgtgactatttctcctagtctgtggcttgcctgttttctttctttgagcaaatggtttaaattttgatgcagtcatatttatgttgtttttttttttccttccatttatggtttttgctttctaggccctgtccaggaaacttttgcctaccctgtagtcaggaaggtgttttcctatgtgttctgtgaaagctttatatagttaacactatacataaaagctaaagtttttatatttaagtcaataatctatctcattaatttttatgtatgttgtgaggtatgaatcaaggttgtttttttcctaatggattcctattccatcatcatttgttgagaagatttttcttccctcctgggattgctttggtgctttacagtcctgtgacctgtgagtctgtttctggactctttagtctcttctaatgatctatttgtcagtcttcaactttgttctttttcaggatagctttgcattttctagtttcttttcctttccatataaaatttaaaatccactttgtctgcaaaagagcctgttgggattatgattaggatgggattggacctagagatcagtttgagggttgatacgttaataatattgagtacccagaatatggtatatctcttcatttatttagctctttttaaatttgttttggtaatattctgtgatttttttttttttttttttttggtatggaggtcttacatcttttgtaaaatttattcctaatactttggattttgacattatcataaaagaaaattatttcactgagttttccagtttgctgctggcctaaacatatagttaattttttatattttaatcttgtatcctatgactttgctaaattcatatattaaatagttgctccatagattccttaagatggcagtgaaggctgtttgatgtcttgctttctaatgtttgtgccttttatttctttttcttgcctcactgcaacgtgtaagacctcgagcacaaagtaaggagagtgggtatccttgccttgtttctagtcttaacgggaagagatcaaatatcttcaccattaagtacagtgtcagctgtagattttcttaactgtttcttaaccttcatcagtgaaagaaggttcttcctaattccaggtttcttaggtttctaccatgaatgagcattgcattttctcatgctttttctgcatctgttgggttggcacagtctttctctgtgcagttgaattggaatttatcaccacctctaatggcgacttgctctttgagatgatcgtctcatactgttctcactttgaaatctcccacctccatcccatcacagttaacacctgctgctgcttcaagagaggttggtgctgtcggtctggggctcccttctctttccttcttcaggtgaccagccccctaagtggtttgttcctccaggcaagcagtctcaaccataaatccatctcagtatatctagtagctcctgtatttgaagacagaaacttcccttgcccatgcatatcccccagcccctcccatatttctacttctccagaacataacttctttttttgttttgtttttttggtttttttggtggagtctcgttgtgctgcccatgctggagtctggtggtgccatctcggctggctgcaacctccgtctctcaggttcaactgatgctcctgcctcagcctcccaagtagctgggattacaggcgcccaccgcgatgcccggctcattttttgtatttttagtagagatggggtttcatcatgttggccaggctggcctcgaacgcctgacctcaggtgatctgcctgcctcagcctcccaaagtgatgggactccaggcgtgagcccctgcgcctggcctgtagcataactcctatagatagttgcctaagtttttttccacttctcattctctttcatgtttcagccattcttcctacacatctccatcaaaatatgtcaaggtcgccatataagctcctcgttcccagactcaggggacgtgtctcatttcctcttccctcctctgcagtgctgggcacagttacctgcttgctgttcttcagatgccctcttctgttgacttccatctcatacacggtcttggcttttctcttactcaatctcctttgctgacctttggcagtttcggtgccacacagggccctgggcccacatctctttggcctcctctccgtgatggcaggcactgccctgtttaccactgtatacttgggatggtctctactggtgtaggatctgctgtttgtgttgaatgggtgaagtaaataagtcaagttttaccaagcaaagcagtaagaacctattctttgaaaaaaaataaaaatacagttgattcttgttgttcacagttctagtctgtaagtctctgggacgctggattagcgaatcatgaagtgttgctcccaggggaaggattggtaggtggcctctggtcgcaacattttcatcagctgatcaaaagacaacctcgttttgtgtgtgcttccctgcctcaagacatgctgacgtaatggggattgttggttcactaacattgaactcgcggctcgcatagaactcagcccacacatgtgctttctccgcggggtacatcccaggctgcttgtgcttagggatactcgacgacactcagcactgtgccagggccaacagtgaaatcaacaacaagcacaaaagtgcaaaaagcagacactcagtagccctatgtagaccaggaaaaggacagttgttttcagaatcaacacgagaagataggacgttgccctgtgtgacctcagccaggaacatgtgcatcatgtgactcaaatcttttcccgaggctgggagcggtggctcacgcctgtaatccaagcactttgggaggctgaggcgggtgcatcacctgaggtcaggagttcaagaccagcctggccaacatggtgaaaccctgtctctactaaaaatacaaaaattaggcaggcgtggtggcatgcaactgtagtcccagctactcaggaggctgaggcaggagaattgcttgaacccggaaggcagaggttgcagtgagtcgagatcacgccattgcactccagcctgggcaacaaaagcaaaactctgtctcaaaaaaataaaatcccacttcgcatgtgtctacggacggctgtaaaacaccgtgagtgtttatgcggggtcacaaagaaaccttacctagcaggtgagttcacagatactgagcctgtgcatgttgaggagcagccctatttggaagtaagttcttttcaccactgattggatttaggaggccagtggagaggccagtggatttaaataaaattgtacttaataaaaaaccagttttgtgtataccaggttttcctatgtgtcccaaccctgaagttaatgaagctgagagtccaactcttctttcaccattcaggaagtagatatcaggccttacagctaattagagcagagctgagactggaatgtgattgttaaactcgccttcctgcagggtcgccgtggcacccagtactcaccaaggttgcagtgccgcacacacgcccagtacatgtgttaggacgcgtgccgctgagcttcaccaagagcacttctgcctcttggatgtagcactggggttaacagcatttcaccacccactgaaactgaatggcacagagattgagttttgttttttgttgctgttgttgttgttttgatgtttttaaaacaacaccatttggggagtttggggaatatccaaaatctggtcataaggtccattccatccgttcagccagtgtggaaggagctcctcgtctatgacaggcgacattagacctgggggtggtgcagccgtgaatgggccaaacacggcacctgtcctcagaccatcagtccagcagggaactctgtctctcagccattgcctagattctcagtggtaagcgcggtgactactagaggcaacaggtacaggatgcaaccgggccagtgcgtgcagcccctaatactaccaagtactacctgagaatggggtgcctggagagtgagaggctagacagtggccggggaagggccttgtgcccctggatttgcacatctggctgccggatttgagaagtgagggtggcagcctcaggacaccagccatgatcatcattcagtcctaccctcctttttggggcaggactggtattacagacagggtctcgctcttttgcccaggctggcatgcaggaacgtgatcaccgctcattgcagcctcaacctcctgggatcaggcactcttcctacctcagctacacaggcatgcaccaccacgcccagctaatttttgtattttttgtagagataggacctcactatgttgcccaggctggtctcgaattcctgccctcaagcaatcctcccaccttggcctcccaaagtgcggggattacaggtgcgaagcaccgcatctggccccagccctctttctcgcccaccgcctagcaagcagggctgccgtgacttagtatccatgtcaatctcctgagggaaagaggggactggtcagagaaccagggtctgatctttagagaaattatttttactgcaaataattgacattctgggttatgcaccatctcttctgagttgggttggcctcgtgtctgagtggtgctgcatgccaggtgctagaggtgtatccgctgacaaagattcctgtgtccacgcactggcatgatccctcctgatcgtgcctttcgttgacagatcctggaagacggtggccgctagtctgagatgctgctgagcagagaagctgcagacagagcctgtcctccctggccccccgaccctgccaccatctccccatttgtggcagacgcttgcatctgttccttttgaatgaaggtcgcttgctgttgtcagaaagaaggtttatgacagctttctggtaaaagcaactgaaaagacactgaatggatgctgtgaagagcttaggatgatgtacttgtgtttatggcccgttccatttgaagtggtgtcgcactgcaggatggcgcgtaggtcagcgaggggccgcgggtgcgagggtggtcctgtgagaggagcaggccgtgtttttgctgcagctttcccatgtttcattcacacacacaagtacttgtcactgtgctgcagctggccacagtatccagttagtcacacgcagcgcaggtctgtagccaggagccacaggccacagcatacagcctaggggcatagtaggcctaccatctagatttgtgtttgcacgacacaattgcctacggggcttttctttgttttgttgttgttgttgttgttgttgttgttgttgtttttgagatggagtctcgctctgtggcccaggctggagtgcagtggcgcgattttggctcacttcaagctccgtcccccgggttcacaccgttctcctgcctcaggctcctgagtagctgggactacaggcgcccgccaccacgcctggctgattttttgtatttttagtagagatggggtttcaccatgttagccaggatggtcttaatctcccgaccttgtgatccacccacctcggcctcccaaagtgctgggattacaggcgtgagccaccgcgcccggccccttcagggcatttcttagaacgtatgtcagcgttttgtgacatgagtgtaatagcgacatctttttaataaatatgtgtcatgccactttggacatgtgtgattctttggccagcctcagtatgcgagcacgtaggctagcgctcagcacatgagtctatggaacccaggggaagcaattgcagtttcgtagtagtttgtgtcttaattaagggagcccctagaccttactctttcactttacctaggagtttggttcctaaactcaccattcaaatccagcaacagaactgactgaaaggaacctttgtctttcgtgtgaatgctcgtgaggggccatccttagagtggaaatgctcctgaggctccagcgaatcaagaccctcagacccccgggctgtccccaccccatgaccacatgttccgcaggcaccctcagcgctgtgccctgcgtgtcgcccaggcaggtgtttgtttttgagcgcagattctgcctgtggccatagccatgtggagatgttcacgcatgtacttccctttgtgatttcagccgatacggaagatgtgtgcattgtagagagattgttctccagcagcctagtggccatcgtcagccttaaagcaccaaggaagctaaaggtttgccactttaagaagggaactgagatctgcaactacagctactccaacacgattctggctgtgaagctcaacaggcaggtgagcgctgccccagctgggtgtgggcttgtctgttgctccctccagcactctgggacaagcccaccccaccggcatgcccctccgtcattcccttgctgcctggccccacgttgccgggcacagatccttgcctacagagaccagctctgtttcctcacccaccagctttgctcagcccattccattcacgacaaatgcccgggcctctgccacactgctcccatacaggcgtccccggccccacccagagggtggatggcagtctctttcacctattacctggttttgcttttataaatgttacttaaaaaaaatatatttggccgagcacagtggctcacgcctgtaatccccacactttgggaggccgaggcgggcagattgcctgaggtcaggaatttgagatcagcctggccaacatgatgaaaccccgtctctactaaaaatacaaaaattagccgggcatggtggcaggcacctgtaatcccggctactcgggaggctgaggcaggaaaatcgcttgaacccgggagtcggaagttgcagtgagccaaggtcatgtcattgcactccagcttgggcaacaagagtgagacttcgtctcaaaaaaaaaacttacagacttttttttccttttgtaaattgttagtttaactttgaattcaagatgaaggatttattactttatctccccctaaactaataagactgtctggcacagaggaaggacgtggtgggtggcatgtgtgcgtgtttcacgcacgtgtgtgtgtctcccagcttgtgctcacgcccagggtaacagcaccacccgggagacccctggcaatctgattctgcccgcactccctgcagggaaagctgattaggctgctggctgtagagtggacatgatgacagccagtagctgcaccctgagatacagtgactaggtgaagtcacagtagagacgttcttgccttacgcagttgaaactaggaagtggtctgttaactgacatagttggttagaatgggaaattataagacatcatatcttgagcatttaaaaattgtgttcacgtccaactaatgtagagctggtcatctttcttgcataagttgtctcagcgatgcatcgtctgcatgtctacattcattttcttccaaatggagcaggaacttgcaaagtaatctgagtgcacaataaaatgttagaccttttaaaacccccttattttcattttacctgtgctgcactcagcatcagttttaaaaagcaaatctttccaaatctattcacagcacacttgtcttagctgtaggttagcatttgcctaacactaaactaaatggcctggttagaattcccagtagagatggggtgagtatgagggagaggtgcatccggcctggctccttcttgattgttgatggaaagcagctgtatccttggcgcttctaacattggtctgcatggtgttctagaaggaactaagattgtgaagccaacgcaggggtggatcacctgaggtcaggagtccaagaccagcctggccaacatggtgaaaccccatctctactaaaaatacaaaaattagccaggcctggtggcagtcacctgtaattccagctacttgggaggctgaggcaggaaaatcacttgaacccggaaggcagaggttgcagtgagccgagatcacaccactgcactccagcccgggtgacacagcgagacactgactccaaaaaaataaaatacaataacaatagaaggaatgagagcgtcatagtccaggagtcagtcaactggagattggggcaggtattgcactggccgttgcttcacgtttggtttcgttttgtctctcgcctagaggctgatagtatgcctggaggagtccctgtacatccacaacattcgggacatgaaggtgctgcatacgatcagggagacgcctccaaaccctgcaggtgagctaacttgtgaggagagaatcccatttttctgattttgcccttgaaagatagctataggtgagagagattttttctttttataggttccgcagatgagacagattttaaaagtattgatcccaaaccaagctgccttcctactgatgctggtcatgtgaccacataagctcattggtttgatcaactttcaagtttgaggttactgatcagttcaaaccaaaggcctttaatctcttgacaatactggtatcacctaaggtggggatttggggttgcagaactttcctaacacagcaaacaagattgtatccaagctattatttgttcctaatgctctgttaaatgaatgctgaattatgtctgacatccaagaaggaactctcaggtggaagtttgcatctcgtcctccgtgtgtcatttgcaggcctgtgtgcgctgtcaatcaacaacgacaactgctacttggcgtacccagggagcgcgaccatcggagaggtgcaggtcttcgataccattaatttggtgagatgcctttcctgctcgaatagctctctaaagtgtggctttttcctgaagaggagcactgtggtgtccctggcatcctgacttggctcagcaatacaaccgctgcacttttttgtttgtttgtttgtttttgagacagggtctggctctgtcgcccatgctggagtgcagtggtgcagtcctagctcactgcagcctcaacctcctgggctcaattgatcctcctgcctcagcctcccgaggagttacagtcatgcaacaccacacccagctaattttttatttttgtagagatggagtcttgctgggttgcccaggctggcctcaaactcctggccttaagccatcctcccgcctcggccccctaaagtgctgggactacaggcgggtgccccgcgcccagccccactgctctcttctcagtagcagagtaggtctggctcattctgcttctggatctgctgcggcgttcagagcagtgctgagctcctcgccacgggaatgtttgaaggaacatagaaaaccttagggataaattgctttgctttttctaaagttggagcagcatttccttggatgcccagccccagtaaatcaagtgggtttggcatttgtttggaccgtaatggtgttttaggaacagctaattggcacttgcggaccaagtgtcagccctggggcgtgggcggtcactgtgcggtggccactctttattggtgtccctttttcagagagctgcaaacatgattccggctcacgacagtcctttagcggcactggcctttgacgcaagtggaactaaacttgccacggcttcggagaaggtgagtctgcttttccccgggggagcactggtgccaaggcgtccacagactttttcagttctgttcacacagccaccttagaggcaaggtcctatacttaccagctccgggagaagcaaagacagccacccacttgtcaggccacaggcgtgtactgcccgagagtgagcggagcttgcagtgtgccactgggacgggagagctggtccacatttgtagtagaaaatacagaaatgtccagaggagacagaagtgccgtgtgtaaccacaccgctcacccagtgtgtttctaaatgatgaaactaccacataacagtaaagaacccagacagtgatgaaatgtgaaaaagcaaagacagaattctatccagccagtctgaacacatttcagtgtatttcattttctctttagtcaacaaaattgggatcctactatgggtataatttatcctttttcactctgcatgacatttgtctaagttcaaaaacacttgtaatggccgcgcagtatttagttgtgattcatgtcaacatcacccttttgggactttgtttctaatatgttgctgccgtaggtagtagtgtatttaagtcatgtatcaatgttttatatgtatttctaactatgaattcaagagattccagtaagaagaatgtctggctttaaaggagatggcctctaaatgtccccgtgtacctgtgaccgcgtggcgaggctccctggcccccaggagactgaaggctccttgttctcttcctcatttggactgtgcctctcttttcgtttcagttcctcttttcttgaaagttgcgtcttccattcttctgtcttgaggtcgcgtctgttctcccgcctccgttttctccgctcttcattggccaccgatgacctttactttgatttggatatgattttgcttctcattgaaatcctaaaatagcctcccctttcaagccatctctcccctcaaactattgaccagagaagatacaataaaacgtcggctcacttccttagctttcctgcctgggcctttgttcttcagtctcacacccgagttctgtaataatgatgtcaccgcttatgggtcacttctgggtcgtgaattatcctggatcttttatcttcattacctcatttgtttcccctcagcaaggtaaacagttctctgtttcatagcaagggctcagaaaggttaagcggtgtgcccggggccgcccaactgggcagcaacagaggggtcagactccaagtctgactttgattctaattatgctagactatcccaatagcaccttgtccttttcttttccctttgaaatggccctgaaattctgttaccctttgactaatcaaagtctcactgttaatgtttctttagtagctcttataaaggcccaaaagtacttgatggaattttaaggcccataaaaatagatttttttttttctggactataaagaggaaccttgattgcttgtacatggaatgctctcatctgtggagtgagagcagcaaggccttcccagccccgctctgtcccaggtgctgaggccccctgaggcctgtgacttaatcctgctttcaagaatcttgcggtcatgtggcaacaaaacaactcttaattaattagtattgcacggtagacgtgcgccacaaaattatgtctcatctgaaagtttaggctgcagaggacaaaacctttgccgtggttatttttgtatatggatgcagaaaatagttcattctctaattctcaatgttacaagctcagtttgtgtccctccatccagagagaaccaagtgttctcaagtaccagttttttttttttttgagacagggtcatgcttgctctgtcacccaggctggagtgcagtggcacaatctctgctctatgcaacctccatctcccaggcttaagtgatcttcctacttcagcctcccaagtagctgggactacaggcacctgccaccacgcccggctaattgttgtactttttgtagagatggggtttcaccctgttggccaggctggtttcaaactcctgagctcaagcgatctacaaacctcagcctcccaaagtgctagaattacaggagtgagccactgtgcctggcctatattctgatttctaatagctgtatactatcccattgtatgagtttaccataatttatgtaaacagttccttggtgttctacacttaggtcatctgctgctttttgctttttttttttttttgaaacggagtcttgttctgtcccccaggctggagtgcagtgtggtatgatctcagctcaccacaacctctgcctcccaggttcaagcagttctcctgccgcagcctcctgagtagctgagattacaagcgcgcgccaccacacccagctaatttttgtattttgagtagatggggtttaaccacgttggccaggctggtcgtgaactcctgacctcgtgatccacccgccttggcctcccaaagtgctgggattacaggagtgagccaccacgcccagccactttttactatttacaaacacagagatagtgcagtggcatgatcatggctcactgcagcttccactcctgggacaacaggaacgaatcatcaggcttagctgatttttttgttttttgtagaggtggggtcttgttatgttgcccaggctggtcttgaactcctggactctagtgtttctcctgtcttggcctccccaagtgctgggattacaggcatgagttactgcattcagcttagatagtcttttctttctttctttctttcttttttttgagacagagtctctctgtagcccaagctggagtgcaatggcgcgatctcagctcactgcagcctccacctctggggctcaagcgattctcgtgcctcagcctcccaactagctgggactacaggtgcgtgccaccacacccacctaatttttttttttttttttttttgagacggagtcttgctgtgtcacccaggctcaagtgcagtggtatgatctcggctcactgcaacctccgcctcctgggttcaagcgattctcctgcctcagcctcctgagtagctgggattacaggcatgcgccaccatgcccagctaattttgtatttttagtagagacggggtttcaccatgttggccaggctggtctggaactcctcacctcaggtgaccactcacctcgggctcccaaagcttgggattacaggcgtgagtcaccgcacctggcccacacccagctaattcttttgtattttagtagagatgggggtttcaccatgttgcccagggtggtctcgaactcctcacctcaggagatctgcccaccttgaccttccatcagcctagatattcttaacagtttttatatttaacagtttgaacctcctaaaatttgtatagtaggagggtgaatgttgaataattcttcctgccctgcaaatttggaatgctacccattttaaggcctttctttccatcagtctatttctttttgtgctaatttaataccgttatatcacttgatagtattcttttaatattaaagcattcaaagtcctgctcgttattttcttggcgcttctctgtttattcccccagatgttcatgtctgtctcatcatccacagatctgatattaacttgggggaagttggcatcttcaagacacttcccattaaagcaggcacatgccgagctcccttgtattcctagttctttgtcttagtaagattttcttcatgtgcatcttaccatttggtgagttgggattgactccttataaggtagttgagatttccagctaatcggctctctggatccgtaactgaatttaaagtggcaggaaagaccttggtggggtccgaagcctcgtcagaccacaaggtcttgcccgtgtaccacacacaaatccaggcttttattttttttttttttccccccccgagatggagtcttgctccagagctggagtgcagtggtgcagtctcggctcactgcaacctccacctcctgggttcaagcgattcttctgcctcagcctcccgagtagttgggattacaggcatgcgccaccacacccagctaattttgtatttttagtagagacacagtttctccatgttggtcaggctggtctcaaactcctgacctctgatgatctgcccgcctcggcctcccaaagttctgggattacaggcgtgagccaccacgcccggcccaggcttttatttttaatagtttaaacttcagatgactcagaacaatagaatgatatgccacttttgccctgaagactgttagtgttgagagtaagtagtcatttaaaataggtttaaagagaagattgaacattaagtcaacaatagaacaggggagtgtttttctatgctcgtggcaaaaagtgtggagatgatgttcaaggggggccctgggggaccccagactccttggtggcccagggcagagctgtcctggagatagccgtgtggcgcatttgcagtctgctgtgaaagatgggaaattcctgttttaactcagctcaaattcttcttttctcttttccttccacaggggaccgtgattagggtattttccattccagaaggacaaaaactctttgagtttcggagaggagtaaagaggtaaagtacgtgaatgtccagaatggattctggaggttgtatttggatttcagttttatgttatctatgaacaaacaagtagaacccccaggagaattccacacgagcatttctagcccggctgggtcaccgggtaagatctgggcgtcggtcttgtcatgggaattgaagagcactttcagaaaagcaaattgggtttttgtttgcgatcccaccagctagcgtgagagttgtgaagagctcacgcaaccaggtgggccctccagtgcccggcagctcccagcctgctgtaagggacggggcggcgacgtcatgggtagcacaccctcccctttaaaggccacgctctgagaacctgttccagctctccagctccgcctccaccctcagcaaatggcattggccccttcttttaacccagaagccgcagcctggagttctcttgtcttcctccctccaggctgcaaagcttccctcatcggtgcttacatgcctcctgtggcgcctgctttggaggcaggactgtccctccctcgtcggacagtagagcgggggaggcctcgggctctggagcccgtgcctcagattggagccctagggagcactttcagtcgcatggccgtggtcggcgggaccccacctcaggtctgtggctccacgtctcggatcagtacctccctccctgaaggtggctgttgaaagaggaggggctgtctttcggggactctcccgccatctggtcccctttcctcatgggatccccacaggtgcagcaggtgcacctcagtatccccaaacgtcaccgctcctccagctcctgcctcctcgtgtcccttggtcttcttccttacaccacatctttctggagttttcctgtgttgctgcttctgcccagttcccctcctgtgcctgtttctgccctggagccgctcttcacccaacccccttcctcacccccgtggcctgtgtgtgtgctgatcccggggctggacgtgtagcctggcttccttcttgaggtgcccgtattcctcctgcctgctgggcactgggcacctcaagccaccaggccagtttgcccctggcccctcgtccctcacactccccatcttggtaaatagcgccacttgccacccccgccagcaccctggcacccaagccagagggactcggccctgcatccttccgcctgaatggtgcctccagggagctcccacctgtgggcccgccctgtgcctctcccgccacgccacctgatccaggctttgcctggtttctgctgttgccctggattcctgtcaggccgttcttcagactctcacccaggctgtttgaaaaatgtaaatataatccaatcacaccccacctgacatctcccaccacacctctgtcctgcaggattagccccaggcccctgccttggttcagcaggcctcccggcaccagcccttccgcccagcctgattctgtttcactgtccctgtcctggctccagcagtaccgcactttcagatcctcagaagagccgatctcttttatccaccagggtcttgcgtgagctggcagatctggtggcctggccggcttctgtaaccctgggagtccaagtcgagtgtcgccctcgaggaggcctttttttgatccttgggttaaatccctttctccatgcgtctctagtgccttccacgtatttttctcacattcctttgcctgtggcaaatggaatatttgggtgaccgcccaaggggttcaccttgcccgctgcctaggcagagccgattcatcaagatgggaattgcagtagagaaagtaattcatgcagagctggccatgcgggaggctggagttttactactactcaaatcagtctgtctgagcattcagggagcagagtttttaaggataacttgggtggggagaagccagtgagccaggagggctgactggtcagagatgaaatgttagggagtcggagctgtcttcttgcactcagtgagttcctggctgggggccacaagatcagatgagccagttcattgatctgtgtggggccgccggatccatcaagtgcagggtctgcaaaataccataagcaaactttctcccaaagttaattcagcctatgcccggggaggaacaaggacggcttggagatgacaagcaagatggagtcagcaaagctagatctcgttcaccgtctcagtcataattttgcaaaggcggtttcgtttgcacctccctgaccccacccccatcgctggatgctgcattaaggcgagaacattcctaattcatacacatggtcaacactgactccaggaaaaccccttgctattacggacagggctaaaagtatcttgtatttctagggttatgaagaaattcacatgaatttagtggctttgggatgccgattgatttttaagacacactggagccactttccctgttgaaagttttgctctgtctttttttttttttaaataattgagacagagtctcactctgtcgcccaggctggagtgcagtggtgcgatctcagctcactgcaacctctgcctcccaggttcaagcaattctcctgcctcagcctcccgagtagctgggactacaggcacccgccaccacgcccagctaatttttgtaattttagtagagacggggggtttcaccatgttggccaggatggtctcgatatcttgacctcatgatccgcccaccttggcctcccaaagtgctgggattacaagcttgagccaccgtgcccggccctttgctctgttcttaaactttactgaggttgccgatttaccctctggtgtggaaagaatggctgtaacttaaattactgagttttcttttactcaccttaggactataaatccatcctacttcagctaaaagtggtttagtgaaatcctactccttttgtcatgtggaagcttgcagctgtgttaacgaattgttcttagtatttccttttgaacattttcctctctcaaggaaaatgtttgagaaggtggctagaggggaataaaacttaccagcaggcccaagtgtgcccgtgacaggaactcttctccgccacttgagttgaacccctggggcagctgctggctccggtggcccgccccaacctgtgcgtctccccaggtgcgtgagcatctgctccctggccttcagcatggacggcatgttcctctccgcctccagcaacactgagaccgtgcacatcttcaaactcgagactgtgaaagaaaagtgagttgcaaatatacgtttctttaaaaatgatgcaaaaccctttgtccccacttgctgccgggatgagaggtaagcacggacccgcccaccctctgacatcgttagccagtgaagaccccggagctggccatggagcgagcacctccgcatccaggctcggcagtgaggaggatgggccccagcagatgagcttctcccacaggcagcacgcagggtagacagagccctcgcgtagggcatggagggcccaggtggacatccttttgtcagtgaagatggcctctcctcaggttcccctcacgacaaaagcgtttgtgatcagacagcccactagggtgaatggctcgtctcttaccttcccacgggtaagcagagacatggacggcttccacaagaatttattatcgcaatgaatgtgtagcatgaggggggtcttatcttttaagaggggcttactctgttgcccaggctgcagtgcagtggtacagtcattacttattgtagcctctagctgctgggctcaagcgatcctcctgcctcagcctcctgagtacctgggactataggcgtgcaccatgcctggctaatttttaaaattttgtagagacagaatttcgctgtgttgcccaggctggtctggaattcctgggctcaagtgatctgccggtgagccaccgcgcccagcctgtctttaaaaattttaaaaagaacatcccactcagaccagcgttaacaataacatactttaggtggtcaaaaataataaattttgttgggtatatttcatcacaatttttaaaaagacaaatggagcatgccccgccctcccccccaaaaaagatgaatagcaacacaaacaggatacgggaaaataacattttggggtctatactcaaggtttttggagacttctattacagagacctagcaggggtcatcagttaggccctagacgtcctcacacccttgcaaaggggatgtgtggtcagctgccacgtcttgtccgtggccaaaggctgtagctcctccctgaagcctgagcacccctcccccgacacctcccagaggaagctccgtgatgcccctggggccctgagtgtctgcttataaccaaccctgtttaattttcctgtgaagaatggagacttttgctgtcggctccagagctgtgcgtctgtgtgagtagggggtggccgtccccccagggagggtgcagcttcatgtgtctggtggcctttccttccagacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacgtgagtagagccggcgcctccgtcccccaccccgtgtgcctcaggccgaggggcccagtcctggcggcttgtggccccttccgtgcttctgaacaggagcagcttcttagagccgacactccatcgagagttgtcggggatgggaggtcccctggcaggcactaggcttgccgctctgtgcgggggtccatttccagacgggctcccgttctgtttttgtggatagtctgcggtattaatgaaagacgttaagtcaaacctcgtgagtgtgccgtagttaaccctttggggccacagaaaccgcacttgccgagtctcaggcatccgtccggctccagggtctggcctcagaacacacacagggcctgtggaggttctgtgctgcgtgcgggaaagattgtcattacacccagtgatggcagggctttgggcttccgtgcgtctttaaacatcattttccagttttgttatctgactagcatcctggaaaacttctctgacgatgactacctataataatcccagaagccacaaaactggtttcatcccgctctcgtctcccgtgggcttcagggctcagcacacgagtgcagccttggccgtgtgagccgaggtcagtggggcgccagacacctgcagctgcccttgtgctcatcttgctggggtctctttcctcgcctgccaaaagtgaggccgccatgtagtaagaccgtttctgtgacagttgtctagaatttggctgctctttattctccctagaattcagaagatcccgcggttgttggtgggtgccgccgacgggtacctgtacatgtacaacctggacccccaggagggcggcgagtgtgccctgatgaagcagcaccggtgagtctgctccggccgcttcacggagctgctccgtgctggcggggggctttcggggcacctggcgaacgtttgtttatttccttgcaaaccagtgacatagaggggcagattccagcacagcggcccatgccgcgcaggtcgggagcttcgctttcccaggtgaaatcaatgccgccgcaagacagggagccccgggctgcggctggtggcgtcagggctccctcagggactgggcacagaggcgacgcaggggtggcgggagccgcatttgttcttaggtgggggagaggtgctgggaggccaggccttcctccccagggtggagtttcgcatttggaaaggaagggcgcagcgtggtggcctccacaattcagtgcacgtggctgagagcctcttgtctcactgtgaggtacaggtttgttcttggaaaacagggagttaacatttgttcattgggaagtaatgcattttcattctgtcttacatgttttttaatgatcaaaaagttctaacaacatataattttttattttagagatagggtctcaccctcgcccaggctggagagcagtggtgcagtcacagctcactgcagccttgacctcccaggttcaagggatccttccacctcagcctccctagtagctgggactacaggcacacagcacatccagctaattactttcttgtgcagggtcttgctaggttgtccaggctggtctggaactcctaggctcaagtgagcctcctgccttggcctccccaagtgttggggtaacaggagtgagccgctgcacctagctttttgtgtgtgtgtgtgaaatggagtctcactctgtcacccaggctggagtacagtggcgcgatctcggctcactgcaatctccgcctcccaggttcaagcgattctcctgcctcagcctcccgagtagctgggatgacaggtgcatgccaccatgccctgctaattttttgtatttttagtagagacggggtttcactgtgttagccaggatggtctccgtctcctgacctcgtgatccgcccgcctcagcctcccaaagtgctgggattacaggcgtgagccactgcacccgggctagcctgactttttttgtaaatagtgaatcctcgttattagttagttcttccattgtaaaagtgaaatattgtcttgttaggtataactccctctttagactttccatgtaaaactcttcatgtaaaaacgtgtgcagatagacgagattaaagttgccacggcgtgatgaatgcctggcgtcctgtgtggtgagtggtgtgctggctctgttgccgcagggcagccagtgtgtactgcccgcagggctgccctgtgtggagacgctgagctgtgtcgctttcttccctccaggctggacggcagtctggaaacgaccaatgagatcttggactctgcctctcacgactgccccttagtcactcagacatacggcgcagctgcaggaaaaggtacttacgtgccttcatccccaacgagacttggtaaggggcgtgacgcaaacctggaaggtaattagccccacagccccgagtgctactgccttctgctggctccggagccaccccaccagctcctcactgggaaagatggggactggttctgagaacataagcgaggttggtaaatgggtgttcccaaggcctctctcaaggctgaattcagtttcgtttccttttttttttttttttttaaaggagagatggggtttccctatgttgcccagggtggtctcaaactcctcctgggctcaagtgattctcccgcctcagcctcccacagtgctgggattataggcatgagccaccgtaccaggctcattttctccgtttttaaagaaaatgtcatcctggctcaggtgactctggggtcacgtgacttgggcccagactggccacctctcagccaagataccaccctgaaaagtactgccaagggttttgcctcagtcttttccctcccacctttttcgtccttcagcaaatctgcatcgagtactgccttcatgctgggcctgtgaagtgcagaagctgtaggggaatgaggccaatgggctcccctccggcggcagcactaagacccatgcatgagatcctccagccacagccttggctatgtgagccaccttcttaaaaaagccaactcgcactccagtgggagagcctgtggttttgcacccacgcagggctgtgcctgctcgctgccactcccatctgtgaaccggcacttccagttcatgagcccaccctgagagtctcctagtgtcattttttttcctggtgttatttttgagctcttaaccagcttgagagagtttgtggcccgtccatgagggagcctctgtttactgtgcaggcatcattttgacatttatgaatgtcagagaacaaatgacttcatctcgagctgcctaaggctgcaaagagttcattagaaagcaatcagaattcagaacgtcttagtacaggcttcagtttataaatatacaccagtgtttccaaaacacagtcctcagtgtgtgtcatggggtctgtggtgtgtccccagcctttgaagggtgacttcgtcgtctctttgcagcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacataaatgtgtcttctgcaattaaacacgatttttattcagttctggtttttgaataagccaggcgggagggaggtgacaatacgggtaagaagtgtaattcagaggctaggcacggtggctcacacctgtaatcccagcactttgggaggccaaggtgggcggatcacttgaggttaggaattcgagaccagcctggccaacatggtgaaacgacatttctactaaaaatacaaaaattagctgggggggtggggcgggggatggtgcacgtctgtaatcccagctacttgggaggctgaagcaggagaatcgcttgaacctgggaggcagaggttgccaggagccaagattgcatcagtgcactgcagcctaggcgacagagcaagactctgtctcaaaaaaaaaaagtgtaattcacatggaggttacacgtgggtctctttcatccccgccttttctcaacaccaagcttaacgggcaggtggtgcgagctggtctgggaggtggtgggcgccctggaacagcaggccctgcccctgtcaggggacccaggagctccatggctgccgttccctgccacagagagaactgggtgattcttcccacgcacggtttcatttggagaggggagagagggagtcttcctacctccacaaccagcagtgggctccatgtgtaaaaggccgggagtgctttggccacagcttagccaaggaaacgggacaaggggtggcagaaaacatgctcatccctgttgctcgtctggtttttttggtttagttttttgtttgggggtttttgtggttttttttttttgagactgagtctcgctctgtcgcccaggctggagtgcagtggcacgatctcggctcactgcaacgtgcacctcctgggttcaagcaattctccctcagcctcctaagtagctgggactataggcacgcaccaccacgtccggctaatttttgtatttttagtagagaccgggtttcaccatgttggccaggctggtctcgaactcctgacctcaagtgatccacccgcctcggcctcccaaagtgctgagattatagccatgagccacctcgccccgctgctcgtggttttcataaccacattggcaaagggtggggatgggccaggcttgttgtttcgtgtgtcccctgccctacatctttgtagaccagacctttgcatgcagggaatgaccgagtcacttgtttgaaatgtacatgaggtggctcatgcctgtaatcccaaccctttgggaggcagaagcgggcggatcatctaaggtcaggagttcgaggccagcctggccaacatggcaaaacctgtctctactaaaaatacaaaaagtaaccaggcgtggtggtgggtgcctgtaatcccagctactctggaggctgaggcaggacagttgcttgaaaccgggaggtggaggttgcagtgagctgagtcatgccactgcactctcacctgggcaacagagtgagactgtctcaaaaaagaaaaagaaaaagaaacggacatgtgacaccatggccagcaagcaggaaatccaaatgcgttattttacaagcgtacttaagagagaggcgggaccgttcggcttcagctctgtggtgttggagatgtaaaaagaacgtgcagggaaaccgtgggacttctgtttgggtcgcctccctgctttacatagaattctcttttttatgacttatttcttactgaaaatatatcatgataatcattggccaagcagatagggtttttctgacgtatcttttagttctgacccaggtcataacccttcacctatgtcataccttttcaatctgtgggtttttctgaagcacaaaaacaaaacaaaaccaatctcagggttttgagatgtgaccagttcttacccttccctaataaccagctaggaaagtctctaatttagaaaaatgaggccgggcgcggtggctcatgcctattgtaatcccagcactttgggaggccaaggcgggtggatcacaaggtcaggcgtttgagaccagcttgaccaacatggtgaaaccccgtctctactaaaaatacatgggcatggtggcatgtgcctgtaatcccagcaactcaggaggctgaggcaggagaatcgcttgaacccgggaggcagagtttgcagtgaacagagatcatgccactgcactccagcctgggtgacagagcacagctctgtctcaaaaaaaaaaaaaagaaaaaagaaaaatgaaatctttctaaagttcagaatgtgaagagactgtcttgattcctcacctctacatcgtttctttctatagttagttataatgtaaatagattcctcttaacacttcattttaggtgaagctgtttttggtgctgccagtgtgcgtgcatgtgtgtgtgtgtgtgtgtctgtgagtgtgtgtgtgtgtgcctgcctgagcttcaggtgaacatactgattacattcccccaccaaatctgactgaaagcccattgctatcagcattttataacacgctaaagaattggacgtggtggctcacacctataatcccagcttcttgggaggccaaggcaggaggatcgcttgagaccagcaatttgaggcaaggccagtctggaccacatagcaagaccccctctcttaaaattaaaacctgtgttctatttttttgttgcctactcacaggctgaacatctcatttgtttttgtttgtttggtttgtttttgagacagtctcactctgtcacccaggctggagtgcagtggtgcgatctcagctcactgcaacctctgcctcccaagttcaagcgattctcctgcctcagcctcctgagtagctgggattacaggtgcccaccaccacgcaaggctaatttttgtacttttagtagagacggggtttcaccacgttggtcagactggtctcgaattcctgacttcgtgatccacccacctcggcctcccgaagtactgggattacaggcatgagccaccgagcccagccttaaacatctaatttgtaccaaattgccctataattctacctagaatattatagcaaaatgccagaagcctgactaaaatcttttaaagaaacccaactcggccaggcgtggtggctcacacctgtaatcccagcactttgggaggccgaggcgggtggatcacgaggtcaggagatcgagatagtcctggctaacacggtgaaaccccgtctctactaaaaatacaaaaaagtagccgggcgtggttgcaggcgcctgtagtttcagctactcgggaggctgaggcaggagaatggcctgaacccgggaggtggagcttgcagtaagccgagatcgcccactgcactccagcctggcgacagagtgagcctccgtctcaaaaaaaaaaaaaagaaaaagaaaaaagaaaacaaaaagaaacccagctctcccagggtggggggcattacacaggggagcccctccgggtgtcgccgcagctgaatgattgcgttggtggaacagctggcccgcttgtgcgtgggccaggacacggtggacctgttccgcctgcgttcttgccggtccatgtttggattagcatgtgagtttaaacatagtgctgatgcggcgattcttctagaagcacatccttctctgagctgaattgcttcatcacacacttccttctggcttggggagttccttttcatcaaaggccaagccttgtgtgtttcggtcctgcccatctccgtgcggcctgcgggacgttggttggcgtggagtcttcacagccggctgtccaggctggcagctctcccatcagggcttctcacagccaccgtctgtctgagcagacgctgagcatcgtgtcatccctcggacacacacaagactccactattccctgtgctgatttctgtttctgttacagcttctgcttctgattttattttttttttctttgagatgggagtctcgctctgtagcccaggctggagtgcaatgacatgatcttgggtcactgcaacctccacctctcaggttcaagcagttctcctgcctcagcctctggagtagctgggattacaggtgcgcaccaccaagcctggataattttgcatgtttctgtagagacgaggttccaccatgtttccaaggctgttctcaaactcctggcctcggccgggcgcggtggctcacgcctgtaatcccagcactttgggaggctgaagtgggcggatcacctgaggtcaggagttcgagaccagcctggccaatatggtgaaaccccgtctctactaaaaaagaaaaaaaaattagcctggcttggtggtgcgcccctgtagtcccagctactcgggaggctgaggcagaagaatcacttgaacctgcgagacggaggttgcagtgagccaagatcacgccactgcactccaggctgggcgacagagcaagactctgtcacaaaaaacaaacaaacaaacaaacaaaaaaacctcctgacctcaggtgatccacccgactcgacctcccaaagtgttgagattacgggcgtgagccactgcgcccggccctgttgctgcttttagaagtggctttttcttcctgtgcgacattactttttagtgggtcagcgcagaaatgtgcttgggctccctgcgacggcgaagcacctttcctcaagggaatctgaagacttttccctgcctttcctctccctcggggaggtcccctcagcgccctcctcttgaccttccctggtgcgtttagtgctgagcctgtgcctgagcctggggacctgggagagttcggaccgaagtccaccgagggccgcagaacggcagggttggggaactggctccctggcgcgcacagctctgtctgcagggcgcggatctgcgctcggtgtgaggaggcacggtgcatgttaagtcgagaaacttctaaactccgccaccagctttggaaataacagctgggattttctgcttaaaccagcatcccagagcacacgggtactaactagcagaagccctaagtaaaatgaaacgggctctgaaggaagtcctggagcctcctgcccgcctgccctcgccattcattcagtcctgcagtgactctgaggaatggcgtgggcgggaggacaagtcacctttaaagccaagcacccggtgggcgcagagggtcccgcctggaatcccagcacttcgggaggctgatgcgggcggatcacgaggtcaggagttcgagaccagcctggccaaaatggtgaaaccccgtctctactaaaaatacaaaaaattgcctgagcgcggtggctcacgcctggaatcgcagcactttggtaggccgaggcaggcagatcacaaggtcaggagttcgagaccagcctggccaacgtggtgaaaccccatctctactaaaaatataaaaaaattggctgagcgtggtggcgcgtgcctgtaatcccagcaactcgggaggccgaggcaggagaatcgcttgaacccgggaggcggaggttgcagtgagccgagatggcgccaccgcactccagcctggacgacagagtgagactctgtctcaaaaataaataaataaataaataaataatgcagatatctttagaaatataaaatagtatcctaggggccaggcacagtggctcacacctgtaatcccagcactttgagagcccgaggtgagaggattgcttgaggctgggagttgaagaccagcctgggcaacagagcaagacccccgtctttacgaaaaattaaaaaattagccaggtgtggccgggcatggtgggtcacgcctgtaatcccagcactttggaggccgaggcaggagaatcacaaggtcaggagatcaagaccatcccagctaacacggtaaaaccccctctctactaaaaatacaaaaacttaggcgggcgtggtggcgggcgcctgtagtcccagctactcgggaggctgagccaggagaatggcgtgaacccgggaggcggagcttgcagtgagccgagatcgcgccactgcactccagcctgggcgacagagcgagactccagctcaaaaaaaaaaaaaaaaaaaaaaaaaaaaattagccaggtgggctgatatgcccagctactcaggaggctgagacaggaagatcacttgaggccaggagttcgagaccagcctgggcaacagtttgagacccgccgcagcctctaccaaaaaaaaaaataataatattctagtttacaagcatgctacagttacaaactcttccttggtaagattttcctccccagagcgctgttgtcagactcctggagctgctgaggccctgcaagctgggtagacaagggaggcaggccgggccaggtgagctcccctgcacccctccccgcccccgccctgcctttcctgtgtttctctggaccctaacgctgcgagacacagacggatagaccatcaggacctcaggagccgcctgagtctcctcccaaccccgagctctgaggagggtggatggttttcttcacggccactaggtggtggaagtctcccaactgtgcagacatctgcggggctggtgggttggcgagctgtgggggagggtgccctggtcagactgtgtccttgggggctgggcggtcgcacccgggagcttcgccaatgtgctagtttgaatgaactcccaatgcaaaaatggcaaacagaggccgtggagaaacctggcttcctccgacaatgggaatttcactctgttctcgttaccgcctgtggatgaatgtgggtctcggagggcgcctctccctccggggagagggtgaccttgccacagtgggactccattccagcggcagctccctcccctgtctgtagccccacggcctcctggccgcctgccttcttattggccacccctcccctctcaacgacctgtttcctaatcatgccattcccccgcgggagagccgattcatcaccatttaaaatggtgaatcgataaagccggtcaggccgggcgaggtggctcacgtctgtaatcccagcactttgggaggctgagacaggcggatcacctgaggtcaggagtttgaggccagcctggccaacatggtgaaaccccgtctctactaaaaatacaaaaattagctgggcatggtagcgggcgcctgtaatcccagctactcaggaggccgaggcagaacactaacttgaacctgggaggcggacgttgcagtgagccgagatcgcgccactgcactccagcctgggcgacagagtgagagtgcatgtcaaaaaaaaaagaaagaaagaaaaagaaaaagccagtcagatctagagagggcgaccggagcatcacccccagacggcttgactctgagctcctgacctcagccttcagacagaggctctcccaacacacacacacatagacacgtgcgcacacacacacacacacacacacacacaccccgcaccagcaaacgctgtctgctctgaagcaggcactgtgtagtctgatatgtccccggggaaggagggtggccaagcacagacagctcccgagagagcctgaggagagagctgcccagcacctcaggatggagaaagtgctagagaggcccttggcttccctgcatcccacggagataacagcaggtacagggagtgaggttcgagagcagtgagtgtaaaccataaggctctgcctgggcaatacatggtcctttctctcttttttttccctcccttccttccttccctccctccctccttccttccttttttttttttttttttgagatggagtttcactctgtcacccatgctggagtgcagtggtacaatctcagctcaccgcaacctccgcctcccaggttcaagcgattctcctgcctcagcctcccgagtatctgggattacaggcacgtgccaccacgcctgggtaatttttgtacttttagtagagatgaggtttcgccatgttggccaggctggtctcgaactcctgaccttaggtgatccgcctgcctcggcctcccaaagtgctgggattacaggcatgagccgctgcacccagcctcattctttcttttttcttttagagttcgggtctcactctgtcacccaggctggagtgcagtggtgggatcacagctcactgcagcctcaacctcctgggctcaagtgatcctcccacctcagtctcccaagtagctgggactcctggtgcccactactatgcctttttgtagaggcaggttctcggtacattgcccaggctggtcttaaactcctgggctcaagcagtcctcctacctcagtttcccaaagtgctgggaatacagtcatgaggcaccacacgcagccacctactcattctaagaccattccttccctgtggtggtgtttatgaaattggagtgttaggggcggggcacggtggctcacgcctgtaatcccagcactttggaaggccaaggcaggtggatcattcgaggccaggagttcgaggccagcctggccaacatggcaaagccccgtctcctttaaaaaatacaaaaattaaccaggcttggtggtgcgtgcctgtactcccagctactcaggaggctgaggcacgagaatcgcttcaacccaggaagcggagattgcagcgagttaagatcgcacccctacactccagcctgggtaacagagtgagactctgtcagaaagaaagaaagaaagagagagagagggagggagggagggagggaaagaaagagagagagagaaagatagaaagaaaggaaggaaggaaaagaaagagagagagaaagaaagaaagaatgaaagaaaggaaggaaggaaagaaggaaggaagggaaagaaagagagaaagaaaggaaggaaggaaggaaggaaggaaaagaaagagagagaaagaaaggaaggaagggaaagaaagagagagagaaagaaagaaaggaaggaagggaaagagagagaaagaaagaaaggaaggaaggaagggaaagaaagagagaaagcaagcaagcaagcaagcaagcaagaaagaaagaaagaaagaaagaaagaaagaaagaaagaaagaaagaaagaaaattggagtgtttcacagcccagggtcattaatttggccacctgtcccctggaaatccgtaactaagtgacaccttagaatgaaagaaacgcctcatggtgtgcacagtgacccattggcttcagggcactttgctcacaaaacacccctccccaaatagaagactctcctgggcaaggtaactcatcccagctggtggcacagggcaggacagggttcagttgctcctggcagaggctgagggaacagggccgggggaggcccctgctgtccttgtctgaagagccaggatctgcatagctccccaccctcagccaccccaccctggcttccctgggccccttctgagatgcagagatgcgttctgggattggccaccatccacccccaagcccagaccatggcaccatgccccaggctgcctgcggccctcttcttgacagactcgcagtcaggtccctgcagcctccttggtgctgacaaatggcccccaggagggtccctggccactgccccagaacccaccatgggccccgcgtcctggccgctggccagctctgtcatttatgtccttcttgaccttcgtgggagcgcccaggctgctccattctgtcctgaaacctacaccaatgcagaacgtcactgtggttggcaaagtcactctgtttgcttcaggtgggcaccgcaggcagggctgagggctgtggctgccgtgttgccggcaaaggagaaaaacccgcaatttgttcagacgagctcctttgcttaaggctctggggagcatcttttctggttattttcagctttctgctccttttgaggaagttcaagggatcagctcctgtccccaccccctgactccaggggtcagactgtgtcagtgttctgggggtccctcttaaggaggcaccccaaatctggaagaacctctgggctcctagaaagatgaagacacgtagagctgtgcccatcactgggcagtttccatcagagagggctttggggcttcggagcacgggtccctccccaggccctgtcctccagaaggatttggatggggtcatcggagagagagagctcgtcctacatggcagcaagtggctcttttcacaaactgtccctgcccctagctgggcatagtggcacgcacctgtagtcccagctactggggaggctgagatgggaggatcacttgagcccagggtctcgatcaaggctgcagtgagctatgatcgcaccaccacattccaacctgggggatagagtgagaccctgtctcaaaaacaacaacaacaacaaaacaacaaaaaccagtctctagccaggcacaggggcttacacctgtgtaatcccagcactttgggaggccaaggtgggtggatcatctgaggtcaggagttcaagaccagcctggacaagatggcaaaatcccatctctactaaaaatagaaaaattagccgggcatggtggcaggcacctgtatcccagctactcgggaggctgaggcaggagaatcgcttgaacctgggaggcggaggttgtgatgagctgagatcatgccactgcactccagcctgggcgacagagtgagcctttatctcaaaaaaaaaaaaaaaaaaaaagaaaagaaaagaaaagaaaagaaagatcacctgtaactgccagtgccagagctaacctggggttaacactgctgtgtgtttccttctggtgacttttctaacagagagagcctgttaggagctgatttattcacattagtatgtagccccacaatgattgtgtgttctccctgcgttactaatgggaatcttttttttccaatcccaaaattggaatccattgtctgacaacacatttgtgtgttggacaaaagaggctgcctggaaagggtgcatgctgagtgataggaatgcaggaggtacttgagaggcttgaaacaggccgggcgcagtggctcacacctgtaatcccagcactttgggaggccgaggcgggcagatcacgaggtcaggagattgagaccatcctggctaacacggtgaaaccccgtctttactaaaaaatacaaaaaaatcagccgggcgtggtggcaggcgcctgtagtcccagctactcaggaggctgagacaggagaatggcatgaacctgggaggcggagcttacagtgagccgagattgcgccactgcactctacctgggcgacagagcaagactctgtctcaaaaaaaaaaaaaaaaaaaaaaaattaggtgtggtggcaggtgccattagtcccagctactcaggaggctgaggcagaagaatcgcctgagcccgggaggcagaggttgcagtgagccaagatcacgccactgcactccagcctggcaacagagcaagactatctcaaaaataaataaataaataaaaataaaaataaagtctggagaccacagagcagggtgtctgaatgcaagaccatgcccaccctgctggcaagcatggaggacggcgtggagccagggtggcatgttcacttgcatgcatgtgtgcacatgtgtgtagacgtgtgtgattcctgggcacgcagtgttggaaagatcactggcctttgtcccagaccaggattccagcctgggctctaagtggccgtgtggctgcggatggatggatgcagaagccaagcaggctatatcctgcattaatgtggccattgagctaatgtccgtggagtcatcataggtcctgatcattggagacattggattttttatttgtttattattatttatttatttatttatttatttttgagatggagttttgctcttgtcccccaggccggagagcaatggtgcgatctcagctcactgcaacctccacttcccaggttgtcacccaggctggaatgcagtggcatgatcatagttcactgcagcctcaacctcctgggccagcaatcctccacctctgcctcctgagtagctgggactacaggtgtgcaccaccacccccggctaatttttaaaaattttttagagacagggcatctccctatgttgctgaggttggtcttgcactcctggcctccagcaatcctcctaccttggcctcccaaagtgctgggattaacaggcttgagccactgcaccaagccc

SEQ ID NO: 180 - DNA, 3044 bp, Homo sapiens
gcaagtgtttttgactattctgcaggaaatgaaatcaaaccacttctacctattttctcctgttatagtttttatcctgagtctggaagttatgttaaatatttttttgcactaaattccaataaagcagagaaaagacaattgttaggcaatttgtagtaccagcattgtttttctatacatactgttataggtgaagcatttaaattattgtgcttttttggtaacaagttttttacattttaaagttgttctttatattttaatcaattcatcattcaaagttctgtgccccaaattataaaatagttcacattttaatgcttttagcagtcaatctgagtgattcagattagttttgatctaaatttaaatgttatgttattatcttttcagctagaaatctgaaaatatcttgttgccaaccatattagtggatatatatctagaaatatgtaaagcgtagtattcatttatacaaataggaaacttatacatttttgggagtgatttgcttacagtttagttcggtttattattgctctttgtttctccctggatcagggagaaaacccttaatactgggaaaatcaatttaattcctattataatgactaccatctatatactttttttttttttttgagatggagtcttgctctgtcacccacactggagtgcagtggcgcgatcatggctcactgcaagctccgcctcccgggttcacgccattctcctgcctcaacctccccagtagctgggactacagtgcctgccaccatgcctggctaattttttttttgtattttgttagcagagacggggtttcaccgtgttagccaggatggtctcgatctcctgacctggtgatccacccgcctcggcctcccaaagtgctgggattacaggtgtgagccaccacgcccggcctatatacttttgaagtatctgcaaatcaaacagaagattaatagtacaggtatatacgtaagggagatgctaacaactgaggaagtcatgtttgcttggtttgcagaattgtgattattaaatatcatattcctttgtaattatggatcctatgaaaaataaaagatctacttgtctctgtttgtataacttggaatggatgagacctgccctctcagccatctataagcaataatgttagatgctctgtgatgatttggaagaaggtgaggagagggaggaatatacaagggaggtgggcatggatggagtgaagagtggaaggtgatgattgtaccaattttctgtgttttaatttgaaatcatctccaacttccatatattcagcaagagtaagtcaaaatacttttttggcctttttaatgatgaggtcatgtttctcactgtaaggttcaattatcaaaatttttccaaaatgtaatatttatgaatcaatctttttttatagttgtgattagtatatgcatatatgttacatcattaaaaaacttttattataaaattgataaatgcttatggtaaaaaagtgaagtagtacagaagagtataaaatgaaaacaaagggttgtgtctctacagtgttcccagtcccagtcctaaaaaatagccatacctaatagtttgttgtgtatttccttgggtgtttttatgcacatacatatttagttgaaattaaacttatatccaattttttgaacattgtctttttcacttaatagtgtattgtgttctattttccatgaccttacctctaaagctacctcttgctttttaatgacttaaagccacctcttgcttcttaatacttcttaatggtgtcctattatatgtgtgtattgaaatgtatataacaagggtatttagtttttaggtacaaatacctgcatagttttgcaagtacatctacaggatatattttttagaagtggaattgcttaatcaaagaagcatgaaatttgagcatgtgaaatttgtataggcattgtcaaattgccctctaaaacagtatgctgattcatattccaatcttaggttcaacacagtgtaaaacacttgatattacaaaattttgaaatgtctgttaatttgctagctcagttatatttcagttggcatttccttatttatgagtgaagcatagctccttttaattattgttgaccgtttatattttcttgtgtgaatttcctgttaaatttttttttctctgatttgtaagtgtacagatctgaggttcaatggctttgagttcggatttgggctttactactaactagttgtttgaccttgagagggttatttagtctgaacttcagttcattatccgtaaaatgtggtagtaagactgcccagctcataaggtatggttaattaatgagataatgaatagaaaatacttaaccgatttcttaaagtacagtgagaatatatgcttgctagtagcattactaatattagtagggtttttttttaaattaaaagtagaaattttcagaaatgtcttttttttttaagacaaactctctgttgccgaggctggagtgcagtggcatgatctcagctcacccctaggctcaagtgatgctcccacctcagcctcccacaagctgggactacaggtgtgcgccaccatgcctgggtcatttttgcatttttttgtagatatggggctttgccacattggccaggctggtcttgaactcctggggctcaagtgatctgccaagcttggcctcccagagtgctgggattaggcatgcgccccctcaccggacgaaaatgtctttatagcatccatatgataatttggtttacttcgtaaacataatgatatggtaagtttcaatagattatctaatatcgaactatccttatattcctggaatgaactctgcttggtcatagcatattgattattaattatattcttaaaatataactaacgtataacaactattgtttaacacaaattaaaacacttttaagattatgtatacttcatggctttaaaataattacagaatagttttataaaattgcagtgaaactttttc

SEQ ID NO: 181 - DNA, 50997 bp, Homo sapiens
gtcaagtcctgctgttttttaaaaaaatccgaactggaaagcaatctatggcaacaaaggtcaccagtgcttcctctggggctgaccctctgggctgggcgagaggagcgcagcagcccctttacctggctgcagccacacaggggaacactggggtgtaatgaccacaccttgtacgtcaacaagcatgtagctaaatgataaaatttctcacacctatagtcccagcactttgggaggctgaggcaggcaggtcgcctaaggttgggggttcgagaccagcctgaccaacatggagaaaccctgtctccactaaaaatacaaaattagccgggcgtggtggcacatgcctgttaccccaggtcctcgggaggctgaggcaggagaatcccttgaacccaggaggcagaggttgcggtgagctgagatcgcaccattgcactccagcttgggtgacaagagcaaaactgtgtctcaaaataaataaataaaataaaatacgggggccaggcatggtggtatgcacctgacaagagcaaaactccatctcaaaataaataaataaaataaaatacgggggccaggcatggtggtatgcacctgtggtccttgctgctcaagaggccaagccggaaggatcgcttgagcccaggagtttgaggcctggacaacatagtgagagactgcatctcttaaaaataaatacataaataaatgggccaggtgcagcggctcatgcctgtaatcccagcactttcagaggccaaggtggaggcagcgcttgaggccaggaattcaagaccagcctgggcaacacagcaagagatctctatctacaaaaattttaaaaaccagccaggtgtgggggccacacctgtggtcccagctacccatgaggctgaggcgggtggatcacttgagccctcatgggctgaggcaggtggatcatttgagcccaggagctcgaggctgcagtgagttgtgatttcaccactgcaccccagcctgggccatggagcaaggccttacctcaaaaaaagaaaaagaaaaagtggtggatcaactagatagccatttagaaaaggatgtatcagccgggcgcggcagctcacgcctggaatcccagcactttgggaggacgaggcgggcggatcacgaggtcaggagatcgagaccatcctggctaacacggtgaaaccccgtctctactaaaaatacaaaaaattagctgggcatggtggtgggcgcctgtaattaacagctactcggcggctgaggcaggagaattgcttgaaccccagagatggagcttgcagtgagctgagatcgcactattgcattccagcctgggcaacaagagcgagactctgtctcaaaaaaaaaagaaaaggaaaaagaaaaaagaaaaggatatatcttgacccctactcactttctacaaaagaataaattctagatggatcatatgaaaggtaaaacgttaaatcttacagacagatttcttaaacaggacacaaaatatattaaccacaaaagaaaaatattgataaattagatcccattaagtttaaaatttcctattcatcaaaagacaccactacgatagtaaaaagtgaatagaaaatatttttaatatacatacttgacaaaggaatcatacagagaatatataaagaattcctattaataataagaaaatgaaagctaagaggaaaatgggcaaaagacaaagaaggctatccaaggtgctcggcctcacagttcatcaagaagacagaatcagagcacaggcagcctccactgcacgcccaccagaagacagagagcagcacatgctgggccggaagtggccgctaaccatgggcggccagtgagcacctgaagtgtggctggcatgagtgagtttagctggtacgaatgagtttaattggcatgagtgagtttagctggcatgagtgagtttagctgacatgagtgagttagctggcatgagtgagtttaactggtatgagtgagtttagcgggtacgagtgagtttagctggcgtgaatttagctggcatgagtgagtttagctggcatgagtgagtttagctggtacaagtgagtttagctggtgtgagtgagtttagctggtacgagtgagtttagctggtacgaatgagtttagctagtacgaatgagtttagccggtatgagtgagtttagccggcgtgagtgagtttagctggcatgagtgagtttagctggtatgaatgagtttagctggtacgaatgagtttagctggtacgagtgagtttagccggcgtgagtgagtttagctggcatgagtgagtttagctggtacgaatgagtttaactggtgtgagtgagtttaactggtgtgagtgagtttagctggtacaaatgagtttagctagtatgaatgagtttaactggcgtgaatgagtttagctggcatgagtgagtttaggtgtcaacagtcacatgaggcttgtggcccatgatgcacagcacaggcatggagcagccacagcagtcggatgaggctgaggagtagacgctggtgtctgtgggcggcaagccacccaggcactgaggcaagagacagaggacacgagctgttccagtataataaaatataaaacaagaatagttataccagatatagatcttaggtatgattatatatgaatatcattaatcattagttggtagtaattactctttatcccaatattataataatcctcgctctacaatcataacctaggaaaaaccaggccatacagagataggagctgaggggacaaagtgaagagtgaccagaagacaagagtgcgagccttctgttatgcctggacagggccaccagagggctccttggtctagcggtgacgccagcgtctgggaagacgcccgttaccaggcggatcatggtccagcggtagcaaaaggtgtcaaggaacaacacccgctacttagcagaccgggaaagggagtctccctttccccggggagtttagagaagactctgctcctctacctcttgtggagggcctgacatcagtcagacctgcccacagttatccggaggcctaaccgtctccctgtgatgctgtgcttcagtggtcacgctcctagtccaccttcatgttccatcctgtacacctggctctgccttctagatagcagtagtaaattagtgaaaatactaatagtccctgatatgcagaaataatggcgtaagctgtctttctgtctgtctcctctccctctctgcctcggctgccaggcagggaagggccccctgtccagtggacacgtgactcacgtgaccttacctatcattggagatgactcacactctttaccctgccccttctgccttgtatccaataaataacagtgcagccagacattcggggccactacaggtctctgcacattggtggtagtggtcccccgggcccagctgccttttctcttatctctttgtcttgtgtctttatttctacactctctcatcgccgcacacagggagagacccactgaccctgtggggctggtccctacaggtgtcagtgcctgaaacgccaccaggcagtgcccccgtgtgggcggaaagtcacccaggtgccgaggcatgagactgaaggcacaagctgttccaatataatcaagaaaatagttaggataagagaaagttatattcgaaataggatatagagatgaatgtatatggatattatcaatcattagttttctgtattaacctttgtatgattattataaccaaagaaaaaccaggccacacagagttaggagctgaagggacattgtgagaagcaaccagaagacaagagtgtgagctctctgtcacgcccagataagggccgcttgagggctccttggtctagcggtagtgccagtgcctgggaaggcacccgttacttagtggaccttggtctggcggtagcaccagcgcctgggaaggcacccgttacttagtggaccttggtctggcggtagcgccagcgcctgggaaggcacccgttacttagtggaccttggcctggtggtagcgccagcacctgggaaggcacccgttactcagcagaccttggcctggcggtagcgccagtgcctgggaaggcacccgttacttagtggaccttggcctggtggtagcgccagcgcctgggaaggtacccgttactcagcagaccttggcctggcggtagcgccagcgcctgggaaggcacccgttactcagcagaccttggtctggcggtagcaccagcacctgggaaggcacccgttacttagtggaccttggcctggcggtagcgccagcgcctggaaggcacccattacttagcagaccaggaaagggagtctccctttccctgggagagttagcgagcactctgctccaccagttcttgtggggggcctgacattccccaggcctgcccgcagtcattggaggcttcaacgtctccctgtggtgctgtgcttcagtggtcacgctccttgtccgctttcatattccgcctgtacacctgctgcttctcttaagttcttagaagatagcagtagcagaattagcgaaagtattagagtctttgatctctctgataagtgcatagaagaaatgctaacgtctgctgtcctccctctctgcttcagctaccacaaagggaaaggccccctgtcacgtggacaggtgacttgcttgtccttatcaatcacttgagatgactcacactccttaccctgcccccttgccttgtatacaataaatagcagtgcgtccaggccttcagggccactaccggactctgcgcactggtggtagtggcctctgggcccagctgtctttcctactatctcttagtctcgtgtcttattttactacaatctctcgtctttgcacatgaagagaaaactcacaaggccctgtagggctggaccctacacccctgagccaagcacacgtgactccatgacccagcagccccaacagaaatgtgtacacgctcgtgcagtggacgcacagacgtaaacattcacacggcgaagcctgcaccaccacgagaaggtggggaggcttctccacatgacggcatggatggacctccccacgggacgtggagcagggaagccaaacacaaacgcacaccacacggctccacttctgaaaaggaaaacaggccaacctcacctcggctggcagccatcgggacggcaggcagccgtggtggggagcaggttttacaaccagacatggctgctggtggtaacaagaggagcatgaacggggcttgcaggggctaatttatgtttctttacctggttcacaagtgagttcagtttatggagtcatcaaaccgtccacctgcaatgtgcgtcctgcatgcgcattatacaaccatcactagttaataaacaaacaacaactgggccaggtgctgtggctcatgcctgtttcccaacagtttgggaggctgaggcaggaggatcacttgagcccaggagttcgaaaccagcctgggtaacatggcaagacaccctctctacaggaaacaagaaaaataaaaagaaaatacaaaaaaaaaaaatgccaagtgcagtggtgtgcctgtactcccaactactcaggaggctgaggtgggaagatcacttgagcccagagggttgaggccgcagtgtgccatgatctcaccactgcactctagcctgggccacagaacgagcctctgtctgaaaaaaaaaaaaaaagctgttacttaaacaaaaaaatccatgtagattcagatacctgatgcccgatggcacaaaaaaagcaagagagagatgacagattgttttattaatggtgttgggtaaattatcaccataaagagtaaggaaaagatgaatttcttccctcattcttgcagtataaactacagataaatgaaagacctctatgtgaaaggcaaaactaaaagctaataaaaatagtctttgaggccgggtgcggtggctcagcctgtaatcccagcactttgggaggctgaggtgggcggatcacctgaggttgggagtttgagaccagcctggccaacatggggaaaccccgtctctactaaaaatacaaaattagccagttgtggtgacacctgcctaaaataggctgaggcaggagaatcacttggacctgggaggcagaagttgcggtgagctgagatcacaccattgcactccagcctgggcaacaagagtgaaactctgtcacaaaaaaaaaaaaaattaaaaaacagaaataaataaaatagtctttggaaaatttatttatgactcaggaataaggaaagaataaataagacccaaaacacaaatcacaggtgccaaggcaaaaagctggctttccacaaaagaacatcagggtccctgttgcgtgaaggtcccgtggcggcattttccagcccatggacaagagggaagagaatctccaacaactgaaactaatgagacaagagggaaaagaatctccaaaaaaaactaaggagacaatggggaagagaatctccaaaagtgaaactaaccagggacctctacctacagcacataaagaatcaacacaaatcaaccaaactccagaatcctgcagaaagtgggcagagaatacgaccagacaatctgagagggacgcccagatggaaccgaatacagcaggagccaatgagcttgccggtgacctgcgggtggcagacggcagagggggcaggtctgcggcaggagcacggctgcactgccgggcaggatggacttggaggctgccctgaaaatgccctgggccctgtggctgggctgtgggcgggtcacctgactgttgaggtgcccgggccctgtggccgggctgcgggcgggtcacccggatgttgaggtgcccgggccctgtggctgggctgcgggcgtgtcacccggctgttgaggtgcccgggccctgtggctgggctgcaggcgggtcactcggatgttgatgtgcccgggccctgtggctgggctgtgggtgggtcacctggctgttgagatgcccgggccctgtggccgggctgtgggcgggtcacctgactgttgaggtgcccgggccccgtggccgggctgcgggcgggtcacccggatgttgaggtgcctgggccctgtggctgggctgcaggcgggtcactcggatgttgatgtgccggggccctgtggctgggctgtgggtgggtcacctggctgttgagatgcccgggccctgtggccgggtcacctgactgttgaggtgcccgggccctgtggctgggctgcgggcgggtcacccggatgttgaggtgcccgggccctgtggccgggctgtgggcgggtcacccggctgttgaggtgcccgggccctgtggctgggctgcgggcgggtcacccggatgttgaggtgcctgggccctgtggctgggctgcaggcgggtcactcggatgttgatgtgcccgggccctgtggctgggctgtgggtgggtcacctggctgttgagatgcccgggccctgtggccgggctgcaggtgggtcacctgactgttgaggtgcccgggccctgtggctgggctgcgggcgggtcacctggatgttgaggtgcctgggccctgtggctgggctgcaggcgggtcactcggatgttgatgtgcccgggccctgtggctgggctgtgggcgggtcacccggctgttgaggttttgctacacatcagttacagcaaaggtccctgcggggaggcacacgtcagcagggctggggaaggaagggaggcttgctagagacccgggacacaaggcaggagagggaccatgcagggagggcgggaagggccgagcacatggctctgcggggcatctggtggcaccggcccagccctggcggtggtgggggtgagacagggcaggcacgcagaggagcacaccagggtgttctgggcggcaggacggccaccaagcctcgaccctagagccagaggacaggcacaggcccccctgggcacgtggggctctagtggagggtgcccgcctcggcggcgatgctgggcatcagtgcagctcagcctgggtctcagatgccgagggcctgtgggtcacactggctgggcagccgtcgaggttctttaccttgtggggccgaagggtcagggtcacctgccccgggcttctccagctcctccaagatctgtttgcgaatggaaggcgcggggacggagtggctcctcttcagcaggggcccagcagctgccgggcggccgcccccgtgatctgctggggaggcagccgtaagcaaccttgtttgcacgcactccctggtgtctggtgcagcccattcggggccacgcagggagcagggtccccacagtgccctgcgcacctgaacgcgctctggaccagcccaccggccaccaggcctctgcatctgccgggccagcaggtgagtgcaagcgagtgccggcctctgactagccctggcccctccccgcccaatcccgcctcccacatccccctcctcccaatctccctccccaccccatcccccttcccccaaatcccccctcccccctcaatccctctcccccaaatgccccctccccccaatccctctcccccaaatgccccctccccacctcaaccccctccccccaaatcccccctccccaccccaatgcccctcccccaaatccaccctccccacctcaatcccccctcccccaaatcctccctccctaccccaaccccctcccccaaatcctccctacctaccccaaccccccattccccgaaatccccctccccaccccaatccctcctccccaccccttccacccctaccccaatcccccatgcgccccacccccatccctaacctaaccccctgccccattccgaggccttgctgccctgattgtcctgctgtgggccaagtgccttgaaggcaaactccatccaggtggggctgccagccaggccctttctcagggcgtcccattggtggatgtggctgtctgggctcgcctgggatgggccacgcagggctgcatctgcccctcaggtgaaacgaggaaggagcctggccttgccgaccacacaggctgaaggaggctgccctgcctggacactgtccttacctacagaggcccatgagcacccccggccctggtctctgccaagacctcatccaggacagctgctgccccatcaagtcacatggacctaatccagtgaaagaaatgccattcaggcaatgacacatactctaaaatacactttgaggccaggtgcagtggctcacacctgtaatccaaacaatttgggaggccaaggtgggaggatcacttgagaccaggagttcaagaccaccctggaccacgtagtaagatgccatctttacaaaaatttaaaaataaaagtaaatgagctgggcctggtggcatgcgcctgtggaccaagctactcaggaggctgacgcaggagaatcctttcagccagtgacatgggggtggcagtgagccagtaccacaccactgcactccagactgggcaaaagagcaaaaccctgtctcaatagtaataataataattattattattattataaaaataaaatgcatttctgggaaaaagcacatcagccagagctgcgtttaaaggtggctgtgatcctcatggggtctcacaagcacacatgagtgcaggagtaacaccactctgctcactccatcctcactcactcaactctgtccactccatcccccactcactccactctgtccactccatcccctgtcactcactccactctgtccactccatcccacactcactcactccactctgtccactccatccctcactcactcactccactctgtccactccatccccactcactcactccactctgctcactccatcccccactcactcactccactctgtccactccatcccccgtcactcactccactctgtccactccatccctcactcactcactccactctgtccactccatccctcactcactcactccactctgtccactccatcccacactcactcactccactctgtccactccatcccccactcactcactccactctgtccactccatctcccactcactcactccactctgtccactccatcccccgtcactcactccactctgtccactccatccctcactcactcactccactctgtccactccatcccccgtcactcactccactctgtccactccatcccacactcactcactccactctgtccactccatcccacactcactcactccactctgtccactccatccctcactcactcactccactctgtccactccatcccccgtcactcactccactctgtccactccatcccacactcactcactccactctgtccactccatccctcactcactcactccactctgtccactccatcccccactcactcactccactctatccactccatcccccgtcactcactccactctgtccactccatccctcactcactcactccactctgtccactccatcccccgtcactcactccactctgtccactccatcccacactcactcactccactctatccactccatcccacactcactcactccactctgtccactccatcccccgtcactcactccactctgtccactccatccccactcactcactccactctgctcactccatcccccactcactcactccactctgctcactccatcccccactcactcactcgactctgtccactccatcccccactcactcactccactctgtccactccatcccccgtcactcactccactctgtccactccatccctcactcactcactccactctgtccactccatcccccactcacgcactcactccactctgtccactccatcccccactcactcactccactctgctcactccatcccccactcactcactccactctgtccactccatccctcattcactcactccactctgctcactccatcccccactcactgactccactctgtccactccatcccccactcactcactccactctgctcactccatcccccactcactcattccactctgtccactccatccctcactcactcactccactctgctcactccatcccccactcactgactccactccatcccccactcactcactccactctgctcactccatcccccactcactccactctgtccactccatcccccgtcactcactccactctgctcactccatcccccactcactcgctccactctgtccactccatcccccactcactcactccactctgtccactccatcccccactcactcactccactctgctcactccatcccccactcactcattccactctgtccactccatcctcactcactcactccactctgctcactccatcccccactcactcactccactctgtccactccatcccccactcactcactccactctgtccactccatcccccactcactcactccactctgtccactccatcccccactcactcactccactctactcactccatcccccactcactcacttcactctactcactccatcctcactcactcactccactctgctcactccatcccccactcactcactccactctgtccactccatcctcactcactcactccaccctatccactccatcccccactcactcactccactctgtccactccatcccccactcactccctccactctactcactccatcccacactcactcattccactctgtccactccatcccccactcactcactccactctgctcactccattctctcctcactctcatcagcattgcttcatttaatttcacatacttttgttagtcacttcaattcttttgggaacatgatgggctataaataaccaagcgcgcacctcatctgtagggtggctgttaactccatcacacagatcgtcgtggggtgactcatgcagtgcacgccgcacccgaccgcttcctcctcagattcaggccccccggttagcactcagaacagcgggtgagagcccatcgcgggaggcccactccccaccaggcacctggcccaggccaagcacgcagggagaattctgggaacaactgaagaatggagggtgaagggtcctgggcctgtctgaggacatccgggcctcatgtgaggagacgggcacacgtaatgagaccgttggaggtttgaggacatccagcccacatgtgaggagatgggcacacctgatgagacctggggaggtctgaggacatccagcccgcatgtgaggagatggggacacgtgaggagacctggggggccatctgatgagacctggggggcatgtgaggtgacctggggcacgtgtgaggggacctgaggcacgtgaggggacctggggtgcgtgtgagtagacctggggggcatgtgaggtgacttgtgggacttgtagggtgacctgggccgtgtgaggtgacccggggatgtgtgtggtggcctcaggcatgtgcaagatgacctggggtgacctgaggcagtgggagcaggatcccccggactctggggctggacattgccctccttggtgcaggacagtacctgagtcacaggactcctggagccgcggtggctttttaagccgctcttcttcgccatagaacacctgcttcttggccttcccggcagccacactggctacagacacgagagggatggcctggctctcctgggacacaagaaggaagttcagtgccaccccaggaacaccccacacccactgacaggtgtgggctcctcaaaggtgtgacaggtgtgggctcctcaaaggtgtgacaggtgtgggcccctcaaaggtgtgacaggtgtgggactctcaaaggtgtgacaggtgtgggcctctcaaaggtgtgacaggtgtgggcctctcaaggcaaagtttaagctacatttcaggcaatggaaagaggccgatcatcaacccagaaatccagttattcaagaaaaggactggtctgtttaaggcaaccaagctcagcctgcttttaccctaggccctgtctcaaacacttgatcaagtcaacatactgccccaaattgtcagaaccttaatactcttcattaaaacaaaagataatgtagaaaacaaaaagatattcccttaatgtcaacaactgaagacgacaagccctaaaatgtcatcagaattatgatttccaactgaaatgcacatactaaagactaatgcgtgctgggcctttactaaccgagctccacttgccccatgactaaagagagccctccgcatatcaggctactgttttgggcagtggggatggagcagggcacgaaaccctggtctcactcagttcccacgagagctcggctaggtggggaccgtcccacgtcccggccaagtgcctcccagggtcacaccgccaggaggagggagagccggggttgacagccttgtgcccttgacaatgcgctgtaccctccaaacgcgtcacagttcagggtcagctccgccccacccggttcagataggaggagctgtcaagggcaacacacagggagtgctggcaacagggaccccatgggacgggcatggggaggggcagcctctgctggacgcggacgtagggaccccacgggacgggcatggggagaggcagcctctgctggattcggctgtagggaccccatgggacgggcatggggaggggcagcctctgctggaccgtggccatagggaccccatgggacgggcatggggaggggcagcctctgcttgacatggctgtagggaccccatgggatgggcatggggaggggcagcctctcctggacagggctgtcagctcagtgtgcagcctgcagggccagaaagggaaggagcgtgtgtgtggctgccgatgtcctacagaacacaggtgaccaaaggaagactcatcacagagtcctgaatgggagctgcagaggcaccaggcggctgttcacaaccgtgtgggcctccagagggacaactccatcatcggagaaggaattccacctttcccaagtccaacggatcagagattttggaacacaaggccccaggagaatcaagcctccaaactgactagcaggtgctttaaggtaggagaataaacacagcacaaccagcccctcccaaagtcctaatgaccagcaactgggaagaccacagctgttgctggcactgccccaccaggcactgggcgcctgccgtgccaaccaatagctgtcccgatgccagctgcatggagcagcatggggctttgtgaggtggttttcacttacagcgttgaagagctctgtggtcaggccgaggtagttgtgcagagccagaaaggtcaccctctgcagccgcaccatgatgatctgcaagaacacgccagctgcgcggtgaccaccggcctggggtacagggcgggcccccggcagcaccacacagagcactgagaaccgtgccccaaaccctgcagatgccacagaccgaaccctctcagggtgaaaaaccccgcagacttgacacctcaccacggtcaagtaacacgttcacatcacggggaatgggacaaggggcacatgaagactgcattgtttttgcaagttttctataaatctaaagttactccaaagtgagaagtttaataaaaatgtaaaaatctctttgggggtagtgagggatcttaagacctctttgagattgtgaacattcatttttattttaagatatatattacaatttttttttgacatggtgtctcgctatgccgcccaggctggagtgcagtggcaccatctcggctcactgcaagctccgcctcccgggttcatgccgttctcctgcctcagcctcccgagtagctgggactacaggcgcccgccaccacgcctggctaattttttgtatttttagcagagacggggtttcaccgtgtgagccaggatggtctcgatctcctgacctcgtgatccgcccacctcggcctcccacagtgctggggttacaggcgggagccgccgcgcccggccaagagacggggtttcaccgtgtgagccaggatggtctcgatctcctgacctcgtgatccgcccgcctcggcctcccacagtgctggggttacaggcgtgagccgccgcgcccggccccagatttttaaaatataaccttcattattcccgaacccactcagaatcccacaacaccagtggtaagtcccgccaatgaagttgatttctctattcctctgaaatcaccttcatggctgtaaagctcagaactgagaaagtaagtgggcaataaacccactcaaatcccaaaccagtgcccaggcccccccagggtgacccacagcagctagaagagttgtctgaaaaagtgactcacctgcaccaccctcaccagagtttccggatatttctcaaaaactccatgaaaagccgcagctggaagccggaggatggtggacgggatggccgcgcggacggagaccgttttgtaaggtgcagcatggccctgtaacaacagctccatcagtccccactctgtgggcctggccaaccccccagggaatgccaaggctcctggaagccctggaggaggccccgcctgctgcccagtcacacggctccattctccctcccaggctgggctgtgcaaagtgctgcttttggcaccagctgcacacgttttttgactgtccaagacatgtgcggcgaaggactggctgacgatgaaatgtgggtgaggggaggcccgcaggcagccaccccaccagacctgggcactcaccatggggagttccaaccactcccacctgccactgaggctcacggaccagctcaccagcgtcctactctacgtccgacatcagcgtcggtacccctcgccaaagggcgtgccagacaccaacctgagcgggcttcctaaaaaggccaccgagagggtcaggagccaccactgtcaaatgcccaccgccacagtggggtcaccgcctaggacagggagcgcgcactgccgggtcgcacgaggcccaggtgaggagccacagtggctcaccgcgtggatgtggccagcagagctccacacggccaaggaaagagcccaggaaaagccccagtgagtgacgtggtttccatcttctagaaattggtgggctctagagagaaaaggctgtttttaaatcacgctgtgatctgcatgcaggcagattcttctggaaacttgttggctctagagacgaaaggctgttgtttacaccatgccgtcacctgcctgcagagacagatttttttttttttttgagacagagtctcgttctgtcgtccaggctggagtgcaatggcgtgatcttggctcactgcaagctccgcctcccgggttcacaccattctcctgcctcagcctccacagtagctggggctacaagcgcccgccaccacgcccggctaatttgttttttgaatttttagtagagacagggtttcactgtgttagccaggagggtctcgatctcctgacctcgtgatccgcccacctcggcctcccaaagtgctgggattaccggcgtgagccaccacgcctggctcagattattctggaaattagttggctctagagagaaaagccttctgtttacatcacgccgtcacctgcatgcagaggcagattcaccctttttggtgcacacctctagcattttcacccccaccacagaaacagaacaatcccaacctccaatgcccctggcagccttttcgcaacctcctttcttcccaccactgggtcttggcaatgctcccccgtcttctgtcccagtggttgtgcctttgtcaaaatgtcacataaatggaggcacagagtgtggaggcttccctcagcggtgtgacacactcgagattcccccacggtggcatgtctgacagaggtctctgccttgactcccaagtgctggctgtctcgtggaggcctcgcagggtctccgtccattcagcagtcgagattcccccacggtggcgcgtctgccagaggcctgtgccttggctcctgagtgctggctgcctcatggaggccttgcagtgtctcctcgtgaaggcctcgcagggtctccgtccattcagcagtcgaaggatatttgtgttgtttccactggggacaattctaaataaagctgcttgataaatatgcatctcccagtgtttgcgtggacacagttctcatccctcttgctaaatacctagggatgggacttgtaggttgtacggaacacgtatcctcacatttataagaaactaccaaactgtctcctacagcggctgccgtgctttgcattctcaccagcggtgagtgagtttccatggatgccctgtgttttgcattctcaccagcagcgaacgagtttccgtggatgccccgtggaatgagtttccgtggatgccccgtggaatgggtttccgtggatgccccgtggaatgagtttccgtggatgccccgtggaatgagtttccttggatgccccgtggaatgagtttccgtggatgcctgtcttcaccagcagttggtgccaccatgtcgcataataaagaatttagctggtcttgtcttcagttcccaggagaaagccctcaagatcttagaagctcctggaagtgtctttttattcacagtgcaattcacttgggtttatgctagcaggtgactcctggcggcaaggcccaacccagaagtttcaggagggagctggccatgcagggaagaccaagcatgtgactagatccaggggtgtcagcccaacctcccacctgcggggaggggaggaagctagacatcgagttggatcacacagccaaagttcaggcaaacgtccctgggtggcaacacacatcagtgtgccaggaggtatagggtccagccctactgtgcctgtgtgtttttttcttcatgtgcagagatgagagatcgtagaaataaagacacaagacaaagagatggaagaaaagacagctgggcccaggggaccactaccaccaaggcatggagaccggtagtggccccgaatgcctggctgcactgttatttatttgatacaaggcaagggggcaggtaagaagtgtgagtcgtctccagcgatacgtaaggtcacgtgagtcacgtgtccaccggacagggggcccttccctatttggtagccgaggcggagagagaatggggacagcttatgtcattatttcttctatgtatttctcggagagatcaaacactttaatactttcactaattctgctactgctatctagaaggcacagccaggtgtacagggcgtaacacgaaagtggaccaggagcgtgaccgctgaagcacagcatcacagggagacgtttaggcctccggatggctgcgggcgggcttgactgatgtcaggcctttcacaagaggtggtggagcagagtcttctctaactcccctggcgaaacgagactccctttcctggtctgctaagcagtgggtgtcttcccaggcactggcgttaccgctagaccaaggagccctctagtggccctgtctgggcataacagaaggctcacacttgtctttggtcgcttctcaccatgtcccttcagctcctatctctgtatggcctggtttttcccaggttataattgtagaacagagattattataatattggaacaaagagtaatgctacaaactaatgattaatattcatatatcatcatatctatattctagttccagtataactattcttattctgtatattttctttattatactgtaacagctcgtgccctcggtctcttgcctcggcacctgggtggcttgccgcccacaaggaggatggcatagctcaaggacacgggagcctcatggctggaccatgccagacctcactctgtgggtctcttgactgttttgactgatcctgattttcatccttttttttttaagacagagtctcactttggagtgcaatggcgcgatctcagctcactacaagctccgcctcccgggttcacgccattctcctgcctcagcctcccaagtagctgggactacaggcgcccgccaccatgccaggttaatgttttgtatttttagtagagacggggtttcaccgtgttagccaggatggtctcaatctcctgacctcatgatccacccgcctcagcctcccaaagtgctgggattacaggcgtgagccaccgcgcctggccgattttcatcctttgtagtacaaatgtgaattgttctagaatattgaatctgagggggtcacaggaatccctgaagttgtaaccagttggtcacaagtgtgagtggcctgggaactcccaagtttgcagttttggatgctattataattgctgttacttttaaatttcaattcctaattcttcattgctaatatagagaaatacagtttattttcgtatgttgataaaccataagttctagtagttgtcttatagaatccacaggattttcaatctagataatcatgtttgggaatagagacttttattttttcttttcccatctgcatgctttttctttctttctcttcccctactgctctgaggacctccaatacgatgctgaacaggagtggtaagaacacacacttggccaggcatggtggctcatgcctgtggtcccagcactttgggaggccgaggcaggtagatcacgaggtcaggaattcaagaccagcctggccaagatggtgaaaccccgtctctactaaaaatacaaaaattagccgggtgtggtggcaggtgcctgtagtcccagctacttgggaggctgaggcaggagaattgcttgaatcagagggggcggaggttgcagtgagccaagattgcgccactgcactccggcctgggagacagagcaagactccgactcacaaaaaaaaaaaccacaaaaaaacaaaaaaacaaaaaaaaacccacacacacactctggcttgttcgcaatcttcaagggaaaatattcagtctttcacgatcaggcacgatgtttgctttcatttttttagtacagatgtcctttattcgatttaggaagttctcttctggttgctgacagtttttatcgtgaacagatgctgaattttgtcaaatactttttctgcatttattaaggtaatcagatggcttttcttctttagtctgtcaatatggaacattacatcaactgattttcaactgttgaaacagctttgctcctggaataaatcccactgatcatgatgtattatccttttccatatactgctggactcaaatctctaatatttcattgaggatatgtatgtttctaatgatgagtgactggtttgaaattttcctttcttgtaatgtctgtctgattaggtattagggtattgctaccctcaaaaactaaactgggaaatagtccctcttctacttttccggagaagtttgtataaaattagcatattttgtccttattgtcctaaatgttgggaagtattccccagtgaagtcatctagatctggaattctccaggtgggaaggattttagctacagattcgatttctttagtagtagccattcagataatctatatctgagggaactgtggtagtttgtgcctttcaaggaatttgtcaatttaatctgcgtggctgattttatgggcataaagctgttcaaaatatttccttattagtccttttatgtctgtagggtctgtagacatgtgcactctttcatgtctaatatctgtagtttgtgtcttctcttcttttctacactagtctggctggaggatttttcattttactgacgtcttccaagagccagcttttggtttcattcattttctctcttgttttgcatttccaatctcatggattcctgctctttattagtttcttccatctgcttgctttgggtttcatttgtttttcttttcctagcttcttaagatagaagcttgggtcactgatctgagacttgttttattttctaatatgagcattgcccaggctggagtgccatggcacagtcgtggctcactgcaacctctgcctcctgggttcaagtgatttccagataatttttgtatttttagtagagatggggtttcaccatgttggccaggctgatctcgaacttctgacctcaagtgatgcacccgcctcggcctcccaaagtgctgggattacaggcatgagccaccgcgcctggccgtgttgtccatttttatccttggtaatattccttcatctcatctgacatcgactttgtctgatactaatatagccactccagttttcttttaattggggctttcatgatatatcttcttccagccttttttttttttgagatggagtctcgctctcttgcccaggctggagtgcagtggtgcgatcttggctcaccgcaaactctgcctcccgggttcacgccattctcctgcctcagcctccacagtagctgggactacaggagcccgccaccacgcctggctaattttttgtatttttagtagagacgaggtttcactgcgttagccaggatggtctcgatctcctgacctcgtgatccgcccgcctcggcctcccaaagtgctgggattacaggcgtgagccaccgcgcccggccttttttattttttgagaaactgtcttgctactctatcacctgagctatactacagcagcacactcagagcttccttcagcctcagcttcccaggctcaagcaatcctcccactttagcctcctgagtagctgggagcacaggtgtgtaccaccacactaacctaattttaaattttttgtagagatggggttgctatgttgcccagactggtctcaaactcctgtgctcaagcaatcctcccacctgagcctcccacagtgctgggattacaggtgtgagtcacttcgcccaggccaaccttctgttttccatctaagtattgatatttaaagtgggtttttcctgcagacaccatagagttggggcttggactttccatccaatctgacagtctgtcttgttgttgtatttagaccatttgtatccactgtgatcatttataatggctgggtttaggatataattttccggagaatgttgccttctttgttttagcaggcgattaagctggttgggttcagaccacaagtctgtatctgtggatggtggattccagtttctctgttttcaaagccttggttctgatgctttgctctgccctgaacatgcaccactcaggagtcaatctgagattcgaggtgaagtttgaatctttgtttttttttttttttttttgagacggagtttcactctaccacccaggctggagtgtagtggcacgatctcggctcactgcaacctccgcctcctgggttgaagcaactctcctgcctcagccccctgagtagctgggattacaggcacacaccaccacacttggctaaatttttgtatttttagtagagacggggtttcaccatgttgaccaggctggtgtggaactcctgacctcatgtgatccgcccgcctcagcctcccaaagtgctgggattacaggtgtgagccaccgcgcccagcctgaagtttgaattttttttttcctgagatacagtcttgctctgtttcccaggctgtggtgcagtggcatgatctcggctcactgcaacttctgcctcccgggttcaagcgattctccggcctcagcctcccgagtagatgagactagaggtgcgcgccaccacacccagctaatttttttgtatttttagtggagacagggtttaaccatgttggccaggacagtcttgatctcttgaccttgtgatctgcccgcctcggcctcccaaagtgttgggattacaggcgtgagccaccgcacctggccttgaagtatgaatcttaatacagtttcaaagtctttgttatgctgctctgggtctgtcctgagccttgtacaggttcacagacaaaatctgtgcatctacttccctggctctctcctccctgagatccacacactctctctggcccttgggggcccttcttctggtgcttttggaggattcccatcagggcttttgctccataactgggctaccatcaaggcaaggccatgagtaacagaagaaaacgaaaaagcaggaagcagaaccctcgtgggtggcggctccacgatgactatccacagtctactggctttattttcggagttctccaagaattgttttctgcattctgtccagagtttttcactgtaatcagcaggacaggctgttgtggcactaccttgccacagcagaactgtaactctcccatttattttagttaaaaataaaatcttaatttccttcttctttgagagcctgaatgaagatgcctaacacatcaccacagatactaaatcaaacagcagctgctcacctgtgtagaccaggctcacggctgctgctgttcaggagaattccaatgtaccttcctgcacgaggccacataaacgagaacccaaacaaggaacttagagggtgcccaatctcctggtgctgggctccaaagcacaactggccgacactcaggcctgctgcgggccccgcacatcgagcacaccagatactcagctcttggcacatgctaatcgatctctgagactcagcaatttttcttccacttggaattttgttccgttcctttcaaaacctttatgtagagcaagttcctccctaagagagctacaccacaccacaagaaacacaagcacagaacggttgagaggagtcatctgccagccccaacagccggggtccagcgactgaaatcacggcctgctccagactcaagggagagacacccccaccaaccgcatcagctgggcaagtctcatctccactctggaatcagggagaaaagcacgtgcgtgtgtttgggggcgggtggggaaaaagaataacaacttagcagctgttgctaaaaatggcttttgtgtgttttatttcaaatccacttgtttacttcaaaaaaccatgccttcataacctcaccccagatcaggaagctgtgaaaaccacagggagaggctggatgctgggaagcccaggtggacacgcagctcctctggcaggcaggggtccccgagggctccccacacttgcacatcttcagatctcggcagtgctgtatgtagcagccagcaatcacacccaacccagctgtcactcagccacggagaaatcaacggtggtgtcaacgactgaactagaacgacacccactcacgccaatgaatctcacgttcataatgttgctcaaattaggaaaggtgaggaatcctggtgtgatgccatttatgagatttagagtcaagcaaaattatactacatattgtataagtaccaaagaaaattcagaaaagtagctatctctgaagaaaagagaaggtgaaatgagagcacacgtgggtaatgtgaacagagccggcagtgtgcatctaacctgtgttctagctaaccagggttaaaactatataacctgggttcgagttaagatgcctgtttgctgtgtcatgcctacttgttttagagacagggtcctgctatgttgtctgggctggcctagaactacgaggctcagcaatctcctttcctctcccgaacagccaggactataggtgccaaccgccattcccagcaacatcacgcttttttgcgtatctgcggtattttgtaacaactttataaaaattaaaataataaagactatctcccattaaaaatggtgggttgggccaggcacggtggttcacacctataatcccagcactttgggaggcccaggagggcagatcgcttgaggtcaggagttgaagaccagcctggccaacatggtgaaaccttgtttctactaaaaatacaaatattacacgggcatgctggtgtatacctgtagtcccagctactcgggaggctgaagcacaagactcacttgaacccaggaaatggaggttgcagtgagccaagatcacgccactgcactccagcctgggtgacagagtgagactgtctccaaaaaagaaaggtaagttgaaggtaaatgcttatctttgtccccttgtggaatatacatgcttatctctgctctcttaaaaagatacaaacctccaaggataaagacaaaagctaagagtagataaaaaatgtcactgaaattttagcggctgatgaaagcaagtgacagggtcatggctggtggagccctctaaggaaagctgacacttggttttagaggtgcagaacctggacagagaggactggtcctcactgcagagccagaacgaggctaacatgcaggtgagacgggaagaggggcaggctaaccccaagtcactttcctgaccccaacaggctggaaatggcttttccccgtggccagaggactaccaggaactctctggagaaggtgaagcaagcaggtaagagcccaaggacatcaggtgtggctacgaatccaagaacagtgtccactccagacgggagcactcccagactcctcagtgagtgtccactccagacgggaacactcccagaatcctcaacaacagtgtccactccagacgggagcacccccagactcctccccaagtgtccactccagatgggagcactctcagactcctcagtgagtgtccactccagatgggagcactctcagactcctcagtgagtgtccactccagacgggagcacccctagactcctccccaacagtgtccactccaggcgggaggactcccagaattctccacaacagtgtacactctagacgggggcactcccagagtcctccccaacagtgtccactccaggcgggaggactcccagactcctccccaacagtgtccactccaggcgggaggactcccagaatcctcaacaacagtgtccactccagacaggagcacccccagactcctccccaagtgtccactccagatgggagcactcccagactcctcagtgaatgtccactccagacgggagcacccccagactcctccccaacagtgtccactccaggcgggaggactcccagaattctccacaacagtgtacactccaggcgggaggactcccagaatcctccacaagtgtccactccagacgggagcacccccagaatcctccccaacaatgtccactccaggcgggaggactcccagaatcctccacaacagtgtccactccagacaggagcatccccagactcctccccaagtgtccactccagatgggagcactcccagactcctgagtgtccactccagatgggagcactcccagactcctccccaacagtgtccactccaggcaggagggctcccagaatcctccacaacagtgtacactctagacgggggcactcccagactcctccccaacagtgtccactccagacaggagcacccccagactcctccccaacagcgtccactccagacaggagcactcccagactcctcagtgagtgtcccctccagacaggagcactcccagaatcctccccaacagtgtccactccaggcgggaggactcccagaatcctccacaacagtgtatactccaggtgggaggactcccagaatcctccacaacagtgtctactccagatgggagcacccccagactcctccccaacagtgtccactccaggcgggaggactcccagaatcctccacaacagtgtccactccaggcgggaggactcccagaatcctccacaacagtgtccactccagacgggagcacccccagactcctccccaactgtccactccagatgggagcacccccagactactccccaacactgtccactccaggcgggagcactcccaggctcctcagtgagtgtccactccagacgggggcactcccaggctcctccccaacagtgtctactccaggcgggagcactcccaggctcctcagtgagtgtccactccagatgggtgcacttccaggctcctccccaacagtgtccactccagatgggagcactcccagactcagacaggagcactcccagactcctccccaacagtgtccactccagatgggagcactcccagactcctccccctcctccaacccagtgccaccacagcagaacatacgcagattcctttctgagaagctgccctaaaaaaaagacctacagaccctgacctgtagactcccaaaccatgaaggaaagagccagcgtcctgctcagtcctcctgcagggagtgtcccctgttaacgagccctgaccccatgcacacgcagcctatatgcagctttcaggtggatcacgctgttttcgttttgtagttaacccatgtaactcccaccgaaatcaatatgtagaacatttccagtaatctagattaccttacgcctccccgggtcgatacccaacctaaacccctaacaggcaaccactaatgagaccttaaccccagcagggccaaacaccaggaccaagtccctcgaaccgcgcgttctaacaggcaaccactaatgagaccttaaccccagcagggccaaacaccaacaccaagtccctccaaccgcacgttttttgtaaaggaagttttttttggaacactagatggccacattgagtagctgcaagagagaccacgtggcccataaagctgaaatatttacactctggccttttacagagaaagctggctggccagcctctgtcctcaagtgtcagtacagctggtagctgagcctcaggtgagtgaaattacacagtgtgtgctttttgttgctggcctcttgggctccacattatttctgtgagatgcagctatgctggtttgcacacttgtgttcaataagaacttcattcacacataaagtgactgctggaggcagaaaagcccctgatcagaaagacagaagccaaaataaacagagaagaaaaactcaggtcagaaacaactcagggagcaaaagaaaacccatcttactttatccatgaagtaagaacaagataatttttaaaaattaaaacataagaacaaagatacttttttaaaaagaacattcagggccaggcgcagtggctcacacctgtaatcccagcactttgggaggccgaggcaggcggatcacaaggtcaggagtttgagaccagcctgaccaacatggtgaaaccccgtccctactaaaaatacaaaaattagctgggcatggtggtgggcacctgtaatcccagctactcgggaggctgaggcaggagaatcgtttgaacacgggaggcaggagttgcagtgagctgagatcacgccattgcactccagcctgggtgacagggcaagaccccgtctcaaaaaaaaaaaaaaattaacagaaaaaacctcttgaaatgaaaaatatgacagaaattaaaaattcaatggaagatttggaaaataaagttgaaaaaatctagaaagtataacaaaaaggctgggcatggtggctcatgcctgtaatcccaccactttgggaggccgaggcgggcagatcacgaggtcaggagatcgagaccatcctggctaacatggtgaaaccccgtctctactaaaaaatacaaaaaattagccgggcgtggcagtgggcgcctgtagtcccagctactcaggaggctgaggcaggagaatggcgtgaacccaggaggcggagcttgcagtgagctgagatcgcgccactgcactccagcctgggcgacagaccaagactccatcacaaaaaaaaaaaaaagaaaagaaaaagtacaacaaaaagacaaaggtggtgtagaataaagacaattctagatttctaaggtttccaaacatacacctccctggcatcctgtctcaggaagtgaatggaggatttgctccaccaaaacacgccggccgagaaagcagcagcaagagccctgtgtaggggaaggaagggtgggtggtcctgggatggcgtctggacagcaggcctggggagggtccgactgggcaagaggatgggggctcctagcaggggcgcttcccagagcaaaaaagcattcacggagccgctggttcaggcgtgaatctgtaatgggtgcatataaaaatcaccaagaggccaaaaataagccgctggttcaggtcgtgaatctgtaacaggtgcacagaaaaatcaccaagtagccaaaaataacacaactgttaattccaagaaaaagagaaagttgcaagaaaggaaatttaactatagtacactacatagctcagctgtgaatagtatccatgaagtcgaaagaaccgcccatgagcggtgcagatgggaacgtagcatgaggcatgggggcaatctacggagccacacttcatctcccatgacaggaagcatgggggccatccaccgagccacacttcatctcccacgacaggaagcatgggggccatcctccgagccacacttcatctcccacgacaggaagcatgggggccatcctctgagccatacttcatctcccacgacaggaagcatgggggccatcctccgagccacacttcatctcccacgacaggaagcatgggggccatccaccgagccacacttcatctcccacaacaggaagcatgggggccatccaccgagccacactttatctcccacaacaggaagtcagtgtgtctagaatggatgggttaggaaacagcaagaaaagctgctcagaaggaaccgaagcgttttcagtgtgaggggacagacggccactgttgataaaactttaagtatgtttttagaatctgtccatgttattttgcaagaatttaagttttgttaaaatgacaaacacaaaagtttgatgaggaaaaacgatgtcacggcagatgatcaactgatcacaatacagaattacctctctcagatatcacccccatttttttttttgagacagagttggagtgtcactctgtcaccaggctggagtgcagtggcacaatctcagctcactgcaacctccaaatccctggttcaagggattctcctgcctcagcctcccgagtagctgggataacaggcacccgccaccacacccagctaatttttgtatttttagtagggatgggtttcaccatgttggccaggatggtctcgatctcctgacctcgtgatccgcccacctcggcctcccaaagtgctgggattacaggcgtgagccaccgtgctcagccaatcacctcccattttttactcccactacactcagggaagatccattcccacccctaagggagaggggctgtgacaccaacgcggatgagacggatcgcagcagctgagaggaacccggcccgtctcagcgcacagctcccctctcctggaacaggcatggctgcactgtgataagtgaggcccaacctgaatatcacaacaagatcaagatcagaaagaacaaagaaataatggagaaagcctctaccccagtgaagctattttttgcttaaagagaaacgaatcatccaaggtaggtcgcatacagatgccccgtgctgaacgggtttacgtccacgtagaccaaagctcctgtggtcctttcccagtttttctcaggcccacaggtgccccttacacatccaggagtccctgagaagcccacctcagctccagagacacactaaccagaggctccaaagaggtgcacagaggtggatctggtggctgggaccccactctgccccaagccacgctgggggctccctcgaagatgagcaccggccttctaacggcaggtcagccttgctcaaaggaggtgggtgtcttctccctccccaggccggcagcctccccagcacaggccacgcgtcacgtgaagatacacaagtcccagggagcacaacgagatgccgaggtcccacccacgcctccaccccaggccccaaacagctcaaagcgcacctgtgcccatctgccggggagcagagtgagcaccctggacaccccgatgtctggctggagcttgttacgtcctttccgagcagaggaacataggatgggatcagaggacaccacccaggctccagtgcgaggtttcatgcaaggacctagcgcttggttctgcctgaatgcatccgagccagggttctggtgagctctagaaaactctcctaacaaagtctagagaaactgaggtagaagttaccttgatacacagctaacaatgaatgcaaaaggtgtaactcaaaagagtaagattaaaatcagttacctcttttgagttgagaggcatttagcaaaattcagctaatggacactaaagatttgtttcactgcatgtaggttttactcaaagaaaaaaagattaaacacacattaaattccagttaatgggccaagcgcggtggctcaggcctgtaatcccagcattttgggaggctgaggtaggtggctcacttgaggtcaggggttcaagaccagcctggccaacatggtgaaaccccgtctgtactaaaaatacaaaaattagccaggtgtgatggcacattcctgtaatcccaggtactcaggaggctgaggcaggagaattacttgaacctggaagatagtggctgcagtgagccaagatcgtggcactgcactccagcctgggcaacagagcaagaccctgtctcaaaaaaaacaacaaaattcaggctgggtgcagtggctcacgcctgtaattccagcactttgggaggccaaggcaggcagattatgaggtcaggagttggagatcagccttaccaaggctgttctctactaaaaatacaaaaattagctgggcatggtggcgcatgcctgtaatcccagccactcgggaggctgaggcaagagaattgcttgaacctgggaggtggaggttacagtgagccaagattgcgccattgtactccagcctgggcaacagagcgagactccatctcaaaacaaacaaacaaacaaacaaaaaacaaaaaaacttctagttaatggcttggcatgatggcttatgcctgtaatcccagcattttgggaggctgaggtaggcagatcacttgatcccaggagttcaagatcagcctggccaacatggcaaaacctcatctctatctctacaaaaaaatacaaaattagccaggtatggtggtgcacgcctgctacttgggaagctgaggtgagagaattgcttgagcccaggaggcggaggttgcaatgagcaaagatcatgccactgcctgggcgacagagcaagacccagcctaaaaaaaaataattctagttaatgttgggcacatggggtgattttactatttttgcacatttttgaactgtctcataataaaaagttaaaaatcatgagacaacatgatacatgattttttgttttgttttgttttgttttttgagacggagtttcactctcgctgcctaggctggagtgcagtggcaggatcttggctcactgcaacctctacctcccgggttcatgcgattctcctgcctcagcctcccaagtagctgggattactggcgcctgcccctacacccagttaatttttgtatttttagtagagacggggtttcaccacgttggccaggctggtctcgatctcttgaccttgtgatccacccacctcagcctcgcaaagtgctgggattacaggtgtgagccactgcgcccggcccggcagcacctttcaaaattacaagtctgcatccctgggaccctgcaagtccaccctaggatttatcctgcagatcaggctctggtatcggaaacgatggacacaggaaaccattcactgcaacgacgaaaagcaaaagactgggagccacagaaagacggcgccagcagggaagagcccagcaggacctgcaggaaacgggggtggctggtccctcgggagggccttgggcctgaggagaggagaaaacgccttccctctacaacactttgtgccttttgaatgctgaaccacatgcatttatgacccagttcaacaacagtcatttaagagacaaccaaaaccgttagccacatgcccggctattcttcaacgcactgtggccagaatgaagctccctcctctttcttccctccttcctggaccaaaccctgctcccctcacatcactgtggagaactggcctttaaccactaccagctgtccagacaagacagaaaaaccaggcctccggggccaacccaggggcgcccggagggccaggcagcgggggactcacggtgatgatgtccaggatgctgagcaggctgtggacgctgtctcccgccagaacctctttcaccaccacctcggtgccgtcctgcgcttggagagcagagtgggtgccgtcaggtctggggctgcgaccgcggggcctggcggaggctcagcccagcccagggcagtggggccacgggcctgcacctctgaggcgccatgagagcagcaggcaccttggatggagggcaggggacaagatggacctgctggcatcaggggtacaacacacaggaagcggcagcaaggaaaacagacggaggagaccccacctctccatcccatgactcgtcttcaatgtggggactgaggcaaaagctcgcagagcctgtttgtttgctgagctaactataaggactccgaggaccgattcagttattaccagcctaaattccagaactttgatataattttccattaggtaaaaaaagaaaagaaaccgcgctattttggtgatttaacaaagtaagcacttcatctcagcttgacccaggaaaattctttatgaagttgcccaaatctggccccagtcccctccatgagcccctcccatctagtccaaaggccagagggacacgggttctggtccttcaggagggccccgcacgagcggcaacgaaagccgctgcttcaccagctgggcggcctcatccccaggagctactggctccagcttcccccaagcccctttcccttctaataacccatcaagtccagccacagacaaagcgacaaacctgagaaccaaataatttgcccagcagcgcttttggtctagaaaccccgacaggcagtgccggagctggcgtgggatcacagcccactcccgggaccacagctggcaggagccctgcaggtcagggtgatgatcacacaaagcccagggtttgctgagtgcgtgctttaaatgagaacaagcaatgggaagtctgggtcgcaaactgcccagacagacaaagccacaccaccctccaggagagcaacacagcgccaaagaggccacggcagggtctggcccagcacccacccccgagcagcgattcaaagggtggaatttaacagaggcaggaaacaagtattgagctcctacgtggattcacacccgaatttttttttttttgagacagggtctcgctctgtcgcccaggctggagtgcagtggcgtgaacacagctcactatagccgcaacctcccagactcaagcgatcctcccacctcagcccccaagtggctgggaccacaggtgctaccaccatgcctggataattattttttattttttgtagagacggggtctcactacttcgtccaagctggtctctaagccgtgggctcaggtgatcttcccaccttggccttaattactttcttacaattaatttaattttgttagaaacctgaaaatagagcaagggttcaatggaccatggcaaatcaacacagtgacttactactaaactatcaaagggagtattctgaggacttggaagatacatttaaaacagctgcccagcccagtgcctcatgcctgtaattccagtgctctgagaggacaagatgggagaatcgcctgagcacaggaattgctgatgagcccggacaacaaactgagactccatctctacaaaaaaattttataagtgagctgggcatggtgacatacacctgtaatcccagctactcgagaggctgaggcgggaggatcgcttgagcccaggaagtccaggcctcagtgagctgagatcacaccactgcactccagcctgggtgacagagtgagaccctgtttcaaaaaactaaataaaatgtaataaaaaataaaaacggtgagttttcccccaaagaaattaaaatcaaaattttgcctagcttttcaatgagaaacgttttacagcccgagaagacagacgtggaggtaaatgcgcagccgcctgaccccgccccgccgccctgcgactcacagtgtcctggatgcagacctccagccgcccgtcctgcaccacacagatgctggggtccggctccctgggctggaagacgtgctccccttcctgcagctgcacaaagacgatgtgtttgcaaagctccaggaacagcggcttctcaaagtggcccaggaccctgcaagagccagagggcactgtgggacgcccttccaggggaggaggacggcctctccaagagtctcgagagcacacggtcactgaccccactggcgccaggctttgtgctgtgggtccacacggctgaccaacaaaccacacagcattactgccaaacacaaccgtcaacttctgaaattcccgtgagcctgttttccatcacctcagagaacttcttgacccgtgaacctgagccacacacacacgggaggaaggcaaaggtggcctccaggatggtgagctgggccagggagcggaaggggtgcagtccaggggccaggcagcaagacaggagcacagagcagaacccaggctccaggctttggatccaccacacccttcttgctcttgccctgggttcaccgctgaagatgaaacaccgggaaatcgttcaacagaacaagaaagatctggtgaaggagccagcagaccacgaggccccgccacggggcacagacaccagcagccccacgatgcgctttgccaaccattcccccaacacaagacggccaagctggagccaggccccagcgagaagcccggggctatgggagctgccgcagcccccggggctcatccccgctcttaccgaacgtttttcagcatgtacagaacttccgatggcaggtgagaattcttcacgtcaaactccgtgaggtcggcctccagcagggagggcgggggctccttgggctgcagggccgggtattccttcttgaaacgcagaatcctacaaggcagagacacactagccttgagcagaccaggcgggttcgaaacccacagcatcagtggctgacacaccaggcagctcagggttggggaggccagcaccatggggggcacctggggcaggatgtggtctgaaggacacacagtacctcttggccaaagacagcaccttggtcctcttcctggcccgctgccggggcagggcagtgttctccacaagggtgttggggagtgtggtcacctgcagagccaagggagagaccagccactgaccctgcaagccgcaaggtccaagctctttgccatggggatcagtcctcaggacctgcctgtgggcctcccacagtcccagcttcagctcctggggtctggctgtgccattttcccaccctgcctggcctgtgagggaatgttggcagcgatacagccccacacatccttgggatcgtcctcactgtccccaaacagccaaccctccagagcccccaggcttcatgcctgctggccccgctgccccgaaggctgacacccgctccatctttggctctcatactggtcaacacaaccctttgctacaaccctttaaaaatccaccactgtccccaccgaccttcccccccaacttcccctctgacctggggccactgcccactctgtcccatatctggaacagtcttcctcccttttctcaggcagtgcctgcttgactgcccagaatagcagtggcctgggtcacaccctgcatgctggcagggtcacctcactcaggccccactgcctgctgcccctcggtccagagctgtcagcctcatggctttcctcccaggccctcagcttccctgtcctctgtggggccactggatgatggccgacactcaacagaccgcctccactctgctccagaccaccctacgccctgtcccggccgcctaagcctgtcccagacccagcctacagcagccctaactcatctgccctttcacagcacttaatgcggatgagaacagatgagtcacagacacccacatccctcccctcttgagtttctcaattttctttttgttttttgtttgttcgtttgtttttgagatggagttttgctcttgttgcccaggctgcagtgcaatggcacgatctcgactcactacaacctccgcctcctgggtcctggctcaaacaattctcctgcctcagcctcccgagtagttgggattacaggcgcccgccacaaagcccagctaatttttgtatttttagtagagacagggtttcgccatgttggccaggctggtctcgaactcctgacctcatgatccgcccacctcagcctctcaaagtgctgagagtacaggcgtgagccaccgtgcccggccgagtttttcaattttctatgaagaacacgaattagttgtacaaccagaaaaaggtaacaaagattgctttaaagggatcagtctgtgcggtttctgtgaagcttctgggtggtctgttgagcacctcctgggcccttcaggagtgcagggaggcggccaggggaggcctccgacagcccaattggccaaagacgaggaagggttaaaccaaggctgcttattccccagatcggggcttgtgaaactcggatccctgagccctggcccagggatctgtgtctaggttccggaaccacccagacattcaaagtgagtcacgcagctttcagcttagagcacacatgccggtaaccagggaactcagcccctcaaatcccaggggatggactctgtcctcagctcagcatcccaaagcctggcagagacctccaagcttggcagcagagtcaggaacctctggccgagcgtgaggccctctgcacccactgggccccagtgatgttcctagaaagcagctttccgttctcacttattgttaaaataaacatccactctgggggccgacagggcctttgtgagcggcaagcgactgagggcatgagctgttccagtataataaaatatataaaataagaatagttatactacatatagatcttagatatgattatatatgaatatcattaatcattagcttgtagcaattactctttattccaatattataataatcctcactctataatcatagcctaggaaaaaccaggccatacagagataggagctgaggggacatagtgaggagtgaccagaagacaagagtgcgagccttctgttatgcccggacagggccaccagagggctccttggtctagtggtgacgccagcgtctgggaagatgcctgttgccaagcggaccgtgatctagcggtagcgtcagtgtcaaggaaaaacacctgctacttagcagacagggaaagggagtctccctttccccaggggagttcagagatgactctacccctccacctcctgtggagggcctgacatcagtcaggttcgcccgcagttatccggaggcctaaccgtctccctgtgatgctgtgcttcagtggtcacgctcctagtccgccttcatgttccatcctgtacacctggctctgtcttttagatagcagtagtcaattagtgaaagtactaaaagtctctgatatgcagaaataatggcataagctatctttctctctctctcctctctctctctgtctcggctgccaggcagggaagggcctcctgtcaagcagacacgtgaaccacgggaccttacctatcattggagatggctcacactccttaccctgcccctttgtcttgtatccaataaatatcagtgcagcctggcattcagggccactactggtctccgcgtcttggtggtagtggtccccaggacccagctgtcttttcttttatctttttgtcttgtgtctttatttctacactctctcgtctccgcacagggggagaaacccaccgaccctgtggggctgggccctacaggccttccctcccctccggccactgtgcaccacagacattcctgaagctgcccctccaggccagggggagtagaggcctgagagggtgaggggttattcttgggtaaaacacactggattcagctggaggaagcagacaccattcggcacaatttataatttcccccaaaccctgagcctggtggcagagctgggaagctggggagaggacagcacacaccaagcactgcccagcctgggggagcccacagcagaaggggtccctcccacaggggcctgctcgaggaagccgtgtgcagcctggggccccgagcaacagctaccttcctcatgatcttccggccgtaaaacatcactttgtctctcttccggaaccggtactgaggagtgggctgtgcttgtcctgcaggggagtaaagggatggcctgaggtagagccgtggcacaggcctggtcctggacatgcaggtgcagcacagtcagtcatactctcgtccctgccagtaactggccatactcagacagcatgagggaagagggcctgagtgacaggctcatctccaacaaagggggctctcccctcttcccactgaagccttgctcaggagaggagaacagaaagggctctgaacagacttggcttcctggaaccgacgggctcagcctgagcccagacgggccatcagattctagccaaagccaccatgcgcttgagggcccctcccaggggctcaaaacacatcccaagacacccacgctttcccccaaccccccgggccagagtcggaaccaagatactcacgaaattgtctaagccttctgaacatgaaaaggatgaggacaccaaccaaggccagggccaggagggctccaactgcaatccccgtcagctggccgagagtggaaacacggcgcccatcagcaaagccacaaacctaaccctagccctaagcctgcccccacccctggctgcccaaccacaggctgggcaggaatgagccaggggatggggacagggagaggtgaaaaaggccacggcccatccaggtctggctccagggaagcgtgaggtgattaccatggtggacggtgaaccttcctccgtgaaccacagtccccaagagtgcagggcggtgcccaggcagaagtcagcctgcagcagagagcatggggtcaggtgggcatggacaggcttcccagcccgaacttgttcagagcagcaggaggagagctgggagttaggggagaagtcagcagccctggagacttctgggaagaagtgatctcgcccggggtgccggggtcctctgagccccctgctaggaagcactcagagagcaacctggctccctcagtcactgggatacagtggggcagggccagcggctgccccaggcatcactaacacacccacatgctggtgatgcaatccttgggatgcaggtctcagggagcaggcctggccaaaggggaggccaaggcccccctctcagtgtcgcctcagccccagcaggagcagtgctcaaaacccctatgagccatctggattctgagaacattcaacaccagttcacatgccaaacaaggaggcagcggccgagaaggctctgtgtcctgcagtctcctggagcagcaggacttcagaagtccaggtccgcgggagggagggaagagagggtgagggcaggatggtgagtgaacgacagcagaggacgctggtggttccaagaagtgaaagagaaaacgagaagacgagaagacgacaccagccagacaggcagccctctccattcctgctggcatcacaccttcctcccaggcagccaggaaccggatagggcaggggaagccactggttcagcctgaaagtttctacacaagagccaaggcctaaaacaacacccacccccgcctcactgcagagagcaggactcccatccgtgccagaaaatccagggaagggccgggcgcagtggctcacgcctgcaatcccagcactttgggaggctgaggcgggcggatcatgaggtcaggagatcgagaccatcctggctaacacggtgaaaccccgtctctactaaaaattcaaaaattagccgggcgtggtggtgggtgcctgtagtcccagctacttgggaggctgaggcaggagaatggcgtgaacccgggaggcagagcttgcagtgagctgagattgtgctactgcactccagcctgggcgacagagcgagactccatctcaaaaaaaagaaaactcagggaagtcagaagagcactcagaaacgcatttaaagacacaattctgcaccaagacagaatgaggacgtgcccagaaagctgagcccttcgaacttggttcagaagcaaatacaagccctgggagcttctgcttcaggacaggggaacccctacgctcactctcaaccaggtggggagcagagaagcacctacgaccatgtccctcacttaaggaagcgaagtgagtccctcagcccagcaaccgcttctgggaccgattatccaaggaaggcctatcacgcgatggcccgtgacctggtcacaggctctcctgcggtggagcggctcagccttttctagcttttcactgttgctttaatgggtccagtgttctggtttaggaaataaggcctttgccatgtggctacagatgtttgactaagaaaaagattctagggctgggcacagtgtctcacgcctgtaatcccagcactttgggaggccgaggcgggcagatcatgaggtcaagagttcaagactaggccgggcacggtggctcatgcctgtaatccctgcactttgggaggccaaggcgggcggatcacgaggtcaggaaatcgagaccatcctggctaacacagtgaaacaccgtctctactgaaaatacaaaaaaatattagccgggcgtggtggtgggcgcctgtagtcccagctacttgggaggccgaggcaggagaatggcgtgaacctgggaggcagagcttgcagtgagttgagatcgtgccactgcaatccagcttgggcgacagagcaagactccgtctcaaaaaaaaaaaaaaaaaaagttcaagaccagcctggccaacatggcgaaaccccgtttctactaagaatacaaaaattagccgggcgtggtgcctgtagtcccagctacccgggaggctgaggcagaattgcctgaacccaggaggcggaggttgctgtgagccaagatcacaccattgcacaccagcctgggcgacagagcgagactccgtcttgggaaaaaaaaaaacacagaaaaaggttctaagcaaaaccatcaggcaaagtcctaaaggaactggaagtagcaactgtgaccttaggggaagaaaagacaaggcctcaggcaatgcccatgggccaccgctggctgccctcgctgtgaacaatgcccatgggccaccactggctgtctgctgtgacaggcgcgtctaacaagtgctggcagctgtgacaggcagcagagaggggccagatccaccactcccacagtcctcaggcgccaagaagccacggggccaaagagcgcggcagagcagacgccaagaggacccttctctgggtccagaaatgccccccaactgggaaatccaggcatctggtcccccgagttacatacctgtgggctgtcatctttctcttcctccatggccagaaacagaaaaaacagtcaggggcgaaaagcagacagcctgaagcaaacaagggcacacctctacccgctcatgctcacacctggacacttttccctgggttcctttcaagtcaaattatgtttcactgaaaggaaaatcctgctgaaaaagtctgttctccaggaagaaaagctgtcttttgagaagtgtctgtcatctgctaggagccacctccttccctctgtaaacagccctcacgtggctgtcccggaacccagaacagcagccagatggggcgtatccaagcaggtcaagaggagccaggcccagcgcggcggggatgggggcagcgctgccttctggagaagcacggctggaggggaggtgacgctggcggggcgtggatccggggtgtggggatgcagctggggaggagggtgcagctggggagggggtggatccggcgtgtaggggtaccgctggggagtgggtgcagctggggagggggtggatctggggtgtgggggtgccgctggggagtgggtgcagctggggagggggtggatccggcgtgtaggggtaccgctggggagtgggtgcagctggggagggggtggatctggggtgtgggggtactgctggggagagggtgcagctggggagcgcgtggatccggcgagtgggggtaccgctagggagggggtgcagctggggagggggtggatctggggtgtgggggtgccgctggggagggggtgcagctggggagggggtggatctggggcgtgggggtgccgctggggagggggtgcagctggggagggggtggatctggggcgtgggggtgccgctggggagggggtgcagctggggaggggatggatctggggtgtgggggtaccgctggggaagggcgtgcagctggagaggggatggatctgggctgtgggggtgccgctggggacggggtgcagctggggagggggtggatccggattgtgagggtgcggctggggggcgacttccgcgtggggtgagaggtcgcctgcgagggtgaccgggcaggagggctcagtgcgcaagccggacgtgctgggtccaagattattgattaatttgggcaccgcgagggctcgagtccccccacaccactgcccggcctgcgggggagcacagacagcccgggccctcccggctgcaggtcccgggctttccccgcgcggttgccggctccgcccagaggagccgcgcccggcggaggggtaagaaaggcagggtcgcggcgtcaacgcggcggccgtctcgagtccagggcccgcgtcctccccgacctcccgacgccacctcacggcctcagggggactgggctcccgggaaaccgccggccacctggcggacgaacacaggcagtggcgggcagtggagacgccagggaccaccgcgctgagagcgatcactcatccgccagccccgccccgcgagccccgccccgcgagccccgccccgcgagccccgccccgcgagccccgccccgcgagccccgccccgcgagccccgcaccgccggccccgcaccgccagccccgcgagccccgccccgccccgcgcgctcctcgcattggccgagtccccgcggccacaccccctaccagattggggccgctattggacgcggcggccgcggccaatcggagccgctcttgctgcgacgcagcggtcggaagcggagcaaggtcgaggccgggttggcgccggagccggggccgcttggagctcgtgtggggtctccggtccaggtgagtctgtcggattggggcgggcgccgcgcgcggccaggggcggggctggccgggttcccggggccgcgactacccgctctctcctcccgcagggcgcggcatgggcgtcctggccgcagcggcgcgctgcctggtccggggtgcggaccgaatgagcaagtggacgagcaagcggggcccgcgcagcttcaggggccgcaagggccggggcgccaagggcatcggcttcctcacctcgggctggaggttcgtgcagatcaaggagatggtcccggagttcgtcgtcccggatctgaccggcttcaagctcaagccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctagctgggcgggggaggggcggcctgccctcatctcatttctattaaacgcctttgccagctatacggtgtttgttttttggcctcaggtcatggcaaagtgtgcagcatgacagatttcagtgcaggcacctaagccgagttctcatgcagactcggcgctgtgaacctctttggaggtcatcttccgagtccgaaggttctgggaacctgccaagggcaaacatcactcagcttgcaggagaaagaatttacaaggcagattgtgccggatgacagcactggtcagttcatcccccaaattattcacccagggaacaaagatacagagatgggggtctcactatgctgcccaggctgagaactcatgggctgaaatgatccgcccgcctcagcctcccaaaatgctgggattacaggtgtgagccactgcgcccagcctaggaaaatttcctgttgcaatctgacatatagtgacatgttgtgttgtatcatcagaaaagaagaaagggataaggccaggtgcggtggctcacgcctgtaatcccagcacattgggaggctgaggcgggaggatcacaagattaggagttcaagaccagcctggccagcatgatgaaaccccatctctactaaaaatacaaaaattagccaggcgtggtggcgtgcgactgtagtcccagctactccaaaggcaagagaatcgcttaaacccaggaggcagagcttgcagtgagtcgagatcgcaccactgcactccagcctgggtaacagagtgagactccgtctcaaaaaagggataaaactgcatgtttttttgcttgtagtcacctatgtatcattagtaaatgctgaggatttgacaaatagtggcctgtacctcaaccacagttcctcccagagagacaaaagccctcacagcaggagttggatgtaacacacccagtttgttcacacacctaaagtcaccatctgtccagtatttgggagctaacccgtgtgggtgctgcagtgatgagtgttccctacagacttcacatatttcaagctgatgacccccaaggcaacttggaacacacactcccttttacttacctgcatagggatccaatacaggttgagcgtcgttatccaaaatgcttggggctgggcgccctggctcatgcctgtaatcccagcactttgggaagccgagacaggcgggtcatctgaggtcaggagcctggccaacatggtgaaaccccatttgtactaaaaatacaaaaattagccaggcatggtggcacacacctgtaatcccagctactccggaggctgaggcaggagaatcacttgaacctgggaggtggagggcagtgagtcgagatggagccaccgagattgagccactgcactccagcctgggtgacgagcatgactctgtctcaaaaaaaaaaaaaggcacagctcaacgcctgtaatcccggcactttgggcggccaaggtggacggatcacctgaggtccagagtttgagagcagcctgaccaacatggagaaaccttgtctctactaaatatacaaaattagccgggcatgctggtggatgccagctattgggagggtgaggcaggagaatcgcttgaacttgggaggcggaggttgcagtgagtcaagattgtgccattgcaccccagcctgggcagcaagagcaaaactccatctcggggggcaaaaaaaaaaaaagcttggaaccagaaatgttttggatttcagattttggaatatctgcatgtacataatgagacatcttggggatgagatgagatacaagtctaaacatgaaattcaattttgtttcatgtacaccttatacacatagcctgagggtagttttatacaatatatatgttttttaggctagtcaaatgaagctgtgagagaaggaatgaatctgtaactggttgtcctcaattattgtttatacaattttttattatttaatttttagagataagagtcttgctctgttgcccctggctcattgcagcctcgacctcctgggctcaacaatcctcctgcctcagcctcccaagtggctgggaccataggcacatgcaccacacctggctaatttttgttttactttttatagagactgggttttgctatgttgcccaggctggtcttgaactccaggcctcaagcaatcctcctgcctcagccccttccaaagtgctgggattacaggccactgtgactgtgctcagtagttttaataatatatgcaacccgtcacatgagttcagctgcgggattttccaaaagttttgggattttggatttttggactggctgtgctcaatctatacaagcatttctggtgccatgatgaggcataaaatgttcattttaaacatgttataaactcgtgtttttcaaaaaacttcatttaatacaaatagttgcttaaacaagtatgaaaggctgaaagtcaaaatctgcctgagaaacttaacaaatctgcaagctggaaaccgcgtcttttccccactctctgccagacagaatcacccagtccactttcaggggcccagcagggaagctgatttaagagaagtcaacagcttttctgactacactgtggattccatcagtgcacaggcacctgcagggctgcagtaagcatctctgatgaggtggtcccgggcactcactcgcagtctccctcctggtttccttgtgggaaggggcttcatgatttcaagctcagttcccctcccactcccagaggtggagcgcatggtcatagaaggagcaggtggccaggaggctgaaggctgagtctgcttcttctgggttcacgccacagtcacgtgtggtggctgctgtagcctgcagccaggtgccattcttcctcatgccctctgtgagtggcttcattccactctggggtctggcatggccctccccatcgttatcctctctgcattcatgacagggtgttggcaactcgcttgcacccttcaggtctgccgtcttggttcctaggttgctaggaaaggaccacgagggggcccgctgcagagaacggaagagcagccaggaccagtcggctccatacaccagcgagtcgggcaatgtgtgagatgtcaggaccgtcgcctcctgcctctcctctggagtgagagatgggagaacccaggaaacacaacatcacccagagcctctccccaacctgtcacacctgacagggagactccaagaacagcccctcacaggtcagcaagtgtttcctgaggagccgttgtgtcatgcaaaggaaccagcaagacctgggcatatgttggagaagaaacagaccgtcatcttgcagtgcacacgcctgtgtgcctccaagagaagcatcaagcggggctacagaacctcacttgatggtgaagaatacggcaaaagccagagagggggaaagacctcagttaacacttaaaaccaaagaacaaaggagttttagccagctgggaaggaaggggatgtctgaggaacaggcagcatgtgtacagcagaggtgagaaagtccaaggctcgcacggggaaccacaaacaggcagccatggcactgtcagtgagtgacagtgggctggagcgtcccaagcatgcagggtccggcacgccctgtttcagagtctggattctggcttggaaaggagccactgacaaggttaagtgagcagtttctttatagaagttgctacggcaactggaaagaggccacaactgcctcccagagcacacagcaacagagggaatgacgaggcgtggccaaacccgaggcgatctggagtccaggaggcaaggccagggctggcaggggcagttgcagagagcaagtggaaggtgagccaggggctgcaaggctgggtggccacttgggctctgaaagggctgccatcgctacctctgaagtacagggattgatgccagcagtgaccggaatcagaaccagaatgagtgctgatggaagaagggctgagggcagaacaggaccgcactggattacaaaacgtgccgaggttgtatgggcctgggccggggaggcccaaccctgggcccagggcttcaactgggcagaggtggctccgaggaggagtgagatgctgaatgttcagagacagccacaggggccctcgagcagcatgtgtggggcgaccctcgggaggaagcccctggggaggccgttactgtcccttgggaggtagcgtcacagggcaggcaggacctccgctagtctttcatccagcaatcgctcaacacgtccactcgggccagcaggacctcttctacagcttaggaaaaggtaataaggcagagtctaagccctcagagagccacagcctgggaaaaagacagcgaatgagtggacggaagacactgttgcgaccccaagaatgggaggccctttctgattagccacaggccaacgtttcctccctctttttattttcaagacaggacctcactctgtcgcataggctggagtgcactgacctgggctctgtcttcctgcctcacctcctgagtagctgcgaccatcatgccccctagttttttctattttttgtggccacggagtctcactatgttgtccaggctagtcttgaactcccggctcaagcaatccgcccacccttcccagagtgctgtgactgcgagtgtcagccaccgcacccagacaatacaaattgttttaaaattaggccgggcgcggtggctcacacctgtaatcccagcactttgggaagccaaggcgggtggatcacaaggtcaagagatcgagaccatcctggtcaacatggtgaaaccccgtgtctattaaaaatacaaaaactagctgggtgtggtggcatgcacctgtagtaccagctactcgggaggctgaggcagcataattgcttgaacgtgggaggtggaggttgcatgagccaagatcgtgccactgcactccagcctgggtgaaagagcaagactctgtctcaaaaaaaaaaaattgtttaaattaaagatacaggctgggtgcagtggctcacgcctgtaattccagcactttgggaggccgaggcaggtggatcacatgagggcaggagtttgagagcagcctgggaaacatggtgaaaccccatctctactaaaagcacaaaaattagccaggcatgatggcgcatgcctgtagtcccagctacacaggagcctgaggcaggagaatcccctgaacctgtgaggtggaggttgcagtaagctgagatcaccccactgcactccagcctgggcgacagagcaagactctgtctcaaaaaaatacataaataaagttatgaaaaaggccagccgagcacagcggctcacgcctgtaatcctaacactttgggaggccgaggcgggttgatcacctgaggtcaggagttcaagaccagcctgaccaacatggtaaaacctcgtctctactaaaaaatacaaaaattagccaggcgtggtggcacacacctgtaatcccagctactccggaggctgcagcaggagagttgcttgaacccggaaggtgggagttgcagtgagctgagattgtgccattgtattccagcctgggagacagagcaagactccgtctcaaaaaagaaagaaaaagaaaaaaaggcctatacagagtacctgacaaaactggcc

SEQ ID NO: 182 - DNA, 176276 bp, Homo sapiens
ctatttactgtttgcttccccatttactcttagcacgcaaattatcctctcatactgagtgttgctgcttcctgtatttaaaaatatatattttttatacactacacataggtcagtcatttaaaggatagtgaaagagaaagatgaaggccgggcacggtggctcacgcctgtaatcccagcactttgggaagccgaggcgggcggatcacaaggtcaggagttcgagaccatcctgcctaacacggtgaaaccccgtctctactaaaaatacaaaaaaaattagccggccgtggtggcacgtgcctgtagttccagctactccggaggctgaagcaggagaatggcgtgaaccgggaaggcagagcttgcagtgagccgagtttgcgccactgcactccagcctgggcgacagagggagactccgtctcaaaaaaaaaaaagagaaagatgaatactgctattctgcagcattgataaacaattatgagaactgccccaaataccatattggtgatagccacccacgcttctcttcaaggtttccttttcccatttcatgggattaccttaagaagctttacttctggctggtgcggtgcctcatgcccgtaatctcagtactttgggaggccgaggctggtggatcacctgaggtcaggagttccagaccagcctggccccaatatggtgaaacccagtctccactaaaaatacaaaattagccaaatgtggtggcgagcgcctgtaatcccagctactcgggaggctgaggcagaagaatcacttagaacccgggaagcagaggttgcagtgagccgagatagcgccactgcactctggactgggcaacagagtgagactctgcctcaaaaaaaaaaaaaaaaagaaagaaaagaaagaaagaaaaaagctttacctctttgttaataaatataataaatccttctcatcctaaatcaagtcaacctttgtctttaatcaggtgttaaaaggaaatcacctaaaatcaaaaaacaggagggcctttttgttgagaatttgctatttcacatttgtgattttagttcatcgcaatcaccattttataaaaatagagtcagatgaatttactatcacaaaactaataagtatactatctagtattctcaaatctaactccaaaaacccaagttctttctgctatgtctctatgcaaacttttacataaactgagaatgctgccaatcattttacttccaaagacagatgtcaagctagccaccaaaagcctgatgtgggaatatcattgtaatctcttaactagaaaaaacaccccgctctgaagaggccatcatttttttattcggataataattcaaacttcatgattttctgaaaatacattctcaagatgaatttttgagaaaagtctcaaaaatgttcattgttatttttgcctgctccaattgacagaactgttctatatggggaaaaaagagaatgaaactatttagtttttatttagacctacacgatactactccctacttaaaacctacctagtggcagcttcacagacgaaagcaaaggccaggcaaagagattacaattacggagcaggacaaatcctgagtttaaggaaaagaaaaatgcatcagatgaagccaaccagctataactacagcctctgcccactgacctcagagaactgggagtgttctgttccatgaggaaatccagctttgatcttttagaagccgatgtttaactaacctagtttaagctgctttttaaaaaatacccacctcttggtatatctctggtagaaattttttcagcgttccctctatctgcttaacagtttccaaaagtaaatgtgttgaggtgtgtcccttcaatatgaaatataagcatcggccgggcgtgatggctcacgcctgtaatcccaacactgggaggccaaggcgggcggatcacctgagggcgggagttcgagaccagcctggccaacatggtgaaaccctgtccctactaaaaatataaaattagccaggcttggtggtgtgcgcctgtaatcccagctactcgggaggctgaggcaggagaatcgttgaacccagaaggcggaggttgcaggcagccgagatcactccattgtactccagcctgggcaacaagagcgaaactctgtctcaaaaaataaaaaaagaaaagaaatgtaagtattgagggtgcatttaaacaaatataaacatacgaaacgtattagtacttattaccaaatcatgttggaatttcttgtggaactgtaagatgaaaatcagttcactaacactggcttctctgaattccaccaaaacagaacacaagcaatgtgagattaacctgttttatttttcaagcttttaatgtggctagtcaaaaaagtaaattaatattggcttggccgggcgctatggctgacacctgtaatcccagcattttgggaggccaaggcgggtggatcacctgaggtcaggagctcgagactagcctggccaacatggtgaaaccctgcctctactaaaatacaaaaattggccggtcatggtggcgggcgcctgtaatctccactactcgggagactgaggtaggagaattgcttgaacccagcaggcggaggttgtagtgagccaaaattgcgccactgcactccagcctgggcaacaaagcgagactccctctcaaaaaataaataaataaataaataaataaaatgataagacttataaagtacttagaacagcacttggcaagcagtgaaagtccaatgaatgagattacaatctaatgcaggaggtagatcgtaaataaacagataaaaactgtgatggttagaataaatgctcaaagggaaaaagggtaacatcatgcagagtaacaggagagagggaagagggaggctgctttatagtcaggaaaaggctcttgaatgatttaaaatttgaggtaaaacctggagaattggaagttcctggttatgcagctagaaatgtcaaatgggcacttggaacacaggggagagctccagcctagagatgaaattttgaaagtcatccgaacagacagtatttaaagccataagaatggatgggttcaggccaggcacagtggctcacgcctgtaaccccagcactttgggaggccgagtaaggcagatcacttgaggtcaggagtttgagaccagcttggccaacatgacaaaaccccatctctactaaaaatacaaaaattaaccaggcatagtggcgaacgcctgtagtccccgctactccagaggctgaggcaggagaatggcgtgaacccgggaggcagaggttgcagtgagccgagatggtgccactgcactccagcctgggcaacaagagcaagactccgtctcaaaaaaaaaaaaaaaaagaatcgatgggatcacccaagaaactgcagcaaaagaaaaaggtccaggactcagccctgagaaacttccatatacagaggttaaatatctaaaaaggagactgaataaagaaagggaaaaccaggagagtgtggcgtcatgaaagccaagaaaagaggtgcttcaagaaaggaaaagtgggaagctgtcttctgtgttactaggacagcgaagaacatgaggacagagaagtgcttgttgcattaacaatgcgggaacgaatgcttaccttgcagatgcaggtcagtgacgtggtggggacagattggaatggttgaacactaagttggagatggaaacagtggagtaatatttgagaaattatgttgagaagagcagcagaaaaatgtagccataggaaaatgtgagaaaagggaggaatctgtttggttttgcaccttttacttttgtatatttttggtatttttacatgacagataaaagaggatatgtgggggtttttttgtttgattgttgatttgtttgagacagaatctcgctctgtcgcccaggctggagtgcagtggcacgatcttgcctcactgcaacctccacctcccaggttcaagtgattctcctgcctcagcctcccgagtagctgggactacagggatgtgccaccacacccagttaatttttttttttttttttgagatagagtctcactctgtcatcgggctggagtccagtggcacgatcttagctcactgcaacctctgcctcccgggttcaagcaattctcctgcctcagcctccccagtagctggggctacagatgcacaccgccacgcctggctaattttttgtattttagtagagatggggtgtcactgtgttgcccaggctggtctcgaaatcctgagctcaggcaatccacccacctcagcctcccaaagtgctaggattacaggcgcccgccaccatgcccggctaattttgtatttttagtagagactgggtttctccatgttggccagtctggtctcgatctcctgacatcaagtgatccacccgcctgggcctcccaaagtgctggtattacacaagtaagccaccacacctggccctggatttcgttcttaatcattacaatttttcagtgaaatttgaggcacggtcatcagctaagagtgagatgagggagacagttgggcaggtttgaaaagagaagagaaaatgtgagagagactgaagagtgttgaaagccagtgagctgccccttagggatttccaggttatgctgagcagctccttcagctctgaggtcatgagttgaaagtaaaaccagagccaggcacggtggctcacgcctgtaatcccagcaatttgggaagccgaggcgggtgggtgcatcacctgaggtcaggagtttgagaccaacctggccaatatggtgaaaccccatttctactaaaaatacaaaaattagccaggcatggtggtgagcacctgtagtgtcagctaaccaggaggctgaggcaggagaatcacttgaacctgggaggtggaggttgcactgagtgagatcatgccactgcattccaccctgggcaacaagatggaaactccatatcaaaaaaaaaggaaactaaaactatccagcctcacatgccagtttctttgtttttttcttttctttttttttttttttgagacagattctcaatcttgtcacccagggtggagtgggatctcagctcactgcaatctctgcctcctgggttcaagcaattctcctgcctcagcgtcctgatagctgggattacaggtgcccaacaccacgcctggctaatttttttgtatttttagtggagacagggtttcaccatgttggccaggctggtctcgaactcctgatatcaggtgatccgcccacctcggactcccaaagtgctgggattacaggcgtgagccaccgcaccccgctggcacatgccagtttctccagaagatatggaaagttaggtttaatcacagttgggcttttttttttttttcatgatggtaatgacagacaaagagtaagggaatcgagggtgtttgcaagagaatgattagaatggaggatcatggaacctaagctgggcgaggagggaggtgaagggaaaggaggaatgcatgagtgtggatggggaagatggacagactggagtaaataaaagctgcaaagaggccgggtgtggtgggtcatgcctgtaatcccagcatgttgggagcccaaggcgggcggatcacttgagatcaggagtttgagaccagcctggccaacatggtgaaaccctgcctctactaaaaatacaaaaattaggcaggtgtggtagcttaagcctgtaatctcagcacttcaggaggccgacacgggcagatcatttgaggccaggagttcgagaccagcctggccaacatggtgaaaccccatctctactaaaaatacaaaaaagtagccagacgtggtggcacaggcctgtagtccaagctacttgggaggctgaggcaggagactaacttgaacctgggaagcagaggttgcactgagccaagatcatgccactgcactctaacctgggcgacagcaagactccgtctcaaaaaaaaaaaaaaattctgcaaagtagacagtaagatcccagctactcgggaggctgaggcaagagaatcgcttgaacctgggaggcggaggttgcagtaagccaagaccgcgccactgcactccagcctgggcaacagagcaaacctctgtctcaaaaaaaaaaaaaaaaagagacaggaaggagccaaaacctttagtgaatgaaaggggacagaattggacaccagcggtgattctgaagagctgtgggagtgtagggagaaagaatgagtccaaaggacccaaggtttttgaaagatgacagaaatgaccaggtcaggaagcaaggaacaggcagctgtgcactcagactgcatgagttcaaactctgattccaacatttactcactatttgaacttgggctcattattcaaccagtttaaataacagctttttattcttaacaatcatgataataatagtactctttcatggggtattatgaagagtaaaggaggtaattgaaataaaagcacttagcaccatgctctagaatgtgctctgtaagtgttggctgttactaaatcatgttggaaaccacaaacttgatctaaatagctttgcagtttgaataaatactacttcaacagccatttctttgccttaacactgttgagaaaccagtgcatctgaaaccttttacttcaagcattaggaatctgtgccaagacattgaagattaaatgaagcttaaaaagaagggcttacagccaggtgcagtggctcaatgcctgtaatcccagcaatttgggaggtcgaggtaggtggatcacctgaggtcaggagttcaagactagcttggccaacatggtgaaacctcgtctctactaaaagtacaaaattagctgggcatattggcacactcctcgaggggctgaggcaggagaatcacttgaacctgggaggtggaggttgcagtaagccgagatggtgccattttactccatcctggaaaacaagagcaaaattccatctcaaaaacaaataaacaaacaaacaaacaaaagaagtggttacaaatgaagatgaaaaaggggagaaaaaaggaagagttttcttagctaagcaactgttaatgacagaggtttgtaaactctttctgccaagccactttggaagccatttggcttacagggtacaattcagagtccttagcaggagctcttaatcatggcctcttgtctatgcatctggtctcatttcttgctacttccccacatgtctaagttccggccataacaaataacctgcatacacaggacttcctcttcccttagtgcacattatgcctttgcctagaatgtcctttctcccacgaatatttacagactagttaagtcaagcattatttcctcagggaagtcgtggtttatcactaccaccttacaaatactgaggtcccagcccccatccgggttcctgcagcagcctctgatcacccatcttacaacattcattatcttatattggaatacctttaaaatatctgttttcggcccggtgcagtggctcatgcctgtaatcccagaactttgggaggccaaggatcacaaggtcaggagttcgagaccagcctggccaacatggtgaaaccccgtctctactaaaaatacaaaaattagccgggtgtggtggtgggcgcctgtaatcccagctgctcaggaggctaaggcaggagaatcacttgaacctgggaggtggaggttgcagtgagccgagatcacgtcactgcactctagcctgggcaacagagcaagactccatctcaaaaaaaaaaaaatctgtttttctcatgagactgtaagctacttggggctataatttgtatctcactaatatacaaagtgtcttgtggaaagcactttgtaacattttggtagaaggattaatgtaaatgaatgttttctttggagaggatgagaaacttgtgtactgaagcaggaatgtgtaggatttttttttttttaaagacagggtctcactggcctggcgcggaggctcacgcctgtaatcccagcactttgggaggccgaggtggacagatcacgaggtcaggagatcgagaccatcctggctaacatggtgaaaccccatctctactaaaaaatagaaaaaattagctgggcatggtggcgggtgcctgtagtcccactactcgggaggctgaggcagaagaatggcatgaacccgggaggcgaagcttgcagtgagccgagatcgcgccactgcactccagcctgggcaacggagcgagactccatctcaaaaaaaaaaaaaaaaaaaaaaaaaaaaaacaaccacaaagacagggtctcactttgtcacccaggctggagtgcaatggcaccatcccagctcattgcagcctcaacctgccaaagttcaagcaatcctcctgccttagacccccgcccccacaagtagctgggactacaagcttataccaccatgccaggctaatttttatgtattttttgtagagatagagttttaccgtgttgcccaggctggtctcgaacccctgagctcaagcaatctgcctgccttggcctcccaaagtgctgagattacaggcatgagccaccgtgcctggccaagaaaggatattttggaggaaaccattacattatagcctggagtttcatttttatttaccaagtgatatactaactcttaacagactaaacacaccccttttggtgatttgcatgaaagctattcaagtttttatcagtgagaggttgaatggacacctctaagtatgtgtcaggcattaatccatctaatgcttctatttgataggtcctattttccctatttttacagatggggggaacgtgcttagcatagttaaataatgtgcccaggattacatagctactcaactcaggctgtgtgatgacaaagttcacactcttatataagatttccttccattctaagatgtttcccccaccttatacaactgactaccacatacagtggtaatacagatatccccattaacatcatcagaatatggaataagaaaagacatgattttacagcactctgggaggccgagacaggtggatcacgatgtcaagatattgagaccatcctggccaatatggtgaaatcccatctctactaaaaatacaaaaaattagccgggtgtggtggcgggcgcctgtagtcccaggtactcgggaggctgaggcaggagaatggcgtgaacccgggaggcggagcttgcagtgagccaagatcacgccactgcactccagcctgggccacagagcgagactccatttcaaaaaacaaaaaaaaaaaaaaaaaaaagaaaagacatgattttataatctagttcaaacaagacagaccaatatatataataacacaagaatgtctgcctgggtcacaccagtgtgttgctaaatctataaccatgataatacaaaggaaagaaggctgaactggaagtgaaagacgtttgtctaggcttagagcccagacagggcacgtgcaacccagcgaaactagggcaagtcatttgtaactgttccgtgactcagagccctcgttttacaaatcaatggattagacttcaccgtccctaaccttattactttaatttaattttgggatggagtctcactctgtcccccaggcaggagtgcagcggcacgatcttggctcactgccgaggctggagtgcagtggaacgatctcagctcattacaacctccgccttctgggttcaggcaattcccctgcctcagccttccgagttgctgggattacaggtgcctgccaccacgcctggctaatttttgtatgtttagtagagacggggtttcaccatgttggccaggctggtctctaactcctgacctcaggtcatctgccccattggcctcccaaaatgctgggattacaggcgtgagccaccatgcccaactgcttccaaacatttcagagtccaagcgaaaagtggttgcatgggtagggcgtggctcatgccgctacttccccacatgcctaagttccggccataacaaataacctgcatacacaggacttcctcttcccttagtgcacattcacttcttgtgtcagttgctaagagtaatcatgtaaagaaataggtgtcatttttgatagctgattctggaagtttctagtttcttctggaaggtatactgcagacataataatatatgcataatatatccctaaagtttctccgtggaagcttgaacccgggaggcacaggttgcagcaagccaagatcgcgccattacactcctgcctgggcgacagagtgatctcttggttcgctgcaacctcccctcccaggctcaagcaattctcctgtctcagcctcccaagtacctgggattacaggcatgtgccatcacgcccggctaatttttgtatttttagtagagacaggtttcaccatgttaattaaccaggctggtctcgaactcctgacctcatgatctaactgcctcggcctcccaaagtgctgggattacaggcgtgagccaccgcgccctgctggcagttctatttttttattttttttatttttttttttttttgagacagagtctcgctcagtcgcccaggctggagtgcagtggcgcaatctcggctcactgcaagctccgcctcccgggttcacgccattctcccgcctcagcctcccgaatagctgggactacaggcacctgccaccgtgcccggctaattttttgtatttttagtagagacggggtttcaccatgttagccgggatggtctcgatctccttgacctcatgatccacccgccttggcctccgaaagtgctgggattacaggcgtgagccaccgaacccagccattcagttctatatttttaagtgacttaattatgtaatcctcacaataagttatgtggtagatactatttttttgagcctgaatttcattgtcacccaggctggagtgcagtggctcaactcgactcactgcaacatctacctcccgtgttcaagtgattctcctgcctcagcctccagagtagctctgactacaagtgcgcaccaccacacccagctaatttttgtatttttagtagagacagggtttcaccgtgttggccaggctggtctctaactcctgacctcaagagatccatctgcctcggcctcccaaagtgttgggattacaggcgtaaaccacctcgccctgctgtagatacgattattaagcccattttactgatgtgaaaaatgagggttaaagaagtcaggtaacctgcctaagctcacacctaagtgccagagctaggattaggaatcaggttctttagattaaaagtgatttagccaggcagggcacggtggctgacgcctgtaatcccagcacttagggaggccgaggcaggaggatcacctgaggtcaggagttcgaggccagcctgaccaacatggagaaaccccatctctactaaaagcacagaattagccgggcctggtggtacatgcctgtaatcccagctactcgggaggctgaggtaggagaatcacctgaacccaggaggtggaggttgcaatgagccgagatcacaccattgcacttcagcctgggcaacaaagaaagactccgtctcaaaaaaaaaaaaaaaaaacaagtgtgacttagtcacaaccttatgctagctttctctaagataggcttctttatctccattttacagctggagaccaagatatgatcccaggtcaaatagctaagaactcacaaaacacattcaaaccctcatatttctctcccaagccctgtttcctaaaaattatgttgctacttctcattctcctttgccggaactcctcatcccaacctttaaacttctgagttcttcggcattacaagtctaggctccctctttcatactgaggacctcaaaaatatctttattttacttttttgagatggagtctcactctgttgcctaggctggagtacagtggcgcgatctcagctcattgcagcctccacctcccgggttcaagagattctcctgcctcagcctcccaagtagctggaattacaggcagtcgccatcatgccctgctaattttcatatttttagtagagatggggtttctccatgttggccagtctggtctctcgaactcctgccctcaggtgatccacccgcttcggcctcccagattcttggattataggcatgagccaccgcatccggtcagattttttttttttttttttttttgagacggagtctcactctgtcactcaggctgcagtacagtggcatgatcttggctcactgcaacctccctttcccaagttcaagtgattctcctgcctcagcctcctgagtagctggaattacaggcacatgccaccgcactgctaatttttgtatttttagtagggatgggttttcaccttgttggtcaggctggtctcaaactcctggcctagtgatccgcccaccttggcctcccaaagtgctgggattacaggcatgagccaccgtgcccagtctctctctctctccccttgcttgctctctctctccttactctcctctctctctctgtcatctctctctctatctttctccctgcccccctcctttctctcttctctgaggaaagcaagcttccatgttgggagctgtccttcggagaagcccacatggcaaagaactgagggtggcttctggccaacaaccagtaaggaactcatgcctgccaacagccacgtgactgaacttggaggccagttctctcccagctgagccttcagatggaatcacaatctcactggaattgcaactgcctcctgagaggccttgagccggagcccctaagctaagctctctggcgtactgacctgaaactgtgtgataacatatggctgttgtatcaaggcactaagttgtggcgtaatttgtcacacaccaatagattactagtacgatgataatcattattttaatattacctatcagccgggcatagtggctcatgcctataatcccaacactttgagaggctgaggcagtaggattgcttgagcccaggcgtttgagaccagcctgggcaacatagtaagaccccatctctacaaaaaaatacaaaaattagctaggcgtggtggtgcacgcctgtggacccagcttcttgggaggctgaagtgagaagattgcttgagccccggaggtcaagactgcagtgagccatgatcgcgccactgccctctggcctgggcaacagagcaaaatcccatctcaaaaaaaaaaaaagaaattactgtcatatacatgtacttacattcatatatttttgtaagtatgatacatttcacaatgagagtgtttaaacaaggaaaaagaggtgatcgtgggtataagccagaagaaagaaaagaaaagaagtcatcattttaaaaatgttatacatgtattttaattttattttatgaaatagagacaggatcttactatgttgcccaggctggtctcgaactcttggcctcaagcagtcttcctgccttgacttcccaaactgttggaattatgaacaggagccatcactcttggctgaaaataagtagttttttgttttgtttttttgtttgtttgttttttgagacagagtctcactctgtcgctcaggctggagtgcagtggctctctcttggctcactgcaacctccccctcctgggttcaagcgattctcctgcctcagcctcccgaatagttgggattacaggcaactgccactaggcccaactaatttttttgtatttttagtggagccgaggtttcaccatgttggccaagctggtttccaactcctgacctcaaatgatccgcccacctcagcctcccaaagtgctgggatttcaggcatgagccatcattttttaaggaatttctatcaaccaaggaagaaatgagaataagtaatagcaatagcaaaaggatgtttttgtctaccctaaagagttgatttgaataaatcccatcttctcgcccttctgggtctgaatagttggtcatgtataccctactcttaaaactctagtaagccgggtgcggtggctcatgcctgtaatcccagcactttgggaggctgaggcgggcggatcatgaggtcaggagatcgagaccatcccggctaacacagtgaaaccccgtctctactaaaaatacaaaaaatcagccgggcatggtggcaggtgcctgtagtcccagctactcgggaggctgaggcaggagaatggcgtgaagccaggaggcggagcttgcagtgagccgagatcgtgccactgcactccagcctgggcaatacagcgactgagactccgtctcaaaaaaaaaaaaaaaaaaactctaattaaagtgggcaggggtaaggaaagcaagtgaaattagtcctctgttgtgataaataaattctgagttacatatcaaattcaataatacatgtacatgccccatcatcaagatcatttgagaatttctgttaacaaaaagttgttggtagaaaatatggtatgtggctgggcgcggtggctcacacctgtaatcccagtactttgggaggcctaggtgggtggatcacctgagatcagaagttcgagaccagcctggccaacacagtgaaaccccgtctctactaaaaatacaaacatcagctggatgtggtggcacacacctgtaattccagctactctggaggctgagggaggagaatcgcttaaacctgggaggcggaggttgcagttagatgagattgcaccagtgcactccagcctgagcaacagagcgagactctgtctcaaaaaatttttaaaaataaaataaaagtataaattctagatgggtgtggtggctggcaggtgcctgtagtcccagctactcaggaggctgaggtggaagaatcacttgagctcaggaggtcaaggctacagtgagccatgatcacaccactgcactccaacctgggtgacggagtgagacctgtctcataaataaataaataaatgtgttattttattttatttatttatttatttattgagacagagtttcactcttgtagtccaggctggagttcagtggtgccatctcagctcactgcaatcttcccctctctggtccaagtgattctcctgcctcagcctcccaaggaactggggctacaggtgcacgccaccacacccggctaatttttgtatttttagtagagactgggtttcaccatgttggccaggctgtcttgaactcctgacttcaggtgatccacccaccttggcctcccaaagtgctgggattacaggcgtgagccaccacacccagccgttaatttaaaaaagtgtaaattctagcatgctcagtgctttaaaaaataaaccaaagagtccaagcaagcacccttcttcaaaaataaaatagtcctgtgtctagcctagtgaactgaccattcgcatatttgaacactctattaatgagaaaaaataagccaatacctagaatattccagcccaggctggagtgcagtggcgtgatcatggctcactgcaacctgggctcaagtgatcctctgacctcagcctatggagtagctgggactgcaggtgcacacaaccatgcccagctaatttttttttctttctttgcttttctttcttgcttttttttttgagatggagtttcgctcttgttgcccaggctggagtccaatggcgcgatttcggctcactgcaacctccgcccccccgggttcaagtgattcttatgtctcagcctaccaagtagctgggattacaggcacatgccagcatgaccagctaatttttgtttttttgtttttgttttttttttttttgagacggagtctcactctgtcaccagactggagtgcagaggtgatatctcggctcactgcaagctttgcctcctgggttcacaccattctcctgcctcagcctcccgagtagctgggactacaggcgcccaccaccacgctcggctaattttttgtatttttagtagagatggggtttcatcatattggtcaggctggtctcgaactcctgacctcatgtgatccacctggcttggtctcccaaagtcctgggattacaggcatgagccaccgtgcctggacttaatttttgtattttttgtagacacaaggtttctccatgttgcttaggctggtctggaactcctgagttcaagcggtccacctgccttggcctcccaaagtgttgagattacaggcgtgaaccatcatgcgtagcctcatattcctattcttacatccagtcattgctaattgtcttgcaccctgacatacacatttgctcaccaggcctcatccatgttcaagatcattaaatcccaggaatcatgccaagggccactatggtgaataagaccttgttataataatagttaatatgccttaagtacttacaatatgccagggactgttgtaaagtgttttacatatagctacaccaaacctatcaggtaggtactattacaaccccattttacttacttacttatttatttttatttgcttatttttgagacggagtttcgctcttgttgcccaggctggagtgcagtggcgtgatctcagctcattgcaacctccacctcccgggttcaagaaattctcctgcctcagcctcccaaacagctgggattacaggtgcacaacaccacacctggctaattttttgtatttttagtagagacagggtttcaccatattggccagggtagtatggaactcctgacctcaggtgatctgcccacctcggcctcttaaagtgctgggattacaggcatgagccaccgtgcctggccacaatcccatttttgaggcttaaagagtttaaataacttcccaagaccccacagctgtaagtgctagcatcaatacttgaatacagacagtcgggcactgacacccatacgttcattggacaaatatttacaatgcacctattttgtggcaatcgctattctaggcacttggtttttcagtgatcatctatgcacagtgctcagttcatccaggcactaggctcataagctcatcagtgagcaagacctacagagatctttaccctcatggagtttactcattagtcaggggagatagacaaacaatgataagcagattatgtagtatattaggaaataagtgtgataataaaaataagaagtacagcagaggctgagtacagtggcttatgcctgtaatcctagcactttgggaggccgaggtaggtggattgactgagctcaggagttcaagaccagcctgggcaacatggcaaaaccttgtctctaccaaaaataccaaaaaaaaaaaaaaaaaaaaaagggctgggcatggtggcacacacctgtggtcccagccagttgggaggctgaggtgggagtgtcgcttgatcctggtagactgaggttgcagtgagccaagattgcatccctgcactccagcctgggtgacagagtgagaccctgtctcaaaaaataaaaaaaaaaaattttaaattaaaaatttaaaaaagtacagcagaatcaggggaccaggagtataaggggtgaggcagctagttgcaattttaggaacagcaggtagacctggctgagaagataacatttatttcttttttctaattttggttataattttaaaaataattttaaaatgctgaaaagcacagtaaataaaataaatacgcatgttctctctacctacaatgtgaaaaatgctaacattttgctatatttggttcaaaatattctaaagaaactaaagcaggagtgtccaatcttttggcttccctgggccacagtggaagaattgtcttgggccacagataaaatatactaacactattgataactgatgaaatatacacatatacatatttatggagtttttttgtgattttttttttctcaaatatatttatttgagatggagtctccctctgtcaaccaggctggagtgcaatggctcaatctgggctcactgcaacctccacctctcgggttcaagcaattctcctgcctcagcctcctgaggacctgggactacaggtgtgcaccatgatgcctggctaattttcatattttcagtagagacgaggttttgccatgttggccggggtgctcttgaactcctggactcaggtgatcctcccgccttggcctcctgaagtgttggaattacaggtgtgagccatagcgctcttttctctctctctttttatttttatccctagtcctgcagtccttctcttgtctgaccacttgacttcccaactgttaccaatgcattcatcagacagagatgtattaatggcttattatgtgcttagactgcaataccagagtcatttcctagaaggaaggaatggttttaacatctgtgcttcatcacattcaatcctgaaatacttaattttgtgcagtagaagattaaaagaaactatttgtaatagcactaatataagaccttgacttcggttatggtaagtaatagagaaagaccatttcgatggattttgaaatctttacattcttttctgaatcccagacccaaaaacccatctctgttgaatggagcaagcaaattaaatggagtgtaaaatgaaactgtgatactgtgtatgtcagcggaaactgatgggtcttacgagttcaagatttgcaagtctaaacacttgaaaagtatggccaccttaattgttttgtgatttagctcctaatcctcctcaagcagtatttatgcaaaagcattgccagcagcagtcgggagttcttaattttcatcctgttttgctttatcctaaagtacgagtgaactcatgtaagaaagaggtttctcatccaggcgcggtggctcatgcctgtaatcccagcattttgggaggccgaggcaggcatatgacttgagcccaggagttcaagaccagtcgtgagcaacatggtgaaaccccgtctctacaaaaagtacaaaaatgagcctggtgtggtggcatgcacctgttttaccagctactcggtgtaaggttatctgaaagacaggacgagagagacccaaggtcaggcgagtaattttattaacctgccaggctgctccatcacagtcagaggatgcagccctgagcttacaaaatgaggggtgtgtatgggggagacagaccctggggttgtttgttggttaactttaccaatatcatctcatgaatggcttacaatacattatcttgtgaaaataggaatttacaagagggtgtaatttaggtttatctatgtttcttgtgacctcccccatgctgcccacagggctgtaatagcaagtctggtgaccttgctgtggtgcctagataaggtttctggaatgcagctgcagagtattcagggtaagggccagctgcattgaggtggggggttcctggggcagcttgtccctaacactcagaaggctgaggtgggaggatcactttagcccgagaggtcgaggctgcagtgatcacgccactgcactccagcctgggtgaaagagcaagaccctatctcaaaaaaaaaaaaaaaaaaaaaaaaaaggaagcagctcattatttattgaattggaacaattcctaagatatatatatgtgtgtgtgtttgtgtgtatggcagtaatatatatatatatatattttttttttgagacaaggtcttgctctgtctcccaggctggagttcaatagtgtgatcatggctcattgcagcctggacctccccggctcaagcgatcctcccacctcagcctcttgaatagctgagactacaggtgtgtgccaccacaccctgctaatttatttttattttctatagagatgaggtctccctatgttgcccaggctgatctcgaactcctggcctcaagtgatcctcccagctcagcctcccaaagtgttgggattatagatgtgacccgttgtacccagccatgctttgttctgttttacaactatatagtattccattgtataggacttttacgtaatcccctatttttggatatttaggtgctcacaatcttttcttttttttttttttttttttgagcggagtctagcactgtcgcccaggctggagtacagcagcacgatctcggctcactgcaagctccacctcccgggtttacgccattctcctgcctcagcttcctgagtagctgggactacaggcgccaaccaccacgcccggctaatttttttgtatttttttagtagagacgtggtttcaccatgttagccaagatggtctcaatctcctgacctcgtgatccgcccgcctcggcctcccaaagtgctgagattacaggcatgagccaccacgccgggcctcacaatcttttctttcaattatagacaacgctacaatgaatatgtacaaaattgtgtgtgaatgtgtacatgaaagtctgttctttgtatgaattcccaaaggtggaactgctgggtcaaacagaatgtattttattaattttgtaagatattcacagtctgccctctgtatagttcgtaccactttacatttttaccaacaatgtatgagagtacctattgcccatacctttaccaacacagcatgctatcaaacttttagaaacattttgaactctgccaatctacatcaagtattctcacctgaggtccacaggcctcaagaaggggtttctctccctgtagtaccaaagtccaccttccatacaaaatctcagtttcaagcatcccactatctgaccaccagttcactcattctagtgtctgcacttcaactctttgcctcttgttaccctcaatccactggtcctatcaatttttcagtgtcaacctcccttttgcttgtcccgttacccagcctagtttctatggctcaatgctgtgaacactcccttgcctaatgtcttcatcaaacctgctaagcaaaaccccatacttgggtaaattcatctccattctgccctgtacctgcaaagggagctgaatatatctggagaaaaactcgcaaccattctgactggtcttgaagcctcagtgggctgttggcaacccccaaatcatgactgttcccgataagtcctctttctcagcccattgtctcaaaattttttcttccctttcaaacctcctcccatatctcctcactccctctttcagctgctgatcttgctttttcaccaaaattagaagcagaaaagaattcccatatccttccatgatcaaatctatcaatgcacatgagtatgtatctgattctttgcttttccttcttttttttttgagatggagtttcattcttgttccccaggctagagtgcaatggcaggatctcggctcactgcaacctccacctcccgagttcaagcgattctcctgcctcaacctcccgagtagctgggattacaggcgcctgccataatgcctggctaacttttttgtatttttagtagaggtgggttttcaccatgttggccaggctggtctcgaactcctgacctcaggtgatccacctgcctcagcctcccaaagtgctgggattacaggcatgagccatcgcgcctggcctcctcttcttatataaaatgtccatgcccctgactaagattatcttttcgttcgtggatcaacttgagggacattgatcctgtaattaacccctcctttctactcaaagctctttagattatccagttatcccatatctattcttcactgccatctccttggtgtgctcttgtctttgtgcatttgcctaactcctcatgcctcaagattctgttctaatttcccttccacttgcaggttcccctaacacactcagatctcagaaattttcttttcccacagccccacccgtccaaagagctaggttcccacaggttcacaaccaaggaataaaaaagacaagtccggccaggcgcggtggctcacgcctgtaatcctagcactttggaagcctgaggcaggctgatcacttgaggtcagaagctcaagaccagcctggccaccatggtgaaaacccttatctactaaaaatacaaaaaaattagccagggctgggcacgatggctcacgcctgtaatcccagtactttgggaggccgaggtgggtggatcacccgaggtcaggagtttgagaccgtcctgaccaacatggagaaaccctgtctctactaaaaatacaaaaatttgctgggcatggatggccgggtgcagtggctcacgtctgtaatcccagcactttgggaggccgaggtgggcggatcacgaggtcaggagatcgagaccatcctggctaacatggtgaaacctcatctctactaaaaatacaaaaaattaactgggtgtggtggtgggcgcctgtagtcccagctactcgggaggctgaggcaggagaatggctggaacccggaaggcggagcttgcagtgagccgagatcgcgccattgcactccagcctgggcgatagagcgagactctgtctcaaaaggaaaaaaaaaaaaagattagctgggcgtggtggcgcatgcctgtaatcacagctacttgggaggctaaggcaggagaatcacttgaacctgggaggcggaggttgcagtgagtggagatctcgccattgctctccagcctgggcaacaagagagaaactctgtctcaaacaaacaaacaaacaaacaaaaacaacagcaacaaaaattagctgggcgtggtggcaggcgcctgaaatcccagctactcgggaggctgaggcaggggaattgcttgaacccgggagatggaggttgcagtgagccgagattgccctactgcattccagcctgggcgacagagcgagactccgtctcaaaaaaaaaaaaaaaaaaaaaaaaggaaaaaaaagacaagcccttgcaaaaccaggtccaaactagcaagatggggaggccaccaaagtgtggacctaaggggtcccagctacagtagctgtgctggatgacgctcctgtgcttgcagggggcacttacatgtgcctacattatataatctatcatcctgtgtgctgagttctatctacagctagactgggaactaagggcagaaactgtgccttattaatctttgtaacccagcagagtgctttatgagtgtactggttgaatgagtaagaaggaggatgtcttgggcttgtatgtataatattcctaggagtttggggtatagctgcacagcttactggaacgaaggatgactaaccaggtaaggatgcagactctctctcctaccatactggcaaagttaaaagtaagccacagaaaaaaaatcatttgggaaactcactcagagacagaccaactaatcgttcatgtccagtttcttttgactcttatccctttcttccctgctccctttaccctatttccttctttctctcttaatgttttttgtttgtttgtgagacagagtctcgctctgtcgcccaggctggagtgcagtgggcacgatcttggctcactgcaacctctgcctccagggtttaagcgattcttctgcctcagcctcccgagtagctgggactacaggcacccgccaccacactcggctaatttttgtatttttagtagagacggggtttcaccatagtagccatgatggtctcgaactcctgacttcgtgatccgccctccttggcctcccagagggcctcccagagtgttgggattacaggcatgagccactgcagcctgttttgtttttttttttttgttcgtttgtttgtttgtttttgttctgttttttttgagacggagtttcgctcttgttgcccaggctggagtgcaatggcgccatctcaactcaccgcaacctccacctcccgggttccagcgattttcctgtctcagcctcccgagtagctgggaccacaggcacccaccactacgcctggctaattttgtatttttagtagagacgaggtttctccacgttggtaagactggtctcgaacccccgacctcaggtgatccgcccgcctcggcctcccaaagtgctgggattacaggcgtgaaccaccgcgcccgacctaatttttgtatttttagtagagatgggttttcgccatgttggacaggttggtctcaaactcctgacctcagatgatcctcccgctgtggccccccaaagtgttaggattacaggcgtgagccaccgcgcccggcctctgttaatgtttcttaagaaaacaaaaaaattaggggtattgattttgtagctgcgctaagtaacctttgctttttgcgtcccttggtctcagtcctagccatttcctatccaccctgtggctaatttgtcctttctgtaacagacaccctagactgtgtctatgcggttgggcagaggcgtgatgggtaaacactcctggcgggagactacaggcgctgcagctacatcctgtttcgtactgggagcaggtgccgccccgcggaacacttacttgccccgccctgcggtggagcagggcggtctcagccgccggaaccgccctggaagcccgccccaatcctgggcgtcgcttcgctgtgagtgccgctgccacggattggcttccagggtccggcccgtcggccaatcaggcgcgggggcgttgtctgggggcggggctccggccgcctctgacgagtcccggatttaccagggccggtgggatcccctcgggctcccgccttagcatgctggccgggacatctggtgaacatggcctctgctactgcggcagcagcacgacggggcctcggccgggctctccctctcttctggcgtggctaccagaccgagcggggcgtttacggctaccggccgaggaagcccgagagccgcgagccccagggcgccctggagcgccccccaggtcggggatggggcccgggcggtgggagcgggggctgggacgcagaagcctcccctggccgatttgcggtggggtgtcggggtcggggaaccggctgccggcctgaacgcgcggccggtggggaggagggggaggtgaggggagcagagggtaggtgtgggtgctcagtgttggggtcatcccccgtccatcctctgtaactgaggatctttgaggtccacgcttgggtggtcttcccatcttgctggtccggacctggtttcggaagggcttttctttcctttgttggaaacgtgtgagaaactctttttttctttctctttttgtttccttttttttttttttttttttttgagacggagtctcgctctgtggcccaggctggagtgcagtgctgcgaccacagctccctgcagcctcgaactcctgggctcaggctatccttccacctcagcgtcccgagtagctggggacacagagggatgaccacgcccagcttttttttttttttttttttttttttcatttttagtagagatggggtcccaccatgttgcccaggctggtcttgaactcttgagctcaagctgatcctgcagcctcggcctcccaatgtgttgggattacaggctgagccactgcacccagcctagaaaaccagctctttaatgaggcggagctgtgggagaagtaaagttttaaggtctcccaaggatacatttccaggaccatctctgaggcttcttttatgtgagcaggtgggggggtccaagactgcattgcttgggagaagtgggcagttagttccagtcttggaagacagcatgatatttattatgtatttgtctccttgtagctagtctgttactttaatttcagagtttaactcttaactctgctgaatttggaactatgtgctggtggggtttctttcttttccttttagccactctattgacaccttgatatgtgctggtggttttaatgaattaacagtcatgaatatcagcttttggaacttctgttgcatgctcatttgcgagactaattttgagtatttggtttacgctccaaaattattgtatcattatttatcctcacggagtagaagataagtacagattgcttattagaggaaaatcatttggcatctttgatctgatcattagattaatgttgaagatccccttcggcatctgggcacctgaccttggaatgttccatcaatcacacactagaacttcaatattttgctcttcacttcggagggcatttaaaataaacctcatatctctgtctctctctctttttttaatcctaaaatggagtctggctttgtcgcccaggctggagtgcagtggcacgatcttggctcactgcaacctctgtcttctgggttcaagcgattgtcctgccccagtgttccgagtagctgggattacaggcacctgccaccatgcccagctaatttttgtatttttagtagagatggggtttcaccatgttggccaggctggtcttgaactcccgacctgaagtgatccactggccttggcctcctaaagtgctgggattacaggcatgagccaccgtgcctggccaagagggaacctcctttttgcagagccgaattccccttcctgtctacttgctcattagggagctccaacttgacctcatctttcttcttgggccttcctgaaagtgacaagatacaatgaacatacgctcctgagctacaggcttcaagggcatgtagtctgcctcagtcctgtcctacaggacaaaaaccaaatgttttgtcctgtagcataacactgcccatcagctttctaggtggaaatacctgtgtccttggtacccattgcctggctgctaatccaatgccatatatatttttaggctctgttagggcagcaacccacctctggtaccaaattctgtattagattggaagagttcaggtgctgtgatatacaaagagaagggatatcttctttccttccccttacggtcatgacccagaagttgcatacattgctgctacgttcccattgtccaaaacttagtcacatggccaccaggttatggggaaggctgggaggtggctctttgttctgggtggccatatactgggctctctattactatcaaagagagggttcagaatggaagttaggaatcgtagcagtctctgccacagaggtatagtaatctgagatgagcaatccacctttatctttttcacctcatatttcacatcaaatctttttagtttttattttttaaattttatttattaggccgggcgcggtggctcatgcctgtaatccctgcactttgggaggccgaggtgggcggatcaccaggtcaggagttcaaaactagcctggccaacatggtgaaacctcgtctctagcaaaaatacaaaaattagctgggtgtggtgcagacgtggggccaggcacagtgactcacgcctgtaatccccgcactttgggaggccgagacagacagatcacttgagacagggtcttgccatgttgcccaggctggtctcgaactcctgtcctcaggtgaaatgcttgcctcggccccctaaagtgttgggattataggcgcgagccaccgtgtccagccccaaataatttatacttcctaaggaatgaaaagagggttctatatacgcaatttatttgtgacatatagtacatttgcattttgtatgtgcaaacgtaacattaattatcaagtatctttatatgttaggcaacatattaaactattaccgtgttttatttttattttttgagatgagatctttctatgtcacctagtctggagtgcagtggtgcagtcacagctcacttcagcgtgcgccgggttcactggccttctttcttcatatgtttatcttggctaaaataaatgtctacataggatgaccacatcattcactaagacttcccttgtattaaggctttaaagagatattgagcctgggtgtggtggctcatgcctgtaatcccagcactttgggaggccgagctgggaagatcacttgaggccagaagttccaggccagcctggctgacatggtgaaaccccatctctactaaaaatacaaaaattgacctggtggtgtgtgcctataataccggttactcgggaggctgagtcaggagaatcacttgaacctgggaggctgaggttgcaatgagctgagatcaagccactgcactccagcctgggtgatagagcaagactctgtctcaataaataaataaataaataaataaataaataaataaataaatacaaataaataattaaatagatattgaatttgcctctagtaaccttttggatggcagtggtttcactagttacaatttgacccatgatgagtgttctttgtaactaggtatttgtaacagcttgtactttcacctctgtaaaccttgatttccaaggaaacttgaatttatttatcaacaatgccaatttaaaatggaggtgggtttaggagtagtgattcatgggtgttcttccttttttttttttttgagatggagtttcgctcttgttgccgaggctggagtgcaatggcacgatctcagctcaccacaacctctgcctcctgggttcaagtgattctcctgcctcagcctcctgagtagctaggactacaggcatgtaccaccacacctggctaattttgtatttttagtagagacagggtttctctgtgttggtcaggctggtctcgaactcccgacctcaggtgatccacccacctcggcctcccaaagtgctgggattacaggcatgagccaccgtgcctgacctgtttatttgtttttttgagacacagtcactccgtggcccaggctggagtgcagtggggtgattttggctcactgcaacctattcctcctgggttcaagtgattctcctgcctcagtctcctgattagctgagattacaggcatatgccaccccgcccagctaatttttatatttttagtagagacgtggtttcaccatattggccagggtggtatcgaactcctgacctcaagtgacccaacaacctctgcctcccaaagttctgggattataggcatgagccactgcacccagtccatgaaaatattagctcttttacttttttttttggacagggtcttgctctgtcacccaggcaggagtgcagtggcatgatctcagctcactgcaacctctacctcccgggtttaagagattctcctgcctcagcctcttgagtagctgggactacaggtgctcaccaccatgcctggctaatttttgtatttttagtagaaacagggtttcacatgttggccaggctagtcttgaactccggagctcaagccatctgccctcaaccaggcttttctgaaggctgcagtctctggctagcttttttctcataagctatctctcaattccgagtttcaaaatctggaaaagctcagtctggcccagcttgactcagcctctccagcagcaaggcagactggagtaatgcgtgcatccccaccaggccccacagcttggcatgggagggtgcaaagtgagggagaagaagctgcttcagctcttgtactctaagtttgagggctctgaaaagcttttatcatgaagcatgactcttgatctcaggacttcattcaaataataacaaatatttcttgagcgtctaccatgtgttagtcttctgagccagaagcatgcctctgatattctcctttatttttaagaggagtgcaggcgtgtatctgctgttgttttctctattctctctggcttcgttacggacttaaacatcaaatctaattcctgtgaccttttgcagatattatgaacagtaaactgtttgggcggtattacgcctaacgtaaaggtattcatttttctcttacagtaattctttcatttctgcagtaatagaaagttttgctttttgttttgttttgttttgttttgttttctttgagacactctgtgtcgcccagactgagtgcagtggcacaattacagcttaccatagcctcaaactcctgggctcaagtgatcctgccacctcagtctcctcagtagctgagatcacaggcacgtgccaccacatccagctaatttttgtatttttttgttttgtttttgagacggagtcttgctctgtcgcccaggctggagtgcagtggcacgatctctgctcactgcaaactctgcctcctgggttcacgccattctcctgcttcagcctcccatgtagccaagactacaggtgcccgccaccatgcccggctaattttttgttttttttttagtagagatggggtttcaccgtgttagccaggatggtttcgatctcttgacctcatgatccaccctcctcggcctcccaaagtgctgggattagaggcgtgagctaccgcgggtcttgctatgttgccccaggctggaatgcagtggccaaaatctccactgcactccagcctgggccacggagtgactatgtctcaaaaaaacaaataaacaggtcaggcctggtggctcatgcctgtcatcccagcactttgggaggcagaggtggtataagaacaatagcaaacatacagggcaatccccattcccattgcaaaccagcggccatattgaaaacgtccccttagaggccgaagccagtgggttacttgaggtgaggagttcaagaccagtctggccaacatggtgaaatcccatctctactaaaaatacaaaaattagccgggtgtggtcgcatgtgcctgtggaggctgaggcaggagaatcgctggaacctgggaagtagacattgcagtgagccgagatggtgccactgtactccggcctgtgtgacacagcaagactttgtctcaaaaaaagaaaaaagaaaacatccccttagagaagaacctatgtcaatgcatagagatcactgcttctgtttctttttcttttttttgagacggagtctcgctctgtcacccaggctggagtgcagtgacacaatctcagctcactgcagcctccgccttctgggtgcaagtgattatcctgcctcagcctccaagtagctggggttgcaggtgcttctcgccatgcccggctaatttctgtggggttttttttggttttggttttgtttttctgagatggagtcttgcttatgattttttttgtatttttagtagagatggggtttcagcgtgttagccaggatggtctcgatctcctgaccttgtgatccgtccgcctcggtctaccaaagtgctgggattacaggcatgagccactgcgcccatccaatttttgtattttttgtagagacagggtctcactctgttgcccaggctggtctcaaacccttgacctcaagaggtcctcctgccccagcctcccaaagtgattacaggtgtgagccacaatggccatccagtaataggaagtattttatgaataattctattgctgtgctctcattcttttaaattttatttttatttatttttctatccttccagggaaaaagaattaaatcttttaatttcattctttattataaaggtaatacagttgaagtacgttttatctagagcatttgaaattggaacttgatcagttaattccatttatttttattttacttcttttttttacttcttttgttttttcttttaaaacaattttgacagagcgagactctgtctcaaaaaaaaaaaaggaaaaagaaaataaagcaatctgaatgcaaaatctctagatttttctgatttcttcccctaattttactttttcccacagcaacagtcttagggacaaatagaactgattcttataagcacaaagtcaactgatgagagcagtgctgcatatgctagagagaagccacaaaccaaagcttttagagtgagtgcatcaggcagcaagtccgctaaatggctgcattcgaaagagctttattgccgagtgcggtggctcacgcctgtaatcccagcactttgggaggccgcggtgggcggatcacgaggtcaggagatacagactatcctggctaacacggtgaaaccccgtctctactaaaatacaaaaaattagctggatgtggtggcacaggcctgtagtcccagctacttgggaggctgaggcaggagaatcgcttgaacccaggaggcagaggttgcagtgagccgagatggtgccactgcactccagccttggcaacagagcgagactctgtctcaaaaaaaaagagctttattgtacatgttcactgtggaaaactgtgagaatacagtaagcaaaaaatagcaaatctgcctgggtgtgatgacgtgcacctgtaatcccagctacttgggaggctgaggcaggaggatctctcgagcccaggagtatgagtccagcctgggtaatatagccagaccctgtttctttttttctcgggacggagttttgctgtgtcgcccaggctggagcgcggtgacgcgatctcagctcactgcaagctccgcctcccgggtttacgccattctcctacctcagcctcccgagtagctgggactacaggtgcccgccaccacgcccggctaattttttgtatttttagtagagacggtttcaccgtgttagccaagatagtctcgatctcctgaccttgtgatcctcctgcctccgcctcccaaagtgctaggattacagacgtgagccaccaagcccagccagccagaccctgtttctgataaaaaaaaaaaaaaaaaaaaggaagaaaaaagaacaagtcggcaatttctacataggattatcacttaaatttttgatcagtttcttttgtttatgaaaaatatatgtgtgcatatatataagtatatataattacatatactaatacatatactataagatgaaatatatattataaactactcatatgtacatacacagtgtaacaatgtaggtgcatgctttatatgttgtggtcattcattaagtgttttttgttttttttttttgagatggagtttcatgcttgtcacccaggctggagtgcaatggcacaacctcggatcactgcaacctctgcctcctgggttcaagcaattctcctacttcatcttcctgagtagctgggattacaggtgtctgccaccaggcctggctaatttcttgtttttagtagagacagggtttcaccatgtgggccaggctgatcacaaactcctgacctcaggtgatgaggtcaccttggcccgccttggcctcccaaagtgctgggattacaggcatgagccactgtgcccggccattcattaagtctggatgctttttcatcaatcattcttctacaatattattttttaatggctgtcggcaatttgagatgagttaatgccattgcttgttcctcagaggatgggtttataaagagagaactaatgatagggagatgtcaatgaagaatgaggagggcctacgtttgtcttcaagattggagggtgcgggtgagggccactgagtaccttcacgtcgtactcatgctctctagggacagccaagttctgattaaacccaggagtgtgaggaacgttcagagaggtttgtttttcatgaaacagagtgccagaggtctcggtggaaggaggtggagacagagagggaaggggttggagatagggttggtggaagaagaaacctgcccgaagaaatggtagtctgagggagcatgtgttgccagggtgaatggaggacgtgcctgacatgagagaggacttcctctttctgctggtgccaaactgctacatgcctcatgttctttgtggcaaggagggttattttgtgccaacttctgtgtcagtattctagtgtatcattagcagcctggctagtgagtacttagaaatagaagcagtgggccagtcacagtggctcatgcctgtaatctcagcactttgggaggccgaggcgggtggatcacctgaggtcaggagttggagaccagcctggccaacatggtgaaacctcttctctactaaaaatacaaaaattagccaggtgtggtggcacgtgcctgtaatcccagctactccggagactgagatgggagaattgcctgaacctgggaaacagaggttgcaatgagccatgatcgtgccgctgcactccagcctgggcaacagagcaagactccacctcagaaaaaaaaaacaaaaccaacaaaaaccccacaaaaattagccgggcatggcggcacgcacctgcaaccccagctacttggagactgaggcaggacaatcgcttgcacccaaaaggcggaggctgcagtgagctgagattgtgtcactgcactccagcctgggtgacagagtgagactccgtctcaaaaaaaagaaaaagaaatagaagcagtgatctctaggcattgacatgggttcttctctaaggggatgttttcttttttctttttttgagacaaagtcttgctgtgtcacacaggcgggagtgcagtggcaccatctcggctcactgcaatgtctacttcccaggttccagcgattctcctgcctcagcctccacaggcacgtgcgaccacacccgactaatttttgtatttttagtagagatgggatttcaccatgttggccagactggtcttgaactcctgacctcaagtgacccactggcctcggcctctaaggggacgttttcaatatggctgctggtttgcaatgggaatggagattgccctgtatgtttgctattgttcttataccactaatcatgagttggggggagatcgctcagagagaaagtagactgagaaggtggccttgggcagagctggggagtaccaatattttatgtattttattttttagatatgggatcttgctctctcacccaggctagagtgcagtggtgagatttccagctcagtgcagcctcgaactcctgggttcaagctcctccctcagcctcttgggtagttgggattataggtgtgcaccaccatgcctggctaccaatatttagagttgggcaaagagaagtccctcaaaagtgactgaggttgagtagctctggagttagaaagaaaaccgggttcctgcaatgctgtagagcccagggaagaatatgttcttaaaaggagagagtaggagctgggtgcggtggctcatgcctgtaatcccagcactttgggaggccgaggcaggtggatcacaaggtcaggagatcgagaccatcctggccaacatagtgaaaccccatctctactaaaatacaaaaaataagctgggtatggtggcatgcacctgtagtcccagctactcaggaggctgaggcaggggaatcacttgaacccgggaggcagagattgcagtgagccgagattgcaccactgcactccagcctggcgatagagtgagactccatctcaagaaaaaaaataaaaaaataaaaggtgagagtggcccacagggacatgctttagacatagtctgtctggattttagccacaaatataaaggtttcctacttcatatgacactgatggagaacttgaataaggttcaaaatagaacccttagcaatttataggactaacccccaggctgaaatcagttcgtttcctgggatggtttgattcatttatttgagctattatggatccacctaactggtgtatgagtgcaaacacatcctgtgtgtgttcaatacctctctgttctttcctcactaaacctgctacaagtaaagaggtgtgctttggctgggtgaggtggctcacgcctgtaatcccggcactttgggaggccgaggtgggtggatcatggcatcaggagatcgagaccatcctggctaacatggtgaaaccctgtgtctactaaaaatagaaaaaattagctgggcgtggtggcgggtgcctgtgggcgcctgtaggcgcctgtagtcccagctactcaggaggctgaagaaggagaatggcatgaacccgggaggtggagcttgcagtgagccaggatcacgccactgcactccaggctgggcaacagagcaagactccgtctcaaaaaaaaaaaaaaaaaaaagttgtgctttggcagtgcatagaatacaaacccaagtgcatgggtggctctgaaatcattccacagcaacacttgttcataaaatggaccttataagttttaaaatatgtgggccaggtacattggttcacgcctgtaatcccagcacttcaggaggcatggcaggcagatcacgaggtcaggagatcaagaccatcctggctaacacagtgaaaccccatctctgctaaaaatacaaaacattagccgggcgtggtggcgggaacctgtagtcccagttactcgggaggttgaggcaggagaatgacttgaacccgggaggcgcaggttgcagtgagccaagattgaaccactgcactccagcctgggtgacatagcaagacaatgtctgaaaaaaaaaaaaagaaaagaagaaaaagaagaagtttgaaaatatgctaacaattgtctctgggttctgaaaataaaaacacaaattgtaaaaatgtgtttcttggccttctttgagaggccaagatgagtgaatcgcttgagctcaggggttcaagaccaacctgggcaacatggttaaactccatctcaaccaaaaaaaaaaaaattagccagatgtggtggtgcacgcctgtagtctcagctactcgggagactgaggcaggaggatcacttgagcccaggttgcagtgagctgtgatggttcttggccgggtgcggtggctcacgcctgtaatcccagcactttgggaggccgaggcgggcagatcatgaggtcaggagattgaggccatcctgcctaacatggtgaaaccccgtctctactaaaaatacaaaaaaattagccaggctacttgggaggctgaggcaggagaatggcgtgaacctgggaggcagagcttgcagtgagccgagattgtgccactgcactccagcctgggcgacagagcaagactccatctcaaaaaaaaaaaaaaaaaaaaaagtgatggttctactgcactccagcctgggcaatagagcaagaccctgtctctaaaataaataaataaataaaaagtaaggtgtctagggctgtaagagcttctttgaaaatctgatttttgtgatttgtagtcatctcctaaactgtttgcatttttaaattttcccctgatttagttgatcatggccttgccaggttggtgacagtatattgtgagcatggtcataaagctgccaaaatcaaccccctcttcaccggacaagccctgctggagaatgtgcctgaaatccaagccctggtgcagacactgcagggacccttccacacggcaggtatggcttctgcacagcaggcgggagctcggagctgcacaccaggccaggctcctgcctctgttcttgaagaagcagcatccccactggagctgaggctcccgcaggtgtgaggagacccgaggggcatgttgaagtacggtccgggaggagcattcttgggattctagaagttctgaggaggcctgttttctcaaggttcaaaaacatttaattggctgggcacaatggctgacacccataatcccagcactttgggagcccgaggtgggagagtcatttgagcccaggagtttgagaccaacctgggcaacatagtgagactgtctctacaaaaaaaaaaaaaaaaaataactgggcatggtggtgcacgcctatagttccaggcactctggaggtagagatgggaggattgcttgaacctgggaggtcaaggctgcagtgagccttgatcgtgccactgcactccagcctgggcaacagagtgagaccctgtctgaaaaaacaaacaaacaaaaaaccttgaactctaaagtgccatatgcttagcatatgtcaatttattctcaaaatcactcccaaaagtagttattgtcctctttattttgtagatggagaaacaaagaggacttatatgactcatagctgctcagtggcagaggtggggtgaaatccagggctacttccattccaaagctgatacccgcctcattctgttttctttcccagcctgggaacttagaaaaagttgggcctgcatcatcagtcatgatttcagggtcctacctcatgttactttttgaagttaatcttgcaaatatcaaattctgattgtgtgcatcagtgagtcatgtttcagtcatctaatgccgtgtaataaactaccccaagacgtaatggcatttaaaccctcaatgatcattttagtgtctcttagggttcggggggttacctgggctttgcaaggtggtagttttctctcttttttcttttttttttttgagacgggcctccaaaggcccttttcttgagcctctgcagaaagatttgatttctcagcacctcataaaagcaaacacgttaatgtggaaaacataaagcgacatgattaatggctcagttggaatatagtggtgatgcatcttaacttcctcaaaagaccaatactttaaatctttttatacaaaaaagaaatacaatgaactttgttgtaagaaaccatgagttggccgggtgcggtggctcatgctggtaatcccagcattttgggaggccgaggcgggcagatcacgaggtcaggagattgagaccatcctggctaacacagtgaaaccccgtctctactaaaaaaaataacaaaaaaattagctgagtgtggtagcaggcacctgtagtcccagctactcgggaggctgaggcaaaaaaaaggagcatctaatagcaaggcgtgaagccgggaagcggagcttgcagtgagccaagatcgtgccactgcactccagcctgggcgacagagcgagactccgtctcaaaaaaaaaaaaagaaaccataggccagaggtgtccaatcttttggcttccctgggccacattggaattagaattgtcttgggccatacataaaatacactaacactaatcatagctaatgagctgcaaaaaaaaatcacaaagaaaatctcacaatgttttaagaaagtttattcatttgtgttgggccacattcaaagctgtcctgggccacattcaaagctgtcctgggccacatgcagcctgtgggctgtgggttggacaagcttgctaagcaatataaagtaaaggttggggccgggtgtggtggcttatgcctgtaatctcagcacttggagaggccgaggcaagaggatcacctgaggacaggagttcgagaccagcctggccaagatggtgaaaccccatctatactaaaaataaaaaattagccagacgtggtggtgtgcacgtgtagtcccagctactcgggaggctgaggcaggagaatcacttgaacctgggaggcagaggttgcagtgagccaagatcgtgccactgcactccagcctgggcaacaagagcaaaaactccatcacacacacacatacaaaagaaattactgtagaaacaaaacttggcataaagcagcagtaggctctgtccttgtgaaggaagtgggggctttcccccttctagttttactgcttcatgacctttgaccatatttttagttttttctttagaaaaaaatcgagataagcattaataataacccaagttatttatttatttatttattttgggacagagccttgctctgtcgcccaggctggagtgcagtggtgtgatctcggctcactgcaacctctgcctcccaggttcaagcaattgtcctgcctcagcctctcgagtagctgggactacaggcgcacgctaccatgcccggctaatttttgtaattttagtagagacggagttttaccatattggtcaggctgggctcgaactcctgacctcaggagatccacccgccttgcctcccaaagtgttgggattacaggcgtgagccacggcacccggccaataatgacccaagttattaagaacaaagcactctgcgttgaagtaattattttggtatgttccagaattaacttgccacatgatttttttttttttaaattttttttaaatatgaaaatttattttgcataggaaacaataatctctggtaaaaatcattactgcatataacaaaacaatgccttcaattaaagggggaaagtgagtttttaaacattggggttaatttagaagaaaatacagtatataataatctcaacatcatgttaaggaacatgattattttttaagatgacccctttgattgtatttcacaggattattgaacatggggaaggaagaggcctcacttgaggaagtgttagtctatctcaatcaaatctactgtgggcagatttctattgaaacctcccaacttcagagccaggatgagaaagactggtttgccaagcggtttgaggaactgcaaaaggagacgtttaccacagaagagcgaaaacatctgtcgaaactaatgctggaatctcaggtaaaaaggagcatctaggccgggcacggtggctcatgcctgtaatcccagcactttgggaggccgaggcgggcggatcacctgaggtcaggagttcaagaccagcctgaccaacatggagaaaccccatctctactaaaaatacgaaaattagccaggcatgctggtgcatgcctgtaatcctagctactcatgaggctgaggcagcagaattgcttgaacccaggaggcagaggttgcagtgagccgagattgcgccattgcactccaccctgggtaacaagagtgaaacaccttctcaaaaaaaaaggagcatttaatagcaagggcataggtcagcctcactgcctataaagatatatagcctggctgacatagagaaaccccgtctctactaaaaatacaaaaattagccaggggtgatggtgcacacctataatcccagctaatcaggaggctgaggcatgggaatccttggaacctgggaggtggaggctgcagtgagctgagatcgcgccactgcactccagcctgggtgacagagcgagactctgtctcaaaaaaaaaagatatataactactgaagagagggaattgagccattaactctgagcttaaatccctcgttacttcaacacaacagatcatataacacacaccattttattattttatttttcctcagagatccttgttctgagcatatcactttattctaagtagcaaaatgttggttgccaaaatattgacctattggctctcctcagagtcaaaatacttctcgtgtatgtgtctactcactctataaaagaccttacttaagacttacttaagaccttacttctgactgggcacagtggctcgcgcctgtcatcccagccctttgggaggcttaggtgggcgtattgcttgaggtcaggagtttgataccagccaggccaacatggtgaaaccccgtgtctactaaaaaaacaaaatacaaaaaattagcctgatgtggtggagcatacctgtggtcccaactacttgggaagctgaggcaggagaatctcttgaacccaggaggcggaggttgcagcgagccgagatcacaccactgcagtgagctaagattgcaccactgtactccagtctgggcaacagagcaagactctgtccaaaaaaataaaaaaacatagttcttaaggttttatttatttattttatttttatttttttgagatggagtcttgccctgtcgcccaagtagctgggattacaggcacgtgccaccacacccagctaatttttgtatttttagtagagacggggtttcatcatgttggccaagatggtctcgatctcctgacttcatgatccacccgcctcggcctcccaaaatgctaggattacaggcgtgagccaccacacctggccttttaaacaaaattttttaaaaatttatttaaaatttatttttcttttgttttcttttcttttttttttttttgagatggattctccctgtcgcccaggctggagtgcagtggtatgatctcagctcactgtaacctctgcctcccaggttcaagccattctcctgcctcagcctcccaagtagctgggactacaggtgcatgccatgatgcctggctaattttttgtatttttagtagaacggggtttcactgtgttagtcaggatggtctcgatctcctgacctcgtgattcactcccatcagccttccaaagtgctgggattacaggcatgagccaccgcgcccagcctaaaatgtgttagccaggatggtctcgatctcctgacctcatgatctgcccacctcggcctcccaaagtgctgggattaaggcatcagccaccgtgactggcctaaaatttcttttaatatgtgagaaaaaaaagtcttttggtaacaggacatactgtcaccattcagggctatgtacagttgcagttcttgagacagtcttgctctgtcacccaggttggagtgcagtggcacgatctcggctcactgcaacctccgcctcctggactcaagcaattctcctgcctcagcctcctgagtagctgggattacaggtgcacaccaccacacccggctaatttttagattttcagtagagacggggtttcaccatgttggccaagtctcaaactcctggcctcaagtgatccacctgccttggcctcccgaagtgctgggattacagacgtgaaccaccatgcctggcctggtcttacttcttaagaactaaagatacttaagttcagaacttaatctgagatgatcaaaagatgacatgtggaagacaggctcagtacaaatgaatggaactgaacctctgctggggctgtgaccaggactctggaatgtcaagatggcaagaagccccttcctaatagtttgggtagttggatagtttgcagccttgattcataccgtagagccccgtgtgaaaactggggtactgggaagaggcagcagaaatctaaggcctggattccagtccagaagaacacacattctaagggggtttccttggggtgagttattctgccgctcaggttattctcctcagcccctcctactgtcccggatcctaggaaaaccatcccgctgtgtccgtgttatgtctctctccgggatatgtagtaaagtggcattgctgtggccacttggggagtgtggggccatctcacaacacacacagacttatctgccttccactggagaagctggctgtctcctggcagctcacgtctgacatgatgttctgcaggagtttgaccactttctggccaccaagttctcgacagtgaagcgatatggaggcgaaggggctgaaagcatgatgggctttttccacgagctgctgaaaatgtcggcctacagcgggatcactgatgtcattattgggatgccccatagagggaggctgaatttattgacaggccttctgcagttccctccagaggtaaggttactcgctgtgtttctcagtagcactatatgattgattgtaacagaataaaactgctggtttcattctggtgataaatgatggtgatggtgatggccgggcactgtggctcacacctgcaatcccagcctgttgggaggatgaggcaggaggatggcttgaatctaggagtttgagaccaccctgtggaacaaagtgagactttgtctctaccaaaaataaaataagttagccaagcatggtggcacgcacccgtgttcccagctactcaggagactgaggccagaggatcacttgagcccaggagtttgaggctgcagtgagctatgatctcaccactgcactccaggctgggcaacaaagcaagatgctgcctgaatataaataaatttttaaaaagtaaaactcatggtgatcattcattttaggaagtcaactaaggctgggcaaggtggctcatacctgcaatcccagcactttgggaggctaaggcaagaggagtgcttgagcccaggagttcaagaccatgggtaacctcgcaaaactctgtccctacaaaaataaaaattaggtggcatggtctctacaaacatgaaaattaggtggtgcacctatggttccagctacttgggaggctgggatgggaggatctcttgagtccaggagatggaggctgcagtgagctgagactgtgccactgccctccagcctggaagacagagccagatcctgtcttaaaaaaaaaaaagaggaaaggcaactaagcatatgagcagttggtccaggaggtagcttagacagtttagttaattgacagagttggtatttggattggttttccatgtatacttacttatttatttattgagacctaatctcgctctgtcacccaggctggagtgcagtggcgtgatctcggctcactgcaacctccgcctcccaggttcaagtgattcttatgcctcagcctctctactagctgggattacaggtacctgccaccacacccaactaattttttgtatttttaatagagacggggtttcaccatgttggccaggctggtcccgaactcctgacctcaagtgatcttcccgtctcagcctcccaaagtgctggaattacaggcataagccaccactcctggctttaaattttcttttttgttgtatgatttcaactcagcacttcttccctagactccattgtgatgaatgccatttttttccttttgaatgtatccacaatagctgatgttccgtaaaatgcgaggcttaagtgaatttccagagaatttctcagccactggagacgtcctgtctcacctgacctcctctgtggacctgtactttggggcgcaccatcccctccatgtgacaatgttgcccaatccctcgcacctggaggccgtcaaccccgtggccgtgggcaaaactcgcggcaggcagcagtctcgccaagacggcgattactctccagacaactcagcccagccgggggacagggtcatttgcttacaggtacttggagcttctgaaattgaggccagaggtggggaaaactgggaagaatgtgtgggttgggagggctgaaagcacatggcagacattcatgatgaaactgagatgaccttttggaaaaagattctgggattgttttaaaaactaacaggagattcatgaggtttagtcttcaggcaactggctttagcctggggcttccacttctgttttccttgcatggcttatgaattaacttggggtttgggctggcaaacctgctccttcttagagcacagatgtcattatctctctggaagtatggccttcttggaaactttgtggttcccatacatataacaagacaagcgtgaaaaaaaaaaagactttaagtgtggttttacttcgtttcttgtttactttattatcttttcttttttatggctttttttttgagaccgagtctcactctgtcactcaggctggagtgcagtggcgaaatctcagctcactgcaacctctgcctcctgggttcaagtgattctcctgcctcagcctcccgagtagctgggactacaggcacgtgccaccacgcccagctaatttttgtatttttagtagagacagggtttcaccatgttggccagcctggtctcaaactcctgacctcaagtgatcctcccacctcagcctcccaaagtgctgagattacaggcatgagccactatacctagcctattttttttttttgcttgtttatttgaaaatgaaagtctttggtattaaggcacataacacaaattatcagtgtggttcgttctttttctaccctgtctcccagtttttggtaacacaacaagtatcttttagaggtttgggctgtggtcatgtttcttctgtgagtattcatttaaatatgaacctttaactacaggagatcatgaaacctggatttcagaatcagtcttcaaattccacagaaatagataaatatataaggcaatcaaatattctatgtttgtaaatgccacgttatcctatgcattttaatttttcacaggccagaaacttgtagtgaataaattgggagtaggcagaattggatttcattatgatatggccggccctccctcccttccttccttccttccttttttccttccttccttccttttttccttccttccttcctttttccttccttccttccttccttccttccttccttccttccttccttccttcttctttctctctctttctttcaagatgggttctcaatcttttgtccaggcaggagtgcaatggtgcaatcatagctcactgtaggctcaaatgcctaggctcaagcaatcttcctgtctcagcctcccaagtagctgggcctacaggtgcatgccatcatacctggctgatttattttattttattttgtggagacatgatcttgctgggttggccaagctggtttcaaattcctagcttcaagcaaccctcctgccttggcctcccaaagtgtagatattacaggtgtgaaccactgcacctggcctgatagggtgtttctaaatagaaatcttgaaatcattagccagacattctgtttacctttcacataatttataatactctattttaatccttcatttttacccagtacattgagctgatcttaagattgtggtggcgggcgcctgtagtcccagctactcgggaggctgaggcaggagaatggcgtgaaccccggaggcggagcttgcagtgagccgagattgcgccaccgcactcccgcctgggcaacagagcgagactccgtctcaaaaaaaaacaaaaaaagattgacttctgaaataaaaggtgaaaaggccattttctttaaaatgatgataaatgaggctggtcgctgtggctcatgcctgtaatcccagcactttgggaggccaaggagggtggatcacctgaggtcagaagtttgagaccagcctgaccaacatggtgaaaccccgcctctactaaaaatacaaaaaattagccgggtgtggtggtgcatgcctataatcccagctactagggaagctgaggcaggagaatcacttgaacccgggaggcagaggatgcagtgagctgagatcgtgccatttcactccagcctgggcgaaagagcaagactctgtctcaaaaaaaaaaaaaaaaaaagttattccaacctgaaaacctagatttcttaatcccttatgtttcttttctccccacccgctccccttgcctcatgatttaggtccatggtgatgcttctttctgtggtcaagggattgttcctgaaacattcacgctgtccaatctcccacatttcagaattggtgggagtgtgcatttgattgttaataaccagctgggttacaccactccagctgaaagaggaaggtcttctttatactgcagtgatattggtacgtaacacagggaggaactgatattgctgaagccgacatggaattcctagggaaacctctggtgcacacagaacaatgagcctcactggttatccctcctttcatttaattaattaattaattaattaattttttgagatggagtcttgctctgtcacccagcctgtagtgcagcagcacgatcttggctcactgcaacttctgcctcccgagttcaagtgattctcttgcctcagcctcctgattagctgggaccacatgcgtgcaccaccatgtctggctaattttttttttttttttttttagatggagtcttgctctgttgccctttccagcttgtactccatgctggagtacgtgatctcggcttactgcaacctccgcctttcaggttcaagtgattctcatgcctcagcctcccaagtagttgggactacaggtgtacaccaccacacctgtctaatttttgtatttttagtagagacggggtttcaccatgttggcaggctggtcttgaactcctgacctctggtgatctgcctgcttaggcctcccaaagtgctgggattaaaggcgtgagccaccatgcccagcctatcagtgtgatttttaaatccaaagaaataagacaaggatggagccacagtgtgccatctcaaatttcttataactggatgggtgatctggtacaagtcagagatcaacacaatgagtacaacaccagagttgttatctctaggatattcaaacttggagtgcccaggggcttagtgataagggatgtgttcaaccactaaacttggtgaaatagtatagttagaaataagatgtgaaggctgggcacagtggctcacgtctgtaatcccagcactttgggaggctaaggcaggtggatcatctgagcttgggagttcgagaccagcctgaccaacatagagaaaccccgtctctaataaaaacacaaaattagctgggcatggtggtgcatgcctgtaatcccagctactcgggaggctgagacaggagaatcacttgaacctgggaggcggaggttgcagtgagccaagatcaggccattgcactacagcgtgggcaacaagagcgaaactccatctcaaagggcaaaaaaaagaaataagatgtgaagaatcaaagtcagcttcttttttatctgtggaaattggtaggtttttttgttgttgttgttgttttgagagtcttgctctgttactcagactggagtgcagtggtacaatcatggctcactgcagccttgacatccctggctcaagagatcctccctcctcagcctccttagtagctgcgatttacagacacatgccaccatgcacagctaatttttttttttttttgagatggagtttcgctcttgttgcccacgctgcagtgcaatggcgccatctcggttcaccacaacttgcacctcccgggttcaagcaattctcctgcctcagcctcccgagtagctgggactacaggtgtccaccaccacacccagctaaattttgtgtttttagtagagacggggtttcaccatgttggtcaggctggtctcaaactcctgacctcaggtaattcacctgcctcagcctcccagagtgctgggattataggcgtgagccactgcacctggccacagctaatttttaaaataatttttgtagagattgagtcactgtgttgcccaggctggtcttgaacctctggtcttgtgtgatccctcttcagccttccaaactgctgagattacaggcgtgaaccactgtgccaggctgaaattggtcatcttaagataaagacagtgctgttattacccattcccagtttcacagtttacaaggctgtttgatggtagcaactattctccttttatacaaacagcctggactggatgcctcttgggcttgtctatgtgaatcctttatgattagtctgatgaagattctttggagcaaatttatctttttctaaggtacatcctttaatgacccttttatctcagggagaaagagagtaatgataataacagtaacaaaataaatattaactactatgtaccaggcactgttaggcattacaattgtttgtgcattcactcatcgaacctttgcaacatcactaagaggtaggagccccattcccgatttatagataagtaggttgagatttgtagctttaccgaggtcacacaataagtcccagagttggaacttgccagctggtctccaaagctggggttgttaaccaaaccaatatctacctgtgaggattgggctgtcttttgatgcaggaagtagggcttagagagggccagtgtcattctgggttaactgtcctgtttcggcttggtcttctgtccttcagggaagcttgtgggctgtgccatcatccatgtcaatggagacagcccagaggaagtggtccgtgccacacgactggcttttgaataccaacgccagttccgcaaggatgtgattattgatctgttgtgctacaggcagtggggccacaatgagctggatgagccattctacaccaaccccatcatgtacaaaatcatcaggtacaattataaacccttgtgtgatatgccccctaaaaattaaaattactattattattcttttgagatggagtcttgctttgtcacccagtctggaatgcagtagcacgatcttggctcactgccatctccacctcccgggttcaaatgatcctcctgcctcaagtgatcctcttgcctcaacctcccgagtagctgggattacaggcgtgtgccaccgtgcctggctagttttcatactttttagtagagatggagttttgccatgttggccaggctgatgtcaaactcctgacctcaggtgatctgcctgcctcgccctcccaaagtgctgggattacaggcatgagccaccatgcccaggcaggacatgaaactttaagagctaaagctgacacagttctgggctggagtgcaggtggcacagtcttggctcactgcaacctctgcctcctgggttcaagcaattgcaattcttgtgcctcagcttcctgagtagctgggattacaggtatgcatcaccacgcctggctaatctttgtatttttagtacagacaggggtttcgccatgttggctaggctggtctcaaactcccggtctcaagtgatccacctgccttagcctcccaaagtgctaggattacaggcatgagccaccgtgcctggcctcccatactcttcacacttgacatggttcctcattgaatagaaaaagggcaatagaaaactcagcagatgggaagattgaagcagggggaattaagcaaacctcgcccaaatctatttactgcagtgtcggcaggaccagaaatagaacctcagtgattcatttctacaaaccatagctgcagacctgcctggcaccttggtgagaggtaactcagaagattctaatgaatgttcagaaccatgctgtccaagatggaagccactagccatcagtggctattgagtacttgaaaagtggccagtcctgattaatgtgctgtaaggataatacacacaccatatttcaaacacttagcatgtaaaatataaacccaaaataatatttttaaatttattagatatggaaatgacaatataatgagtatattgacttaaataaaatatgttattgaaatgccgggcatggtggcttatgcctgtaatcccagcactttgggaggccaaggtgggtggatcacttgaggtcaggagtttgagaccggcctggccaacatggtgaaaccccatctctactaaaaatagaaaaatttggccaggcgcggtggctcacgcctgtaatcccagcactttgggaggccgaggcgggcggatcacgaggtcaggagatcgagaccatcctgactaacacggtgaaaccgcgtctctactaaaaatacaaaaaattagccgggcgtggtggcgggcgcctgtagtcccagctactcgggaggctgaggcaggagaatggcgtgaacccgggaggcggagcttgcagtgagcccagatcgcaccactgcactccagcctgggtggcatagcgagactccgtctcaaaaaaaaaaaaaaaaaaaaagaaaagaaaagaaaagaaaaagaaaaattagctggcgttgtggcgcgtgcctgtagtcccagctactcgggaggctgaggcaacagaatcgcttgaactggggaggcggaggttgcagtgagctgagattgtgccactgcattccagcctgggcgacagagcgagactcggtctcaaagaaaaaacaagaagaaaagaaattaatttcacctgtttctttttatcttttctaacgtgactgccagaaaattttaaattactcatggcttgcatttcatttctgtcccatggtgctgattcagatggttaatgtgacggagggggaatttgttactttggaacttccttttctagatactagaaaataaaatagattcccctcctccaagtttatttccttatagatataaattaaagcagaggaatacacgttttatgagcgtttctgatccttggtaccagaaagaggactgctctcagaagaactaattgtgttctgtttagctctgaatttagcagctgaatgactcagtgaacctcagggttctattttattttatttatttttttgagacacggtcttgctctgtcgcccaggctgtagtgcagtggtatgatcacggctcactgtagcctcgacttcctgggctcaagcgatcctcccgcctccacctcctgagaacctgggactacaggcgcttgccactatgcctgactagatggggtctcacagcgttacccaagctggtctcgccatctgcccgtctcggcctcccaaagttctgggattgcaggcatgagcctcctcacctggccccagggcgttagctttaaaatctatcctgctttcttctctcttttatcaggattaaatatgataatatatgtgaatagactttatagttgaaagtatgacatgaatgtagagtgacatttattgtaacacccaggtgttgatgattgtagttaaaggatgatagatgcaacctgaaagattgcaactttcagactggagcaactttgggttccatacctttttagataaaggggggtgctgattggatagacagtgtgggtcagtcttggaaataattgtcagaatttaccaaatcatagaaaaactctgttaattatttctatttggatgcagacaaaaacttataaatttgttttctctcagttgcctggaaaagaggttgttactatgagtgccttcatttattaaattaatttattatatttaacattgtttatttattttgtttctgttttataaacttattgagatgaacgtgacataatataaaattggctgtcttaatgcgaacaactcagtggcatttatttaccttcacaaagtggtgcaaccatcacttctgtcaagttccaaaacatttttcctgaatgcctttttattttatttttatttatttttaattttatttatttggtttttgagacggagtttcacttttgttgcctaggctggagtgcagtggtgccatctcggctcactgcaacctctaccacttaggttcaagcaattctcctgcctcagcctcctgagtagctgggattacaggcgcccgccaccatgccaagctaattttttgtatttttagtagagacagggtttcaccacgttggccaggctggtcccgaactcctgacctcaggtgatccacccactttggcctcccaaaatgctaagattgtaggtgtgagccactgcacctgtcgaatgcctttttagagtgctgacactccaccgcccttgacagtgactctccttgtctctattagattgttacaggtcagactgatttttgtttcttctctttcttgggcagagctcgaaagagcattccagacacatatgcagagcacctcattgctggcggactcatgacgcaggaggaggtgtctgaaataaaatcctcctactatgccaagttgaatgatcacttaaataacatggcccactacaggccccctgccctgaacctgcaggcccactggcagggcctggctcagccagaagcgcaaatcaccacctggagtacaggtgtgcccctcgacctcctgcggtttgttggcatgaagtctgtagaggtgccaagagagctgcagatgcacagtcacctgctgaagacacatgttcaggtgggcagcctccaaatggctggttattgcttctccttcctgctcagcaaaggagctgacgttggtctggtgttttcagttgtctgattcatttgacaaatatttattgtgtgtcgttaggttctagaaactgatcctagtgttgttttggtactgatagtcagttacctcagattttctcttcttttctttttcctccatgtatttatttatttatgcatgttcatacattacatgtacctggaatacatgcacactataagaaatacagagatacaagaatgtctgtttttatttttccaaccagtgagtagaaaacactttgtttcaggtggcttaaataaaagaaacaaaagtcaacacacataccccaaggtagccccctaaacatgctcatgttttacgtattgtcttaggatcactataggatgacaaaccaccctggtggacctgggacttaggggttttctggaatgtgggactttaagtgctaaaacaaggagagcaaagagttaaatgtctttttctttcttaagcttggatgaaggaactttgccctctaaattattttattttatgttatttttggatggaatctcactctgtcacccaggctggtgtgcagtggcgtgatctcggctcactgcaacctccacctcccaggttcaaacgattctcctgcctcagcctcctgagtagctgggattacaggcatgtgccaccatgcccagctaatttttgtatttttagtagagatgggttttcaccatgttggccaggttggtcttgaactcctgacctcaattgatccatccactttggcctcccaaagtgctgggtttacaggtgtgagccaccatgcctaacatgaattattttcaaacactaacttggccaggcacggtggctcctatctgtaataccagtgctttggaaggccaaggtggaaggattgcttgagcctagaagttcaagaccagcctgggcaacatagtggaccttatcgctagtaaagattaaaaaatttgcctggcatggtggcgcatgcctgtagtctcagctcctcaggaggctgaggtgggaggattgcttgagcccagaaggtcgagcctgcaatgagctgagattgcaccactgtactccagcctgggtgacagaataagatcctgtttctccaaaaagaggaaattaaaaaaaaaaaaccaacccactaactttaagtttttattataggtacagagactattacaacaaactattaatatgtactcatcactcagcttaggaaataggatgttataaatacagttccccacatacccctccttgatccatctcctcccacctccgcagaggtaaccactaacctaagcacgtgtttgttttgcctgttttaaaattgtatataggccgggtgtggtggctcactcctgtaatctgagaactttgggaggccaagccgggcagattatttgagttcaggggttcaagaccagtctgaccaacatggcgaaaccccttctccactaaaaagtacaaaaattagctgggcgtggtggtgtgcacccatagtcccagctacttaggaggctgaggcaggagaatcacttgaaccagggaggctgaggttgcaatcagccaagatcacgccactgcactctagcctgcgtgacagagtgagactgcctcagaaaaaaataaataaataaaaactgtatataattgctctccttctctaatgtatccttttgtactctgtttttattcagcattgtttttgatgcttaatttcgttgctttttttttttttttttttttgagatcaagtcttgctctgtcgcccaggctgtagtgtagtggagccatctcagctcactgcaacctccgcctctcaggttccagtgactccctgcctcagcttcctgagtagctggtatcatagagacacgccaccaggcctagctaatttttgtatttttagtagagatggagtttcaccatgttgtccaggctggtcttgaactccttacctcaagtgatccacccgcctgggcctcccaaagtgctgggattacaggcatgagccaccatgcctggcctgcattaaattttttgtactcattgtgaaaaaggaaatggactcttagacgttccttttttttcttcctctgaattttacagtccagaatggagaagatgatggacggaatcaagctagactgggccaccgcggaagctcttgccttgggttctttacttgctcaaggtaagaattttcttttttttttctgttttttttttttttgagtctcaccctgtcgcccaggctggaatgcagtggtgcgatctcagctcactgcaacctccgcctcccaggttcaagcgattctcctgccccagcctcccaagtagggcgcaccaccatgcccagctaatttttgtatttttagtagagacggggtttcactatgttggtcaggctggtctcgaactcttgacctcgtgttccacccgcctcggcctcccaaagtgctaggattatgggcgtgagccaccgtgcccagccaaggtaagaattttctgtctagctagtagagagtacttttaatcacgtttgctacctgttacctttgcagtttatttgagttataactacctcccattgtgttcattgaccagagaggttctaaagcatgttaatttttctttcctgacaatattacttatttgtagtataagtcatgctgacaaccttcatcagagtatagacataggacagttatgcctgggaaacaaagggctagtgctggatgtactggaaagatagttttctctaaaaattgcagggcacatgatacctctccactcttatgcaatctcatcttaactatagacttttgaatattggacagcatatattaataactatctgttatcctaaggaaaattctcaggattaagccagtatataagaatttacagtcaccacaccttattattaggttatttatgggaatctgactttttttttcttgcttgcttaaggttttaatgttcgtctaagtggccaagatgttggtcgtggaactttcagtcagaggcatgcaatcgtggtttgccaggagacggatgacacctacatccccctgaaccatatggacccaaatcagaaggggtttctagaggtgagatgtttctatagctgttgtaaaatccaggtgccaacgattacacttccaggattcttagaacaagtaggaaggagtgctggcaactttgggttcagtacttttggaagtaaaggagtgctaaatgggtggatgaggtgggtctgtcaatttggaatgcaagtaacccctagagagtaggctggagctttcttcttctggtgacatatctgtaatcatgtaaatgtcaaatcaatgtgtgttttgtcaactcaaagttgacattatcatctgcatattgctgtaattcattaaagttagtcaaagatatggataagtcagtattccttgcctacttaaggatagcaaaatcgcacatcctcaaggttacctgttccctaaggtatgattggcttgacgaatgtacacataaccgtgtatttctttcttttttttcggagacttaatcttgctctgttgcccaggctggagtgcagtggtgccatcttggctcactgcaacctccacctcccaggctcaggggatcctcatgtttcagcctcccgagtagctgggaccacgggaatgaggtgccattcctggctaatttttttatttttagtagatggaatttcaccatgttgcccaggctggtcttgaactcctggcctcaagcagtccacctgccttggcctcccaaagcactggaagtataggtgtgagccactgcacccagccagatataaccatgtatttctgtgtggcagcctctgtgccctctgtagtgccttaaggatagtagtggagtcttttcatttatttatctcaaacaattattcaagtgtctagcacatgatgtttatgaaaataacttattccttaaggtaagttgagtggcatgtcatcttctttcctactctagccattagtttgagaacatcatcttgagttactgacaccttataaaaaattcacttggtggccgggtgtggtggttcacgcctgtaatcccagcacttcgggaggctgaggtgggcagatcacacggtcaagagatcaagaccatcctggccaaaatggtgaaaccccatctctactaaaaatagaaaaattagctgggtgtggtggcatgcatctgtagtcccagctactcaggaggttgaggcagaagaatcgcttgaacccaggaggcggaggttgcagtgagccgagaacacaccactgcactccagcctggtgacagagcgagactctgtctcaaaaaaaaaaaaaaaaaaagaaaattcacttggcaaaagccacattttaggaagataactgaagggatatggagctcatcttttctttaagttagtccaaaatctacccttggatcaagtcagattgccaaactagatactgaaatgtttagcattcccctacctcagatgaggctttcattgaattgtgctttgatatttattatcagttttgaattttgctattgaaaaagtcccaattaaatgccttgtgtctgttttgtggatactgttgaagatttaatttagtttcattcattcattcattcgttcatttatttatttgagacggagcctcactctgtcacccaggctggagtgcagtggcgtgatctaggctcactgcaacctctgcctcctgggttggagcagttctcctgcttcagcctcccaagtagctgggattatttggcctcccagagtgctgggattacaggcgtgaaccaccacgcctggccgaagatttaatttattatttagacctggcacggtggctcacacctgtaatcccagcactttgggaggccaaggcaggcagatcacttgaggccaggagttcaacactggcctggccaacatggcgaaaccctgtctctactaaaaatacaaaaattagtcgggcatggtggcacacgcctgtaatcccagctactcaggaggttgaggcaggagaattgcttgaacccaggaggcagaggtagtgagcggagatcataccactgccctccagtttgggcaacagagcaagactctgtctcaaataataataagagtaatttattatttaataccatgtcctctatgtgaagaccctgggagaaactcctgcttgatcttggtagtgagagtagctatattttcctgagtagtgatctgccttcattgtctaatagtattgaattttgtaactgaccagcattcccttatcaataatggcttctaggaagggacagaggtcaggcagccttcatgataagtgaataggtccttggggtgtgtttttcccccaacttcgttgtacatctcaatctgtgtgtgtgtgtgtgtgtgtgtgtgtgtgtgtgtgtatgtatgtgacaggtcctcctctgttgcctaggctggagtcccacagtgcaattatagctcactgtagcctccagctcttaggcacaagcaattgtcccgcctcagcctctcaagtagctgggactacaggcaagcaccaccacgcctggctacttttaaatattttgtagagataggagtctcactgtgatggccagtgtcatcttgaattcctggcctcaagcaatcctcctgccttggcctcccaaagtgctgggattatagatgtgagctgccgtgcccagcctagagggtttttatttttttaagtaaaagctttattgagctataactcatacaattcaacctctcagtgtgtacacttgagcagtttgtagtctattcacagagttgtgtaatcatcaccactatctaattttagaacattttcattaccctagaaagcaagcccatgcccgttagcagtcactgcccattccttcctccctccagcccctggacaccactcatcgactgtttgtttctattgatctgcctattttggatgtttcatgtgactagaacggtataacatgtggccttttgggactggcttctttgacttggcatcatgctttcaaggtccatccatgcatgcagcatgtatcagtacatccttcttttttttgagaccaagtcttgctctgttgcccaggctggagtgcagtggcgcaacctcggctcactgcaacctcagattcctaggttaaagtggttctcccacctcagcctcccaagtagctgggactgcaggtgtgcgccaccaggccctgctaatttttgaatttgtagcagagacagggtctcgccacattggccaggctgatctcaaacttttgacctcaagtgatcatctcagcctcccaaagtgctgagattacaggtgtgagccaccacactctgcccgtccttcctttttattccaaaataatattctataaagatgtagcttaaacatatatttttttaaaatttgaaagaaacaaaattaccaaaatgttgtgtacagtaaggaactttttctcatctttattttttcttttgagacagggtctcactctgtcacgcaggctggagtgtagtgatgcaatcactgctcactgcagcctcgacctcctgtgtccaagtgatcctcctagctccctttttccatcttgaaccatctgagagctagttgccatcctggtgccccctactgtgtatttccacaaatggggggacatccttctccatcataacacaccaaaatcaggaaatgaacacagacatgactaccatgtatttctcaaaccaagatcaacaatttttttttcttttttttttttaggcagagtctcactctgttgcccaggctggagtgcagtggcacaatctcggctcaatgcaacctccacctcccaggttcaagcaatcctcccacctcagcctcttgaggcctgcatcaccatgctcagctaatttttgtattttttgtagagactgggtttcaccatgttggccaggctggtctcgaactcctgacctcaggtgatcctcctgctttggcctcccaaagtgctgggattatgttttgcatttaattgtaatgtctttttaaccttctcagagataaaatttgtattctgctttttttaatgttaacatatcatgatggttcttttgatttaccatgcaaatacgatgttagaataatgattttaaccaaaggtaggactttattttttaactttcctcactttgtttcatgataatttttttcttttttgagacaggatctcactgtgtcacgcaggctggagtgcagtggtgcgattatagctcactgtagtttcaacctcctgggctcaagtgatcctcccacctcagcctcccaagtagttgggactacaggcatgtgccaccatgcccagctaatttttgtctgctttttttagagatggggttttgccatgttgcccatgttgatctcaaactcctgtgctcaagcgatcctcccatctcggcctcccaaattgttgggaggccaccacgcccggccacaggtttttgaaaagcttataagacgcagttgtatacctagctccagaagagggtcatctgagaagtatatgtgcttatccttgaagaaactctgtaatacccatattccagcctcttttatcttttcctctctttgtcccaacttttctcatctgcatcactgacaccaagcagcaaatctcttctcaaaagaatgtggtgatgaggccgggcgtggtggctcatgctgtaaccccagcactttggggggccaaggtgggtggatcacctgagctcaggagtttgagaccagcttggccaacatgctgaaaccctgtttctactaaaagtacaaaaattagctgggcatggtggcgggtgcctgtaatcccagctactcaggaggctgaggcaagagaatcacttgaacctgggaggcggaggttgcagtgagccgagatggagccattgcgctccagcctgggcaacaaaagtgaaactccgtctcaaaaagcagaaacaaacaaacaaaaagaatgtggtgatgaacgagagcaaggctccctctccgcaccacctcccttcgataagttcgcaggagcccagtgctctgccgtggccctcacatgcagcgtttccttctcttctctgggattaggtcagcaacagcccactgtcagaagaggccgtcctgggatttgaatatgggatgagcattgagagcccaaagttactgcccctgtgggaggcacagtttggcgatttcttcaatggtgcccagatcatctttgacacattcatctctggaggttggtgtcagcgtatagggtgggtacaggtgggggtccctgcgtggccccagcctcgtggggacaaatgaatgaaaaggggccactgctgccttgagactcccgtgtgcggcggcgcctccagggagttggggtcaccctgttatgacgggagtgtggccactgtcaggttaatgtgttactgggacaaaaacccaagctctctctcagcaggagcactggtgccacccagcacctgtgctcaggggtcagtagggccatgaaaacccgctccagtgtctgaaagcttccgaagcagtacctgctcaccgtaaaaattagaagtaattgaagtaaacgtctaagtcttctccccagaccctgaatcccattttccagggatgcccactcttgggttttgaatacctgccttaaatctttcctatagttatgcttctctgtaacattttcactgggaggaagaaaagtgcctgagggcctggacttctgacttgtccagagactgttctgtcgtgcccaccaccccctgtttcaagacagtggcctgtgttgtcagctgggctgtgagagctgcccattctttttcttttctttttttttttttttgagacggagtctcgctctgtcacccaggctggagtgcagtggtgcgatctcggctcactgcaagctccgcctactgggtttgcacgattctcctgcctcagcctcccgagtagctgggactacataggcgctggtcaccacgcccggctaattttttgtatttttagtagagatggggtttcaccgtgtcagccgggatggtctcgttctcctgacctcatgatccacccacctcagcctcccaaagtggtgggattacgggtgtgagccactgtgcccggccgggagctgcccattcttgtaagagtggtgcctgcggtggtattggagcggcatgtgctgtccaggaagctgggaacgttcccctttgagtttgtcttccactcgtaaaagcccagggcctgtgccgtgataggttatggctttcttttttgagacggtgtctcactctgtccctcaggctggtgtgcagtggcatgatctcaggacactgcaacctctatctcccggggtcaagtgattctcccacctcagcctcccgagtagctgggactacagacatgtgccactacagctggctaatttttgtatttttagtagagacggggtttcaccatgttggccaggctggtctcgaacacctgacctcaagtgatctatccgcctcagcctcccaaagtgctgggattacaggtgtgagccaccgtgcctagcccatgataggttttcattcaatgaaatggacatttccctaagtatagcataacagttctagaaggtgcatgtaatgaaagcagttttggggggccaggcagaaaactaacattgatttccccagctgagtcgtgtcaggccactttgtccccgcttcgtagagctcttactccccacgtggtacttttccaggagaggccaagtggctcctacaaagcggcatcgtcatcctccttccacatggctacgatggggctgggccagaccactcatcctgtcgaatagagcgtttcctgcaggtaagggtaacgtcttccggagtcaatgaatcattttcctgcttcctagagcttttctacctcctgcggatagcttaacgcccacctaactgtaacacagcttagtatttgagtgaaacagatttgatgcaatgtcaattttctttggaaacgtaatgcctcaggtataattgtatcacggttttatggcaattaaagttctcttgtgccaggatcagcagttcttataccaggctgatcatcagaatcccccagagagcttttttatttttatttttttttgagatggggtctcgctctgttgcccaggctggagtgcagtggtgcgatcttggctcactgcaacctctgcctcttgggttcaagcgattctcctggctcaccctccaagtagctgggaccacaggcgtatgccaccatgcctggctaatttttgtgtttttagtagagattggtgttcttccatgttggccaggctagtctgaaactcctggcctcaagtgatctacccgcctcagcttcccaaagtgctgggattacaggtgtgagccaccaaccctggctggttattaaaacatttgaaatatcctgccagaaatagccattgtcctcatttggtgtgaatcattacaaatgtctccttttgcatgttatttccttatagtttattatgaagactttcagatatacagaaaagttggaaagaatttactgtgaatactcatatgcccactccctagaattcaccattattttttattatacttgttttttcacatatctattcatctgtcattctggtatccttcaatgcatcttatgttttgattcatttcaaaataaatggagacattagccgggtgcagtggctcacacctgtaatcctggcactttgggagaccaaggcaggtggatcacttgagatcaggagtttgagaccagcctggctaacacagagaaaccccatctttactaaaaatacaaaaattagccatgtgtagtggctcatccctgtaatccaagctactcgggagcctgaggcaggagaatcgcttgaacccaggaggcagaggttgcagtgagatcacgccactgcactccagcctggacaacaaagactctgtctcaaaaaattaaataaataaataaataaataataaatagagatatcaatacatgtcaccccaagtacttcagcatgcatatcgttaatgattttggcatgcgtgcagctaaaatgtataaacagatgatagcttaatagataggtagacagaacaacagatagatggatagttacattaatgatgacatcgagaattttatttaaaaagagattagagtaatggtagataaactaaagcatgacatgtgaaatgcaaaactactagttgttgaagaaacagaggaaatgagtaggtgggggatacagtttcggagtcatcagccactagatgacattgacagtcatgagtctggaagaagtcatcgaagcagcgagcacagtggaggagagaaggtgcctgagctctgggccctgggatagtccaacctcagaggatgcagagaagaagaagaagtgagatgaagaaggagcaaccagtgaggtgggaggaagatcttagaaagcaagcgaaggaaacatatcagggaagagggagtgtcagtgtcaattaagatgaggagtgaagtaatcccagcactttgagaggccgaggtgggaggatcacttgagcccaggagtttgagaccagcttgggcaacatagtgagaccctgtctctactaaaaataaataaataaataaatagatgaggcataagaatgaaccactgaatttagaaatcaagagtccatttgttggttgatgactgcggttttgatggagtggtagggacaaaagtctgtctgggacatattaaggactatctagagcaacttgtccaacctgtgtccatggaccacatgcggctcagaacagctttgaatgtagcccaatacaggctgggcgtggtggctcactcctgtaatcccagcactttgggaggccgaggcgggcggatcatgaggtcaggagatgaagaccatcctggctaacacggtgaaaccctgtgtctactaaaaatacaaaaaattagccgggcacggtggcaggcacctgtagtcccagctacttgggaggctgaggcaggggaatggtgtgaacctgggaggcggagcttgcagtgagctgagattgcgccatgcactccagcctgggtgacagagcgagactctgtctccagaaaaaagaatgtggtccaatacaaattcataaactttcttaaaacattatttgtgattttttttttttaccttattagccattgttagtgttagtgtattttatgtgtggcacaagacaattcttcttcttccggtgtggctcaggtaagccaaaagatcggacacccctgattcctgattctagagaaaggaaagtgtatttatttaaacatttttaattgacaaatgtacaattgtatatatgaatagtataaaatgtgatgttttgatacagctatacattgtgaactgattgaatcaagctaattaccagacccgtcacctcacatactcaccatttttggggaagagaacatttaaaatctatcctcttagtaattttcaggtatataatacgttaactacagttaccatcctgtacagtagatctccagaacttattcaagggaggaaagttggcctagcatggtggctcacacctgtaatcccagcactttgggaggccaaggtgggtggatatcttgctcaggagtttgagaccagcctgggcaacatggtgagaccccatttctgctaaaaataaaactaaaaaaattagctgggtgggtggtggtgcgtgcccataatcctcactacttgggaggctgaggtgggaggatcacttgagcctgggaggcggaggttgtagtgagctgaggttgcaccactgcattccagcctgggcaagagagccagaccctgtctcaaaaaaaaaaaaaaaaaaagggaggaacatcaacttaactcttttgaggagtattgctgtaaatagaacaagaaaatgagacagtagctggtgggaaaatttgtgtcaagagttccttttgtgttttcttttatttttgtgatggcgtcttgctctgtcacccaggctgtagtgcaatgctgcagtcttggctctctgcaacctctgcctcccaggttcaagcaattctcctgcctcagcctcccgagtagctgggattataggcttgtgccacgatgcccggctaatttttgtatttttagtagagatggggtttcaccatgttgaccaggctgctcttgaacccctgacctcatgtgatcctcccaccttggcctcccaaagtgctaggatttcaggcatgggccaccgcgccaggcctttgttttgtgttaaaggtaggaaataaggcctgtttggtgataggcatgatccagtagacaagaagagaatggtgatgtaggggtgctgatagaataactgagtgatttccttgcattggtaaaatggggtgggctctagtacatgatggattaaattagctttagacagcagcatggttggtggcaataaatggaaggcagagaagatgagtgcaagtgagaatgtgtgtgtagatggtctgaggacatgctgttaggtcattagctgagagtggtgatgcaggaggaggtcctgagtttaaaggtgtgaattagtcacctgggaaagaaggagaatgagtgagttagggaaatagagtttaagagtctaaggtcactaagggcccatctcagactgttggtcaggattctaaagtaagaccattggtgtgattttgtgttgtctccagctactttctctgcagacatggaacaggcagaaagtggggattaactaggtttatgggttggagtgaagggtcatgggaatcaagggtgtatgcaaaaagaagatgatcatgattgaggccaggcatggtggctcatgcctgtaatcccagcactttgggtggctgaggcgggaggatcgcttgaacccaggagtttgagaccagcctgggcatcataacaagaccccatctctacaaaaatattaaaattagtcaggtgtggtagcaggcacctgtagtcccagctacttgggaggctctggtgggaggattgcttttgagtccagagtttggggttacagtgtgctatgatcatgccactgaactccagcctgggtgagagaacgagactctgtaacaacaacaaaaataattgtccagattttgtcaactctctttctttcctttcactgcctttggggaagggttaggagttatgcctcagctttctgtcccaccaggatcttctgagatttaacttccttgccctcaatttttcaacctttctattagctgcttttgatttttgtcttaaagcacgcgtgcacacacacacacacacacacacacacacaatcgttttattacattaggaaagtgagattctgatagtgcttccttcccctgtcttaaccctgtagtaatcagaatatgtattttttttaaaaaagtcctttccagattatctttgctatcagccgtgtttgggaacaattgtgttagatgacacagaattgggccagtggagaaagccatcagagctctcctttggttaataccgcaccgttcataaattcacctgctgatatttttctgtaatgttgggcaatagcttttctgctataatcaagaacacctgtgtttccctttggccagcccattgtcactacgactgaaatagatgatctgaacattcttctcctttcttgccacttctctcccagatgtgtgacagtgcggaagagggggtggacggagacactgtgaacatgtttgtggttcacccaacaactcctgcacagtatttccacttgcttaggagacagatggtccggaacttcagaaaaccactcattgttgcttcccctaagatgttactcaggctcccggtaagcagaaggtggtgaataagccttcctccttttgtcattttttgcactccatttttccctattttccatatctaattatatttaaattacagaaacacctttttagtttcaactgactttgctactttcattttttttgttgttttttgagacgcagtcttgctctgtcgcccaggctggagtgcaatggtgcaatctcggcccgttgcaacctctgactcctgggtttaagcgattctcccgcctcagcctcccaagtagctgagattacaggcatgtgccaccacacccagctaatttttgtatttttagtagagatggggtttcgccatcttggccagactagtctctaactcttgacctcaggtgattcgcccgcctcggcctcccaaagtgctgggattgcaggcgtgagtcaccacacccagcctgctttcattttttaaacagccttttaagactacctggaaagataggtaggttttctgtcaattgtaatgaaggacagggatagcagatgttatactagtgccctcctgagcagaaatactatttagaaaagcttttaggctattaggctgggcatggtggctcatgcctataattccaggactttgggaggcctaggcaagaggattgcttgagcccaggagtttgagagcaacctgggcaacattgcaagaccccatctctgaaaaaaaaaattggccggtgtggtggctcacacctgtgctgtcagctgctcaggaggctgagatgggagcatcttttgagccctggagttcaaggctgcagtgacgtatgaccatgccactacactccagcctgggcaacacagcaagacattgtctgaaaaagaaaagaaaaagttttaaagcccatatggtctaagcactattttttttgatagcagcaatttgggaattcaaagtattttgttgaaaatgagtggcattatttgtcattcttttttttttttttctttttgagatggagtcttgtgctgttgcccaggctagagtgcagtggcgtgaaatttatcattttatcatttaacacatacgtaggtttacctatttatctgttaagtgtacattgtttttcaaatcacaaaaatatgctagtttccaaatagaaatgttcaaaataataaatactactaagcatatatttatcccatctgctatacttttttcaggttcatatgagttttaattagaattagtattaaatttttttttttttttgagacggagtctcactctatcacccaggctggattgcagtggtgctgtctcagctcactgcaacctccaactcccgggttcaagcgattctcctgcctcagcctcctgagtagctgggattataggcactcgccaccatgcctggctaatttttgtatttttagtagagatggggttttactgtgttggacaggtggtctggaactcctggcctcatgtgatccacctgccttggcctcccgaagtgctgggattacaggcatgagccaccgtgcccggccgggagtattacagtttttacatttatttggatatgactgctgaggtgaaataagacgtttagaatttggccattcaagaatatcttgtgctgctcacaaaggttcgagagtgtatatttggaattgaggggtactgaagaaaagctgcgagtgatttgcttccaccccttggttggttggttggttggttggttggttggttggttggttggttttttgagacggagtctcgctctgtcgcccaggctggagtgcagtgctgcgatctcggctcactgcaagctccgcctcccgggttcaggccattctcctgcctcagcctcctgagtagttgggaccacaggcgcctgccaccacgacctgctaattttttgtatttttagtggagacagggtttcactgtgttagccaggatggtctcgatctcctgacctcgtgatccgcccgcctcggcctcccaaagtgctgggattacaggcatgagccaccgctcccggcctgtttgaacagtttcttgagatggagtgtcgctctgttgcccaggctggagtggagagcgcgatcttggctcgctcgctgcaaactccgcctcccaggctcaagcaattctccagcctcagcctccccagtagctgggattacaggcttgtaccaccatgctcagctaatttttgtatttttagtagagacagagtttcatcatgttggccaggctggtctcgaactcctggcctcaagtgattgggctgactcggcctcccaaaatgctgggattataggtgtgagccactatgcctggcctcgttgttttaagcagtttttagcattcagaggggagtagggaggtactcattctcaggggcgatattttcatggccctaaaatcagtgcctccttaaactttttgcactaggtaccttacttgactcaccctagcctggccctgggagtcagtatctagtcaatagccaggaaatggatttcagtagtcttaccaatagcagccattcatttttagttcacttatagtggtctaccggttctttctcacccagtgtttcgcaaacaaccttatatatttctaggtgacctcataagcctggaagcatcaccaaacatttaggaagagttaatgcaatgcctttagcaccatttttctgatggggctcttttttttcttttttttgttattttgagagtctcgctttgttgcctaggctggcatgcagcggcataatcttagctcactgcaacctttgcctactgagttcaagcaaggcctcagcctccgacgtagctgggactattaggtgtgtgccaccacacccagcaattttttttttttttttttttgagacagagttttgctctgtcacccaggctggagtgcaatggcacaatatcagctcactgcaacctccatttcctgggttcaagcaattctcctgcctcagcctcccaagtagctgggattacaggcatgcaccaccatgcctggctcatttttgtatttttaatagagacgaggtttcgccatgtgggccaggctggtctcaaactcctggcctcaagcaatatgcctgcctcggcctcccaaagtgctgggattacaggcatgagccaccacgtctggcctgattcttaaaattatgtcgtggcaccaggcaaaaggtaatcttttcttaaattcattttttaatttttattgtcatccttgtgcaggggccatgctaatcttctctgcagtgttctaattttagtatatgtgctgccaaaatgagcacagaaggcaatctttttactttttttttttcttgagatggagtttcctgttacccaggctatagtgcaatggtgtgatctcagcccactgcaacctccggctcccaggttcaagcaattcttgtgtctcactctccccagtagctgggattacaggcatgcaccaccacgcccagctaacttttataattttagtagagacggggtttcaccatgttggccaggctggtcttgaactcctgatatcaggcaatctgtccacctctgcctcccaaagtgctgggattataggcatgagccaccgcgcccagtctttttcttttctttttttttttttgagacaaggtctggctctgtcacccaggctggagtgcagtggcatgatcatggctcattgcaacttccgcctcccaagctcaaacttctagcctcccacctcatcctcctgagtagctgggactacaggcatgcgctaccacacctggccaatttttgtatttttttgtagagatggggtttcaccatcttgcctaggctggtctcaaacttgtgagttcaagcaatccacctgcctcagcctcccaaagttctaggatcacaggctggagccactgcaactggccagttttggtttgttttgtttcggatgaggtcttgctctgttgcccaggctggagtgcaatggtgcgatttcagctcactgcaccctctgccttctgggttcaagcaattctcccgcctcagcctcctgagtagctgggattacagacacccgccatcatgcccagctaatttttgtatttttatatttttgtagagatgggatttcaccatgttggccaggctggtctcaaactcctgacctcaggtgatccgcccaccttggcctcccaaagtgctgggattacaggcatgagccacggcaccttttttttttttttttttttttttaatagaggcaaggcaccagtggggatggtggagtagggggtgcaaagggagtctcgctatgttgcccaggcgggtcttgaactggcctccagcgatcctcctgccttggcctcccaaagtgttaagattccaaaaggctatcttatgtaacctcagaaacatagttttaccctgaagtatacagaactgatattttttggcaaggcattgcgtctattaggacatgggtctccttgcagtgctaggctagaactttggtactcgtgtttgatagcggcccttgtaagtgacagcatcacctctttctgttgcttgctggatgtgtggcctcttctccctcgtaggcagccgtgtcaactcttcaagaaatggcaccaggaacaacatttaacccggtcattggtgattcatctgtggatccaaaaaagtaagatatgtatctctgttttcatattctgtggcagaattttaattaatgggaaaagtagttcacattaagagatcacaggtgatgcagatctcccctctcctatttttatttatttatttatttatttatttatttatttatttatttttgagactgagtctggctctattgcccaggctggagggcagtggtgcaatctcagctctatgcaacctccgcctcccggattcaagtgattcttgtgcttcagcctcccaagtagctgggattacaggtgcccgccaccacaccctgctaatttttttatttttagtagagatggggtttcaccatgttggccaggctggtctcgaactcctgacctcaggttatccacccacctcagcctctgaaagtgctgggattgcaggcgtgagccaccatgcctggcctcctctatcctaagtcctttaagtcagtggagtatgagttaagtgtgggtgggaaagtggactttgtaggcgcatgttgctgaagaagggtccccaggaatagcctgtgactgaactcggctgcagagacccccaccaccttgttcatgaggactttaaatctgcactgtctcccgtttcttctgacataattctctttttttttttttttgaggttgagtcttgctctgtcgcccaggctggagtgcagtggcacgatcttggctcactgcaagctccgcctcccgggttcacgccattctcctgccttagcctcccgagtagctgggactacaggtgcccgccagtacgcccggctaattttttgtatttttagtagagacagggtttcaccgtgttagccaggatggtcttgatttcctgacctcgtgatccgcccgccttggcctcccaaagtgctgagattacaggcgtgagctactgcacctggcctcttctgacgtaattcttactttaaaaaatttctcccccaccctattgttccttttctgtccaacagggttaagaccctcgtgttctgctccggcaaacatttctactccctggtgaaacaaagagaatctctgggggccaagaagcatgactttgccatcatccgagtagaggaactctgccccttcccgttggattctttacagcaagagatgagcaaatacaaacatgttaaaggtaagaggttgttctcatttgggttttgatgttcagatacccaaaacccatttcagctcttttaaatgaaaagatgtggtgggggttattagaaaattgaatcttgggccgggcgcggtggctcacacctgtaatcctggcactttgggaagctgaggtgggtggatcacaaggtcaggagattgagaccatcctggctaacacggtgaacccccgtctctactaaaagtacaaaaaattagccgggcgtggtggcgggcgcctgtagtcccagctccttgggagcctgaggcagaagaattgcttgaacctgggagacggaggttgcagtgagccgagattgtgccactgcactccagcctgggcacaagactctgtgtcaaaaaaagacacaaaaacatgaaaatttggtacaggcggggcgcggtgcctcacgcctgtagtcccagcactttgggaggccgaggtgggcggatcacgaggtcaggagatcaagaccatcctggctaacacagtgaaaccccgtctctactgaaaatacaaaaaaattagccgggcgtggtggcgggcgcctgtagtcccagctacttgggaggctgacgcaggagaatggcgtgaacccgggaggcggagcttgcagtgagccgagattgcgctactgcactccagcctgggcgacagagcgagactccgtctcaaaaaaaaaaaaaaaaaaaagaaagaaaatttggtacatatatggggcctgtccgagggtcatgggggaggagggagagcatcaggcagaacagctaatggatgctgggttaatacctaggtgatggatgatctgaggagcaaacctccgtggcacacatttacctgcataacaaacctgcacatcctgcatgtgtaccccagaacttaaaaaagaaaaaagaaaatgcattgaatacacctaaactacaaaacacagcttagcctagcctgccttaaacatgctcagaacactcacattagcttatcgttgggcacaatcatttaacacaaaatctattacatttcataatgaagtgttgaatatctcagataatttatcgaatactgtaccaacagtgaaaaacagaactgttgtatgggtacttgaagtacagtttctagtgaatgtgaatccctttcacaccatcgtaaagttgaaaactccatcgtaggtgggatcatagtaaattggggaccgtctgcatgtgtctacttgaggtgctgaaagaatttcttctctcatagatcatatttggagtcaggaggaacctcagaacatgggtccgtggtcgtttgtttctccaaggtttgaaaagcagctggcctgcaaggtaatcacacgttttctctggtagtgttttgtgttttgtgtgcatgttgtttttcttttctttctttctttcttttttttttttgagacagagtctcactctgttgcccaggctggagtgcagtggcgcaatctcagctcactgcaagctccgccccccgggttcacgccattctcctgcctcagcctcccaagtagctgggactacaggcgcccgccaccacacccagctaaattttttttgtatttttagtagagacggggtttcaccatgttagccaggatagtctcaatctcctgacctcgtgatccgcccacctcggcctcccaaagcgctgggattacaggcattgaggcacggagccctgtccctctaatctcttctgcgtaactcattatttgaaagaggtgatttatggttaaacaagctaagagaaatacatgcactgtcttgttggaactaagcagagctctgatctagtcaaaatgtcattttatttcttctctgctgcacttatagctccgtctggtgggccggccccctttgccagtacccgctgtaggaattggcacagttcacttgcaccagcatgaagatatcctcgccaagaccttcgcttgatgatgacttttgaagaaacactatttctctttaagaaaatggccattaaggccgggtggggtggcacatgcctgtaatcccagcactttgggaggccaaggctggtggatcacctgaggtcaggagttcgagaccagcctggccaacacggtgaaaccccgcctctactaaaaatacaaaaaatagccgggtgtggtggtgggcacctgtgatcccagcttcctgggaggctgaggcaagagaatcgcttgaatctgggaggcggaggttgcagtgagccaggatcacaccattgctgtccagcctgggtgacagagcaagactgcgtttcaaaaaaaaaaaaaaaaaaacccattaaaagaggcctccttcctccactctctcaacccctctgttgggtaacatgaaaagactgtattcctctaagatgttgggattgatatacgtgatttaatctgcaataggtggaataaccaggggaactggttatgaatatgtgaatgcaaccagcaaatttatccttgaaggtgtgatggtagaaataggaaaacaacaaaagaaaaacaataacaaaaaaagaaagtgtgatggctgggtgcagtggctcacgcctgtaatcccagcactttgggaggcttaggcggctggatcacctgaggtcaggagttcaagaccagcctggtcaacgtggtgaaacgccgtttctactaaaaatatgaaaattagttgggtgtggtggcatgcgcttgtagtctcagctactccggaggctgaggcaggagaattgcttgaacctggaaggcagaggttgcagtgagccgaaatggcgccactgtactccaacctgggcgacagagcaagactccatctcataaattaaaaggaaagtatgatagtgttatggattttagctctgagtgagctggaaaactaggtcattatctagatgatttcagacttgaccctaattgaccatatatgaccaggaaacacttctgagtttacagctccgtggagatgacctcaacactgcctcttgatttgtttgatgcatgtcactttcattaattttccccctcctttttgaaagtcctgtggcagtactaatattttcattttatgtaatctctggtgctgctttccagtcactgtatgaagtgtctccccaacactagcaaatctaggtcctactaaatacaaatctctgggtggatgatcttctagtactgtatttttaaattaaggagttttagttataatgaaattgatttgtagtctgttttgccgtaaacttgtttttctttaaattgttcttacagtgatatcttactatttttaactgtctggggtttctgatatggggatttcagcccctggttaatcagtcttgtccctacaagtccctgatgcagtatgtttatttgtgatgtttaaagaacatttcttggctgggcgctgcggcttgcgcctgtaatctcagcactttgggaggctgagatgggtggatcacctgaggttgggagttcgagaccagcctgacaaaacatagtgaaaccccgtctctactaaaaatacaaaaattagctgggcgtggtggtgggtgtctgtaatcccagctattcgggaggctgaggcaggagaatcgcttgaacccaggaggtggaggttgcagtgagctgagatcctgccactgcactccagtctgggtgacagagcaagactccatctcaaaaaataaataaatagaaagagagagagaggaaaaaaaaagaaaagaacacttctttatttgagggactttcccaacaccaggtgcttggggatttcttagagatcaccaaccgactccctcactgtgaaattaaaccaagtactggaaacgtaactaaacagcgaaccatgtagcttcacctgactcagtgctgggggcctctaccatctactgtgcttgtgtcatgatgctttttctctgaagtggtgtgggaagtaccaggggactggcagaagcccaggccctctctacttttaccagcaactgatcatgtctttcagaatccatgtacatataggctgttctagccacagtggtagatttatgattcacatccgaaagtgtgccttagttatcaatttaacatttctctagtattcatatcccttttcttaccatatacctcagtgtatccttcctgtgtcaagccttataaatcatgtaatttagtgccactcatgtaaatcagtaaaatcacaaaggtctatttaatgaaaacgatttaccaatgttgtttttttttaacaagaaaaaaaataaaagcacattgtcattttttttcctcaggactcctggacttcttgaattaaaagatttcaaaagtctaagcacaaaaatgagatggaagattagatctttgtaaaaggttagtttaggctgggcgtggtagctcacgcctgtaatcacagcactgtgggaggtcaagatgggtgcatcacctgaggtcaggcattcgagactagcctggccaacatggctaaaccccgtctcttactaaaaatataaaaattagcagggcatggtggtgcatgcctgtaatcccagctacttgggaggctgaggcaggagaatcacttgatctcgggaggcggaggttgcagtgagccgagattgcaccactgtactccagcctgggtgacagagcgggactctgtctcaaaaaataaaaggttactttaaatctctccgaatttcttttgagacagagtctcactttgtcgcccaggctggagtggtgcgatctcagctcactgcaacctccacctcctgggttcaaaagattttcctgcctcagcctcccgagtagctgggactacaggtacgtgccacagccagttttttgtatttttagcagagatggcgtttcaccatgttagctaggatggccttgatctcctgacctcatgatccgcccaccttggcctcccaaagtgctgggtttacaggcgtgagccactgtgactggtggatctctccaaatttctaattttacacctcacagtctgttcatggtttctttttatgtcttctctaactcgagtcatgaaatgtgtcttctgttggcttaacctttctactctcaatcactactgcaacatggatcagcattttacattcccttgcagggagggaccatttgaggaattccaaatcaaatactcattactttttttcccttaaaaatttagtaggccaggcgtggtggctcatgcttgtaatcccggcactttgggaggctaaggtgggcagatcacctgaggtcaggagtttgagaccagtgtggccaacctggtgaaagcctgtttctactaaaaaatacaaagatcagccaggcgttgttgcgcatgcttgtagtcccagctacttgagaggctgaggcaggaaatcacttgaactactccagcatgggcaacagagcaagactccatctcaaaaaaaaaaaaaaaaagtgtaaaagggatagtatttttattgtcaaccaaggaattattaaaaaataataaaatttcaaaggtaatatagtcagtctaaagatgtctaagcttcatagtatttttcccaaatagcatgtgtatgcaagacacagaaaagctaagcaaaatagttattattctcactaaaaaattttttattttactaagaataatttgtcatttcagacaaaactaacatttttccatggttgctactatttctacttcttgaatacccaatttaaggtttagtcctcattgaacattaaaatggcatagatagatataaataatagatataaataagatacaagtataaagttactaaggttttctttttttcttttgagaccaaatctcgctctgtggcccaggctggagggcagtggtgcgatcctggctcactgcaacctccgcctttctagttcaagtgattctgtgtcagcgttaggccgctttggcctcttaaagtgctgagattacaggcgtgagccaccacacctggcccttttacaaaattgaagaaatgaaagggttaccccgcccaaaaaaaaaaaaaaaaagattacactggaaggaagtcacagattaaggatcaagactgttgagtctttaggttccaaaagcttcacctacatttttcttatatgtatttggatattaaagaaaataagttacatatacaccatggaatattattcagccatttaaaaaaaataaaatcttgtcatttgtagcaacatggatggaactggaagtcatcatgttacgtgaagtaagtcaagcacagaaagacaaaacttggatattctcactcacatgggagcttaaaaagtggattttggccaggcgcggtagctcatgcctgtaatcccagccccttgggaggccaaggcgggtggatcacctgagctcaggagtttgagaccagcctggccaagagggtgaaaccctgtctctactaaaaatacaaaaaattagccgggcgtggtagcggatgcctgtaaatcccagctactggggaggctgaggcaggagaattgcttgaacccaggaggcagaggttgcagtgagctgagatcatgccatttcactccagccaaggtgacaagagcaagactccatctcaaaaaaaaaaaaaaaaaagtggatctcatgaagatagagagtagatcggtggtatcagaggtcgggaggggaaggggtggggtgatgaaaagaagtagattaatgggtacaaatatatggttggatagaagaaataagacctactgttagatggatcggtaggtgaccatagtttaatcagtaggtgaccatagtttacaatatctactatacattgtgaaatagctagaggagaattcaaatggttctatcataaagaaaagacaaatatttaaggtgatggatatcccaaatacaccaatttgatatttacaaattatatgaatgtattaaattatcacatgcaccttgaaagtatgtacatctagcattcatcaattaaaaaaccccaaaagctcttactctatagaaatagtaattcattgtcattttatttaaatctgataaagcacaatctaaagcagactcctttcctcactgctaattgcaattttatttatttatttatttatttagagacggagtctcactctgtcccccaggctggagtgcactggcacgattacggctcactgcagccgcgaattcctgggctcaagtgatcgtcccatctcagcctcccaagtagctagaagtaacgtgcctgccactatgccctgctaattaaacaaattttttttcttgtagagacgacgtcttgctatattgcccaggctggtcacaaactcctggccttaaatgattttcccgccttgtcctcccaaagtgctgggattacaggcatgagccaccacacccagtctaatttttaaaaattatttaagtcagaccagtggcgtgtacctgtagtcccagcaactccagaggcttaggtgagaagatcctttgcgccaaggactttgaggctgcagtgagctatgatctcaccactgcactccagcttgggtgacagagtgagatccatactgtgaaaaataataatacataaaaaattaaacagggcgcacagtggcccatgcctgtaatcccagctctttgggaggataaggaaggcagagtgcttgaactggggaggcataggttgcaatgagccgatacagtgccacttcacttcagcctgggtgacagagtgagaccctgtctcaagaaaaaaaaaaagtatttatattactttagtgtcgtgtccctgttttctttgactcatatggggatccagctaaaattgaactgaacaccagaaatgaccttttaagagtaaaatggtatttcatcaataaatactttattggacatatagtccctatattacatttttatggaccttagaaatacacagaagtaaaagataaaatgggttgcccactgtcctcaatgggctaacaatctatttgagaagacaaagcatttaatacatagagacattttcttgttggatgtgctaaaacaatgaaagatcaaggaggtagacttgagagtctggatggatgtagattaggtggcacattgcagttaaacaaggaaaagccctaggtggcatggcatgtagtggtagaaagaatggtggaaggggccaggagcagtggctcatgtgtaatcccagcactttgggaggctaaggcaggcagatcacttgaggtcagcagttcaagaccagcctggccaacatggtgaaaccccgtctctactaaaaatacaaacttagccaggcagggtggcatgtgcctgtaatctgagctgctcaggaggctgaggcatgagaatcactggaacctgggaggtggaggttgcagtgagttgagattggccactgcactccagcccagtgacagagcgagactctgtctcaaagagaaaaaaaagaatggtggaagggtaattcacaaagtttatccagagtgtcaaagctcattcccaggctcttgaaccatggaactatcccagaaataggcagtaaaaagaggcacaggatactcttcaccttctgtgatattttcaatttagtgcatcttccccctgcccccccccaccccccgccgcttgctggagtacagtggtgcgatctgagctcactgcaacgtctacctccagggctcaagccagcctcctgaggcctcctgaaaagctgggaaaacaggcgcaaaccaccatgcccggctgatttttgttttttttacctttcatagagacgtggtctcactgtgttgcccaggctggaatttagtgcatctttattgaaaggatattgcattcatgaaattagctcataattgagtgtcaaaactgcacttaagtcaatcattttgtaggctattgtacatagtagaaaaagtaagaacgaccactctatctagaagtttactgcatatcaggggagattaggcaagtataaaaatgactaatacaaagtagagtgaggtaaggatgaattaacaggatgggagattattactgtggcagattggattttccaaaaattcccacagcggtattttgaatcccacatgttcttccagaatcttgccacaatctcccctagaggtggtgtccctaggacttgtggctgcccctacagacacaatgcagtaaaagatgctggttcagttctgaggacatcccttggaccccagctgccacgctgtgaggaagcccaggccgcttggagaagccatctggaggtgctggagctgacaccagcacccaatgccagactggggaatgagggagccacctgatcattccagtccccagccctggggctgtcccagctgacctcaagtacagcagagactcatgcaagctggacctaaattgcacgcccccctgaaatatataatttatttcatgaacatagatctgaacattagaacagattattgaggccggttttggtggcccatgcctgtaatcccagcacttggggaggctgagacagctggattgcttgagctcaggagttcgagaccagcctgggcaacatagcaagactctatctctacaaaaaatacaaaaattgggtgagtttggtggcggaaacctgctagtcccagctactcgggaggctgaggtgggcaggtcgcttgagactgggagttcgaggcagcagtgagctatgattgtgtcaccgcactccattccagcctgagccacagagcaagaccggctcttaaaaaaaaagaaagaaagaaagaaaaaagataacagtggcttcaggaaaactgttccacggtaggaggcatacgatcctgatctctgtattttggagaagacggaggggactagcttacgtcgagacagaggagttcataactattaactatacacaacgacgtgtcacaaatgtttacaaacttccaagagataacgataagaagcggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagccccagctactcgggaggctgaggcaggagaatggcgtgaacctacctgggaggcggagtttgcaatgagccgagatagcgccactgcactccagcctgggcgacagagcgagactctgtttcaaaaaaaaaaaaagaaggaagcaaaatacgattggttcggtcccgtccgctctcagcggctcagtcccaggcctcggggccagaaccgtgttccccgcgctacttgggcggcgccgagatcgcggcctccccgaagggtgcccaggaggcctgggtcggacgtggggcgcgaggaaacggcgggttttccacactgagccgcgaaagcctgtagacgacgaagaaccccgcagccttggcctctgcgcggcttccacgccccacggctgcccgcccgagccctgcccccaggcgcgccagccccgcctcccgggtcccgggtcctgggaccgggcccgccctgccccggcgcccgtggtcaccatggcaacgcagcggacgtcggccaacggcccgccctgggggcggggctgggccggtcgggcgcgcgggtcaggtggcgaagggcggagtctgcgcggggttgggcggagcctgcgcggggccggtaggatcgcgtcgggagccggtaccgaggcccgagccgcgggagtcgagcgaaggcagcgccgaggccgcggtttccccctgggcctccccagcagcagccatgggcagtgagtagcggcggctggagcggggactctggctgggaacgcaggccccgcctgggctgcgggcggtggggctggcgctcgctcggagtcgtgggggccagggatgcgcgggccgctccgggcctcagcggagggcacgggccgggggcctccgccgaggctcccctagccgtgcgaggccttgcccggcgggtaccgggacccggaggcccggggtttgcgtttgatagagggcgaggatggcgctgggaggccattggttttgggggcggggagttagggcaccgggtgaacctggaccactttttaatttttcaggagttaaagaaatcccgtgtttttattccctcgtcatctttccttggcatgttgcattgaagaaagctcccctaactcgtttaattttaaaaaaagtgatgcatggcgtgtgttttagggaggaaaggagtgtgcattggtaacagcgttttccttaaactgttcattctgtagcgtttactgaaaactgtaaggttttataagccttagggacaaggccttatgttataggaatgtttttcagggccctccccgtaacactcaaccccacatatgtgcacgtagctacttgcatagctgtgaagatgttcgttggatgatgggtcgtgcatacccaagcagggcacccattggccaactagtggacatttgggggaaattagaaaggagtaggagagacccgtggtaaaattttgcatcacaaggatagacagggggcagccaaaagctttgcttgaacatgaataccccttacagatgatcataaagtgtcaagaaatctgagagtggcttggattgaggtggagaggaaaagggatggagaggttctaggaagcctcctgatgtgattgatacttgtttcgcgttagcaatgaatgctttcataattcagatttactttccagaaaatccaaaatattaggttgctgcaaaagtaattgcggttttcaattacttctcaaaaaccgcagttacttttgcaccaacctaatagtacttgggtaacaaacatctgcccatgacaattagttaatccttctgtcaaacatcagtgactggtggggcgcagaggctcacgcctgtaatcccagcactttgggaggccgaggagggcggatcacccgaggtcaggtgttcgagaccagcctggccaacatgatgaaaccccatctctactaaaaatataaaaatcagcctggtgtggtggtgggcgccagtcatcccagctccccaggaggctgaggcaggagaatcccttgaacccgggaggtggaggttgcagtgaatggagatcatgccactgcacttcagcctgggcgatagagcgaaactccgtctcgaaataaacaaacatatatcggtgactgcccatcatttgtagaggcttttttaaaaaagataatatagtcaactttaggcaactacagaaacgtaatcactcacgtcagctttaagacaattttgggatgttggtatatagaatccagtgtctgtaggggaagaaaagccgcagagcctaactaatacctagctgcggcttgtctttctccacattgcagaccctttggcaaaggacagaagcttgagagattgtcattttcaccctccagttctctggcaggacttgacttaagccgtgccagaagacagtgtctatccttaaagaaccttgatttatcttacctttatatgttataagagtagtctgggaaaacaatactttctgatgaaatgtaattgttaattctctgggttgattattttacacaagcaagtacttttctattacctgggagagtaactaggcaatgaaatgtggtctgatgaaatcaaacagagattacataccttttttttttttttttttttttttttttgagacggtctctctctgctgcccaggctggagtgcaatggctccatccgggcttactgcaagctccccctcctggggtcacgccattctcctgcctcagcctcctggggaggggggactacaggggcccgccaccacgccctgctaatttttttttttgtatttttagtagagacgggggttcaccatgttggccaggctggccttgagctcctgacctcaagtgatccgcctttctcggcctcccaaagtgctgggattacaggcgtgagccaacaagcccggcctacatactttaaaaaggtaactacaggggctgggtactgctcacgcctgtaatcccagcactttgggaggccgagacgggcggatcacgaggtcaggagttcgagactagcctgaccaacatggtgaaaccccggctctacgaaaaatataaaaattagccaggcatggtaccgtgcgcctgtaatcccagctatatacgaggctgaggcaggagaatcacttgaacccggggggcggaggttgcagtgagccgagatggcggcactgcactccagcctggaccacagagggagaatccgtctcaaaaaacaaaaacaaaccagttaactataggggccaggtgccatggttcatgcctgtaatcccagcactttggaaggctgagatgggaggatcgcttgacgttaggagtttgagacaagcttggccaccatggtgaaatcccatctctagtaaaaataaaaaaattagctgggcttggtggcactcgcctgtaatcctagctactcgggaggctgaggcaggagaatcacttgaacctgggaggtggaggttgcactgagccgagatcgtgccgctgaactgcagcctgggcaacacagcgagactctgtctcaaaaaaaaaaaaaaaaagttaactataggaggtgattccatgatttttttgtcacctatgcatttcggcatctttcagttgtttaaggcagttctctacagaagagcccatttgccgttgtgcttcctgagtgcagaaggcaccctcctgtcttcctcctctgatacctgctttcttctgtcatgcattgtctcacgggtaccacggtagagtacatttgctcccttttgacgtcgtgatgccctttgaacagccccctttttgtatatgtaaaatgattggatacaagtgtgaggaagaaagtatgatgccctttgaacagccccctttttgtatatgtaaaatgattggatacaagtgtgaggaagaaagttctggaaaaaggttgcttggattgcttcacttctactgaccagccatcaaaccatttggacttctttgtccctggaatgatatctcttcctttacatatcatttgaaatggagaacagtatgatgatttaatttggggcttaagggtggggtgaattgctggtgaaagagaatctttgtatttgattttctagaaagacagatctttttttaacttcataataataggaacatttattatttttctttttacagtcaaatttttagaagttatcaaaccattctgtgcagttctaccagaaattcagaaaccggaaaggaaagtaagtataatattttagtaatatagagggtagctcaagggcttgttctatgaaaccagcaaaattcatttccttacctcagtccttctctgttggtaattggaaaactattggtgttcatcctccttgcaagaggcacaaagtgaataaaaataatataaatctgtttaaatctagataggttaactcatgctttcaaaaatgactgttctttaagttgtgacatttccaaattaagtgtttcttcggcctatgtgttagttaagacaggttattctcctgtctgtagtgatcctttataaatcctgtagtattgggtgtgtattgtgtttgctaatgatgtcacctactggactagaaataacccagtctgctcgataggttttgatgagtacagctgttttatgtaaatgaattgcatttgcacaaatatatacctcccatttcttgattcattcgttggaaagaaaaatgacaggaatgcattcagaagatattgtgactgggtcaaatcgttcttccatcattgcaaactttcagagttcaggtatttaaattctggaaatattgttaatcctagattggccaatttctagaaattcttcatcaaactacaaatttctcatcaaactaacaggaatagggacatagagataggtaaaagaattttaaacttactatttgatttagaagtatttatttatttatttatttttgagacggagtctcgctctgtcccccaggctggagtgcagtggcgccatcaaggctcactgcaagctccgcctcccgggttcacgccattctcctgcctcagcctcccgagtagctgggactacaggcgcccaccaccatgcccggctaatttttttgtatttttagtagagacggggtttcaccgtgttagccaggatggtctcgatctcctgaccttgtgatctgcccgcctcagcctcccaaagtgctgggattacaggcgtgagccaccgcgcccggctagaagtattttattgctttgagattgtaaaaatagttgttccattaacatttaaggcatcctgagaaaccctggctttgcagtctataaaatattcatatggcactgtcaccagcaggcccaccttcgcacagtgcagtgttcaccgaatcgcgtgcacattggatccctgttttgctttggctccttttcagtttcatttaacaccgtacaatgcagatgagaactgcctgtatttaagttaccttttttatgaaaagtaaagaaacttatatttaggaagttcagctgtttgttgtagctgctactgaggtgaaagggacattagaaaacaatctaggcccggcacagtgactcacacctgtaatcccagcactttgggaggctgaggcaggtgctcaagagatggggaccatccttgccaacatggtgaagccccgactctactaaaaatacaaaaaaattagctgggcgtggtggcgtgcgcctgtagtcccagcttctcgggaggctgaggcaggagaatcgcttgaacctggggtggtagaggttgcagtgagccgagactgcgccactgcgctgcagcctgggcaacagggtgagactctgtctcaaaaaaaaaaaaaagaaaaaaagtctacctaggatagtacttcaaaaaggggcatttaagagtgaataataggatgtcacgatggggaactttagttacgtttttgtgtggatttgtgctttaaatttgctgtttcgaaaaccaaacaccacatgttctcactcgtaaatgggagctgaatagtgagaacacgtggatacagggagggggaacatcacacaggggcctgtgggggtagggggaaaggggagggagagcattaggacaaatactaatgcatgcggggcttaaaacctagacgacaagttgataggtgcagcaaaccaccatggcatatgtctgcctatgtaacaaaccggcacgttcagcacatgtatcctagaacttaaagtaaaatttaaaacaataataataaaataaaaatatttaaggtaaaaattttgaagtaaaagagaaactgaaaaatctagatttgaaaattctttcctcagtaaaagtagatttaaaaaaatataagcttaattttttagaacatatttctctttttaaatttgtataaatataagtagcacaaatgcagttttgttacatgaatgtattatgtagtggtgaagtctgggctttgagtgtatccatcacccagataacgttcattgtacccattaagtaatttctcatcatccatcttttcctgccacccctgtacccttcggagactccacttctgtcattccatattctatgtccatgtgtacacattgtttagctcctacttttaagtgagagcccacagtgtttgactttccacttctgagttgtttcacttaagataacctcctccagttcgttccatccaggttgctgcaagggacatggtttcattcttttcatggctcagaagtatttcattatttatatacagcatatcttctttatccagtcatcaagaagcatctgtgcatgtgtgtctgtatatatgtgtgcgtgtgtgtatatgtatgagagagaaaaaaatgtttgtaaaactttgtacctaataaacaaaaatgcttcctttataacacataacggacattcccaatttctgtgaattaggccccaaagaataacctcaaaactctgctgccccccaaaaatttgctgtttcttggttttgattgatgattctttacattttgttgtacagatccagtttagagagaaggttctgtggactgctataacgctcttcattttcttagtgtgttgtcaggtatgtaactatactattaaataaatgtctgcaccattgttctaaggttttgattggttagaatttgagaattttttttgttaaaataaagaatacattgagctcaatatattgagcattattatcctttttattttttattattaatttttttttgagatggagtctcactctgttgcccaagctggatgcaggggcatgatctcggctcaccgcaacctctgcctcctgggttcaagtgattcttcttccttggcctcccaagtagctgggactacaggttcctactaccatgcccagctaaagtctcgctctgttgcccaagctggatgcaggggcatgatctcagctcactgcaacctctgcctcctgggttcaagtgactcttcttccttgggctcccaagtagctgtgggactacgggtgcctaccaccatgcccagctaatttttgtatttttgttttattttattttttgagatggagtttcacattgttgcccaggctggagtgcagtggtatgatctcgactcactgcaacctctgcctccccagttcaagtgattctcctgcctcagcctcccgagtagctgggattacaggtgcatgccaccaagctcagctaatttttgtatttttagtagagatggggtttcactatattgaccaggctagtctcgaactcctgacctcaagctatccaccttcttcagcctcccaaagtgttggtattataggcgtgagccaccacgcccagctgaatttttgtatttttagtagagatggggttttgctgtgttgttcaggcttatctcgaactcctgacctcaggtgatctacctgcctcagcctcccaaattgctgggattacaggcgtgagccaccacacccttttttatctggcaattttttgtttttaaatagagacggggtctatgttgcccaggctggtctccagctcctaggctcaggtgatgctcctgcctcagcctccctagtaggtaggactgcaggtgtgccccaccatgtctggctaatttttcaattcttttgcagggaaagggtcaagctaaaaccaaatttttgcaatcttgggttgtactgtgtttaaaaattactaaaatttgatgatagtgtttttttggtttttgttttttggtttttttttgagacagggtctcactctgtcacccaggctgcagtgatcacttcagccttgacttccccaagcccgggtgatcttcccacctcagccttctgactagctgggactacaggcacgagccactacacccagttaatttcttttggtattgtagagatgaggttttgccatgttgcccaggctggtctcgaattcctgggctcaagccatccatctacctgtatctcccacagggctgggattacatgcctgagccaccacacccagcccaatgatactttcaaataaaatgttgcagacatattaagttcacagtgtgagtataaaatgtggcctgcctatgttttagggttattgtaaagattaaataagataatttaggtcaaggtggctgggcatggtggctcatgcctgtaatcccagcactttggcaggccaaagtgggaggattacttgacgtcaggagttgagaccagtctggtcaacatggtgaaactccgtctctactaaaaatacaaaaattagccaggcatggtggcgtgcacatgtaatcccagctactcgggaggctgaggcaggagaaccacttgaacccaggtggtggaggttgcagtgagctgagatcacgccattgcactcaaacctgggcaacagagcgagatgctgtctcaaaataaataaatacatagatacatacatacatacataccagataatttaggtcaaggttttttggggagttcgaaaatctattgaaatacttgtaagaacttttaaaaaattatattaggaagcagtagaacagattaggtacataatctggagaaaacctaactatattttctttctgaaggatgaaatgatctgataattaaagtacttttactactgtacttgttttaaatttgttttaaatggtcagggagagaagtttaaagaaacaaagaaaaatacaaagaaaaaaaagaatagtcatccatatttctaccattgactttcagcatcttagaaactcctctccccaccattaaaaaaaaagtcaaccttgtggaggtataatatatatacagtaaagtacacctgtttttaggcatacattttgaagagttttgacaaatttgtacacccacatgactacaacctctgtggatatagaacacttctgtcatccccgaagttcactgtaacctttctcagtgaatctccacaggcccaggctaccactcatctgcatcctgtgactgtactttgatttgttttttctagagcttcatgtaaatggaatcatacagtagtatattctttagtgtctaacttcataatctttttgagattaattcatatggtcgttacgtcagtaactcattcctttttatttctgaatactgttctgatgttgaagttatcacagtttattcattcattcgcttgttagacatttgggttgtatccagattttggctacaacacatcaatttgctatgaacattcatgtataagtctttctgtggatatttttcatgggtgagtccttagaagtacagctgttgggttttatagtaaatgtatgctcaacttataagaaattgtcagctcttttccaagtggttgccccattttgtttgtttgtttgtttgtttgtttgagacgtagtctcgctctgttgcccaggctggagtgcagtggcacgatttcggctcaccgcaagctccgcctcccgggttcaagcgattctcctatctcagcctcctgagtagctgggatttcaggcacgtgctaccatgcccagccaatttttgtatttttcgtagagctggggttttaccatgttggacaggctgttcttgaactcctgacctcaggtgatctgcctgcctcagcctcccaaagtgctgggattacaggcgtgagccaccacgcccggccctcggttgccccattttgtatttccaccagccgtgttctggagttccagttgatctgcatcctggtctacttttagtatttttgattattttaatagtagtcatcttgccaggcgcagtggctcacgcctgtaatcccagcactttgggaggctgaggcgggtgaatcacctgaggttgggagtttgagaccagcctgaccaacatggagaaaccccgtctctactaaaagtacaaaattgagctgggcgcggtagctcacacctataatcccagcactttgggaggccaacgcaggcggatcacgaggtcaggagatcgagaccatcctggctaacacagtgaaaccccatctctactaaaaatagaaaaaattaggcgggcgtggtggcgggcgcctgtagtcccagctgctcgggaggctgaggcaggagaatggcatgaacccaggatgcagagcttgcagtgagctgagatcgagccactgcactccagtctgggcgacagagcgagactccgtctcaaaaaataataaataaaaataaataaaaatacaaaattggctgggcgtggtggcaaatacctgtagtcccagctacttgggaggctgaggcaggagaatggcgtgaacccgggaggcggagcttgcagtgagccgagatcccgccactgcactccagcctgggcgacagagcgagactccatctcaaaaaaaaaaaaaaaaaagaattcatgaacctgacagcactcaacatgggtagaggggccgagagctgctccaggggtgtgggcagtgagcttttgtagcagaagtaaagaattgcagaagtaaagaaattacttgattggctacagctaggcgtttgcctcatttgattatgttccagtgagaggtttctgtgtagccaataggctggttgactgtctgtaattggctgaaactcattcagaattaaatatcctctaaggtcattttcagttttcttttgtgagacttcagggtacagaaacaaccacaggctaatggccacctgcttagagtgccttaacaagttgaaactgattattatattaaatatagtgcaaagtttggaactctgcaactgtgacagattcatagaaaataagctcctattgttgcccacctgttgttgtacatgatcctctagctatggaatttactaagtgaaataaaattagaaaccaattttaataatcctactggttgcaggaaaggagggtataccattaattatgggaggttggcttgctgtttcccacagagcgcctaaccatggcggattaaggaaggtcgttgggcggagtggccgctctccacttgtggaatattttgagatggagtctcactctgtcacccaggctggagtgcagtggcatgatctcagctcactgcaacctccgcctcccggattcaagcgattctcctccctcagcccccggagtagctgggactacaggcacgtgccaccacgcccagctaatttttttgtgtgtatttttagtagagatggggtttcactgtgttaatcaggatgatctcgatttcctgacctcatgatccacccatctcgacctcccaaagtgctgggattacaggtgtgagccaccactcccagctgtttttgttttgttttttgagatggagtcttgttttgtcgcccaggctggagttcagtggcacgatgtctgctcactgcaacctctgcctcccaggttcaagcgattctcctacctccgcctcctgagtagctgggattacaggcacgagccgccactccctgctaatttttgtatttttagtagagatggggtttcaccatgtcggccaggctggtcttgaactcctagcctcaagtgatgtgcccacgttggactcccaagatactggtgttacaggcctgagccatcgtgcctggccctcacctctcactttaaatgaagagtgtctacagctgccaggtgcacataaaatatccatgtttcatgctttaccagttttattacccagctgataaattcagactttcagggaggtttaggttgaccaggtgagttgtttaaaattgctgccagcatcttttgtaactttcttaaaaatcagtttcatatagagaaggtttttgaaatgtctttgtctaatccccacatggttaaggaggggttaaggccaagtgctgtatcctaaatatgggttatataataggaagcaatctgaacttaagttgttttttgttgttgttttaatgaaaagttaatgtcctcattatggaaaatttgatacatatgaaaagaatacagaagaaaaagtcaaccataatcccaccatctacagataattgctgtttaggatttaaaaagatatctcctcctagtttgattttctgtgcatctatttacagtgtcatagtttatatatacactttcgtacttcgtttttatactagggcttcttaacagtcgcactcctgaatttgaggtaggatgattccttgccccaggggtctgtcctgtgtatttcaggatgttcagcagcactctggcctctactagccatcaccccctgttctgtgaaagggccatatatgcaaaatgacccgcaaacactgaaggagctgcgaaaccaatgaatgagggagacaaatccagtttgtcagtagagggtgattttacagacagaagcatagtttggggcagcagtaagacagggaaaggcctgcattcttactcccagacccagggctaatctatcatagggaaggggtgtatgtgctttgtgcaggacagttgaaggcagctttccagaacatgcaagaatgctgtgtgtcacagcctgttatttgtgtaatagcatcaacgttgcttggatctcagggcaggatttatggcgagtacatgttcttacactaaggactgtaaataaagcaggaatcaggaggtatccctgagaccagggttgagcagaagtcaacatggtagattagcatccaagatggagtcactttggtctccaccttggcccctagttgtggcaaccaaaaatgtctctagatattgccaaatgtcttgggtgggggctaaaatcacccctagtttagaactgctattttatatttagttttatgacataagtacttcttccatgttattacagattgagtaagcataatttttagtggccatgtaatattccattgtggatatcatcttcagtcttacattgagaagagtgaccttggctgtctttagtatatagagctttgcaaaatcattctacgaccaggcaggtataatattccataatctactggtgggagtgttttttaaattgtggtaaaagtatagaaaatatgccatcttcatcatttttagatgtgcagtttagtaacattaggaatgttcacattgttgtaccaccacactccataagcgatgtatttactagtgaatgcaccaagtgatgatttgttgtttttatttttattttcactttctggttcttttaattattttttttattaacccttatctatgtgatggaatgtttttctttttattttctttttaataaacagctttaccttgaagatatgcttgtttttgttgaagaacataagaatagtttttaaaaaagtattgcaagcagtaagtgaataccttgtaaattaagtgcacactttatactttttttttttgagacagagtctcctgtcacccaggctggagtgcagtggcgtgatctcagctcactgcagcctttgcctcctgggttcaagcgattcttatgcctcagccttatataatacagtttcataaactattttgtgtactattttagatcccactgtttggaatcatgtcatcagattctgcagatcctttctactggatgagagttattctggcttccaatagaggtatgcgtgtcttttctgtctccacactcctactcacagcaaacagatggaaacatgtggattagcaatgagttttcaatgtctacagggagggggaggatatcattgcctagaaaagcctagtatgtagataatgacaacaccgtgtgattaatgtaatcatagagaaatctgttcttgggttttcatggactggaaaaccctgatcttcagtgtcaaagaaggtgatgtccagataacattggaattggagtccaggtggggcgccgtggctcacccctgtaatcccagcactttgggaggccaaggtgggcagatcacctgaggtcaggagtttgagaccagcctggccaacatggtgaaaccccgtctctactaaaaatagaaaaattagccaggtgtgggtatgcacctgtaatcccagctactcaggaggctgaggtaagagaatcgcttgaacctgggagatggaggttgcagtgaactaagatcgcaccactgcaatccagcctgggtaacagagtaagactctgcctccaaaaaaaaagggagtccagtgtgtgagccaatcggggagctcagctggagctgagcctgaagcctcaagcagcattgttcatctgggaaattgtggctgaggatgctggacagtgagagtagcaaggggtacaaccagtcgtgaggtttcttacatttaggaacagtggttgcctcttttttggaaacacttttttcaggcgatcctcccacttcagcctcctgagtagctgggactactggtgcgtgccacaatgcctggctaatttttgtagttttgtagaggtgaggttttgccatgttgcctaggctggtcttgaactcctgggttcatgccatcctccctcaaagtgctgggattacaggtgtgagccactgcacccagcctggacatactttaaatcgatggcagatttttttttgatgtttttaggttataaaggtaatattgatttattattttaaaaatgcactagcaatttatatacagatttatatgaagctgaaaagaaaagtgtcacttctgaggggagctctggaggatttggtagattggtgactatcaattgaggccttttctttgcacatacattcacttacatatatctatatacttcttataactgaaaagtaagatgtcctgtatatactattctgctactttgtttacttaatatcttacatgagctattaatggccatgttattattccattataaggatacgctgtgatttatttgatcattcattcaacaaatacttactgagttcatattgtgtgtcagcctttgtgcaaggtgccgagattagagcagtgaacaagacaatgtcccagttgtcatggagttgatatttgctgtttggggaggtacctggggtggggaaggtgctctaggaaggtgatctttgaagacagctgcaggaagtgagagaggaggccacatgaagacctgagggaggcatattctagggaagagccagtgcaaaggccctgaggtgagcctgtgcttggtgtgttcaaagatcattgaggaggggccaggcgcaggggctcatgcctgtgatcccaacactttgggaggctgaagcgggaagatcacttgaggtcaggagtccagaccagcctaggcaacaaagtgagaccccatctctactaaaatcacaaaaattagccaggtgtggtcgtgtgtactgtggtcccagctacttgggaggctgaggtgggaggatggcttgagcctgggaggaagagattgcagtgagccgagatcacgccactgcactctagccggggcgacacaaccagaccctgtctcaaaaaaaaaaggaacattgaggaggtgagtgtggggtggaagaaatgaaagaagagggaggagtgatgggacctgatgttgcagatgtatctaagtcagatcatgaagggcttggagaccgttggatggagcacattttaaggaagatgggaaacttctgcaggccactaggttcctttcttgtcatatattacgtttttttccccccgattttatatcattataaagaatgctacaatgaaggctatcacaccgttctgtaactttttgatagaatgaatttctagaagttcaactgttgggtcacaagataggcatactgaaatttttgatagagaaagctaaattatcttccaaaacagttgtttgattttacactctcagcgacagtatatgagaatgaccatttctctttcaacagtggatattattagtattttagtctttgttagtcagagaggtaaaagctggcatcagttatttaattttgatttctttatagattggtgagtttgaacattgttttctgtttttatggaacatttgtatttcttctataagtggagttttattagtgtgttagattccttttgttgtaagtaataggaaactagatgctttcgtagtccgtagatgtgatgattggatcttcacgctcgtgtgtgagatgtgcctctctccagccttgttaggatgttggaacattacccatctgacatgaaaagaaaaaagaaaaaacattgttttaaataaaggagaaaaattaaggaataggaaatcactgactagcttaaacagaaacatgatacttgctggaaggatactggttattttttggaatctacagtggagatgaacagctaagccccaggaagaaggggagcaaggccagcccttaggcctcagcagcagggattggtgaacattttccattctctgtgcgattcagctccacactcccagatttattttattttattttatttttttaaaccaaatttcgctcttgttgcccaggctggagtgcaatggtgcgatcttggctcactgcaacctccacttctcaggttcaagcgattttcctgcctcagcctcctgaatagctgggattacaggcacaagccaccatgcgccactaatttttttatttttagtagagatggggtttcaccatattggccaggctggtgaattcctgacctcaggtgatccacccaccttggcctcccaaagtgctgggattacaggtttgagtcactgtgcctggccccagattatttgtttaaaattccagatgcccagggttctcaccaggcaggatcagcttcagttagagttccagggttgcacagtacaggtttggatgctgggggcctactcctgtgctgcattttcctgagaaagcttcagcaggagcagacacatcatgtatctgctgtttcctttttaaattgtttttttccttttttttttgttttattttttttgagacggagtctcgctctgtcacccaggctggagtgcagtggcgcgatgtcagctcactgcaagctccgcctcccgggttcacaccattctcctgcctcagcctcctgagtagctgggactacaggtgcccgccaccacgccctgctaattttttgtattttttagtacaggtggggtttcaccatgttagccaggatggtcttgatctcctgaccttgtgatccgcccgcctcagcctcccaaagtgctgggattacaggtgtgagccaccgcgcccagccagtttgttcactttttaattgatttgtaagagctctttgcacatgagagataagaactttttgtcatttgtgtttaatttttttttattcttttgggacaggctcttgctctgttgcccaggctggagtgcagtggtgcaaacagctcactgcagccttgacctcttgggccaagtgatactcctgccttagcctcccatgtagctgggaccacaaccgggcaccaccatgtctgactagtattttaattttttgtagagacagcatctcactttgttgcctaggctgctctcaaactcctggcctcaagtgatctgcctgcctcagcttcctaaagtgttgggatgacaggcgtgagccaccatgtctgccttaatagttttattttaaccattatgctgccttttgccacgtggaagttttgtagttgtatctaatcatatcttccatcttttcctttgtggcttctagattttttgccatgcttagaaagactttcttgcccaagatgataagctactcacccatatttccttctagtatttttgtcatttatcctttatgtttaaattttctatacatggaggctgggcacagtggctcatgcctgtaatccctgcactttgggaggccgaggagggcagattacttgaggtcaggaatttgagacctgactggccaatgtagtgaaaccccatctctaccaaaaatacagaaattagctgggcatggtggcttacgccagtaatctcaggtactcgggaggctgaggcaggagaatcgcttgaatccaggaggtggaggttgcagtgagccaagatcgtgccattgtactccagcctgggtgacagtgagactctgtctaaaaaaaaaaaaaaaaaaatttctatacatgtagcatttgttttgatgtgaggcatgaggcatgaggtaaggaatctaggtttaatttcctaaaaatggccaatttttttgccaaggtccatttttttctctactgatttgaaatgccatatttcttatatcaaatattcattaaagcttgattaagtctatttctggactagagctatttgcaataataaattttggtgatctaacttaagaaatctatctaatatctttttttttttttttgagacagagtctcgctctgtcacccaggctgaagtaagtgcagtggcacgatctcggctcactgcaacctctgcctcccaggttcaagtgagtcttctgcctcagcttcccgagtagctgggactacaggcgcccaccaccatgcccagctaatttttgtatttttagtagagacggggtttcaccatattggccaggctggtctcaaactcctgacctcatgatcctcccacctcgtcctcccaaagtgctgggattacaggcgtgagccaccatgcccggccatttttttttttttttttttttttaagacagaatttcgctcttgttgcccaggctggagtgcaatggcgggatcttggctcaccgcaacctccacctcccgggttcaagcaattcacctgcctcagcctcccaagtagctgggattacaggcatgcaccatcatgcccggatacttttgtatttttattagaaatggggtttttccatgttggtcaggctggtctcgaactcctgaccttaggtgatctgcccgccttggcctcccaaagtgctgggattacaggtatgagccaccacacccggctttttttttttctttgagatggagtctcactctttcgccaggttggaatgcagtggtgcgatcttggttcactgcaacctccaactcctcggttcaagggattctcctgcctcagcctcccgagtagctgggactacaggcgcacgccaccacacctggccaatttttgtattttcagtagagacggccaggatggtctcaatctcctgacctcaggtgatctgttggctttggcctcccaaagtgctgggattacaggcgtgagccaccacgcctggccaataaatctatctaatgtcttaaacactaaaacatgtttttattttttactattgaggaagtatctgagacgacatcaaaaatcccccgtaaggtggactattttctcatatgaaggccaccttttcagcatttatgaaaacaggattgaagggagtgatgtgacagagtggcccaggaagtcttggcactgtagaattacttgattccataccttccttatacagttggcatatttgattttcttatttctccctataaattctttttttttggtttgtttttgagatggagtctcactctgttgcccgggctggagtgcagtggcgcaatctcggcttactgcaacctctgccttccaggtttaagcgattctcctgcctcagactcctgagtagctgggattacaggtgcccgccaccacacctggctaatttttgcatttttagtagagacggggtttctccatgttgtcccgttggtctcgaacttctgacctcaggtgatccacacacctcggcctcccaaagtgtggggactgcaggcgtgagccactgtgccaagcctatagtactttttattcagggcattgctgcaggattgtgttaataaatgagaacttttcttagcaagtagtgtttaagaaatgaaaatttgcttgttaaaattttcacgtgtgtttcagttgaggtaattagggagtgcgacacctctaaatcagtttgtatcgtgtacagcaaacattgcacacttctctccccttcctttccaggaactttaatggaattgggtatctccccaattgtaacatctggtttgattatgcagttgttagctggagccaaaatcattgaagttggagatacaccgaaagatagagctttattcaatggagcccagaaacgtgagcattaatgcaattaaagagcattctccaaatttgagagtgctcgtggtaaagatgttttctctagtcttttcttgtctttggtggtaagcgtgctctcctttccccccaactttcatcagtgtttggtatgatcattaccattgggcaagccattgtgtatgtcatgacggggatgtatggggaccctgcagaaatgggtgccggaatctgtctcctgatcatcattcaggtaagaaatcctatattttcctatgcagataacaaaacagtttgattcctttttccttttctaacagttctttaggtgattggcttattcattttcttacttttgaattatttaattctagtattttgatcactgaagtgatacgtgtaaaatttttttaaaaccttctgtcaccgtgacgtgttcaagttgtgttgacgtgaaaaattcaaatttattctaatagcttcataactgcacaatacaaagaattatggatcaattgtattttattgattcttaagatacacatttgtcacattttgatgtctctagaatcaggatgtttttgtacagtaaacagtgccttccacttgcggtctgccaggaggcagtcatggtggtgtcactgcctgtgcgtgtgtcagcctgttcaggtcatgctgaccttagttggctgagtgtgatcttcacagaatgggtgtttgagttcaatcgctgtctaaaggtgttcagaaaatctgttgtgatttgttattgaaatgaaagtttatgtatagaagggcaagctagatgataaatatctaccactaggtctaaaatacgtttttgtaagtagaaaattaaaattctttgcaataaggtattgtgccataagttaattggcagtattcttttcttagtagtacacaaaataatgatgttttacatggtaatgtcttagagtcagtgaaacactgtttatacacacataaatatattccatgggttttttaaatggatgcttaggaatggaatttttaaaggtcaacataattattagtgtcctaagtatcttttttttttttttttgagacggagtctcactctgttgcccgggctggagtgcagtggcacaatctcagctcactgcagcctctgtctcccgtgttcaagcaattctcctgcctcagcctcctgagtagctgggcttacaggtgcctgccaccacgcccagctaattttttgtatttttaatagagacgggggtttcaccatgttggccaggctggtgttgaactcctgacctcgtgattcgcccgcctcggcctcccaaagtgctgggattacaggcgtgagccactgcgcccggccctaagtatcttaaaatatgttaagtttggaagctatttctctattgtacaatccttaaaaaccatttagataaattacccaagaacagatcatacttaagttatctttcttgtgttttgaaaagaagtttgctgaagttaataaacaatgggtatctggagtcctgattttcttggaaatgcctcttcttcttcactttatgaaattgggattagtttaggaaattttttctttttcttttcttttttttttttttgagacacagtcttgctgtgtcgccaggctgaagtgcagtggcacgatctcggctcactgcaacctccccttcctggtttcaagcgattttcctgcctcagcttcctgagtagctgggactacaggcgcgcgccaccatgcctacctaatttttgtatttttagtagagacagggtttcaccatgttggccaggatggtcttgatctcttgacctcgtgatccgcctgcctcggcctcccaaagtgctgggattacaggcgtgagccactgtgcccggccaggtatttttttctgtctgttcaaaagatcaagatcaagctgagaaaaatattttttaataatctcaaataccagtttattaatatatacatagaaggaaatctgactgtctcagactggcatggttgagcattctggtttttttgtttttgttttttatttttgagacggagtttcactcttgttgcccaggctagagtacaatggtgcaatctcagctcggcacaatcttggctcaacacaacctctgcctcctgggttcaagcgattctcctgcctcagcctcccaaagtgctgggattacagagcattctgttttttaaattagaaatgttatgtaggaagcaaaacatgattatttaatgagtgtgacttatatccaggaaagttatgctgttcaagtatttatttagcattgttaacaataaacatgacttttctaatgagatggaactgttttgtcatttgaccagggcaggaattttttttttcgagacggagtcctgctctgtctcccagactaaagtgcagtggtgcaatcttggctcactgcaacctccgcctcccaggttcaagcaattctgcctcagcctccccggtagctggaattacagggtcctgccaccacgtccagctagttgtgtatttttagtagagatgggattttgccgtgttggccaggctggtcttgaacttctgaccttaggtgatccacccgcctcggccttccaaaatgctgggattacaggcgtgagccaccacgccccgcccagggcaggaatttttaatgaaaatcaggttatttggaagctttctgatccccagtgtgttcgcatttggtagaagatacgtttccttaaagaataactgtcagatgtggtggctcacacctgtaattccagcactttgagaggccgagatgggcagttcacttgaggtcaggagtttgagaccagtctgggcaacatggtgaaaccctgtctctactaaaaacacaaaaattggccgggtgcagtggctcacacctgtaatcccagcactttgggaggctgaggcgggcggatcacgaggtcaggagatcgagaccatcctggccaacatggtgaaacgctgtctctaccaaaaatacaaaaattagcagggcgtggtggcaggagcctgtagtcccagctatttgggaggctgaggccgaacccaggaggcggaggttgcagtgagctgagattgcaccactgcactccagcctggcgacagagcgggactccgtctcaaaaactaaaacaaaataaaacgacaaaaattagccaggcgtggcggtgtgtgcctgtaatcccagctactaaggaggctgaggcaggagaatcgcttgaactctggagtcggagtttgcagtgagccgaggtcacaccactgcactccagcctgggcgacagagtgagactctgtctcaaaaaaaaaaaaaaagattaactttgtctttgtctttatttgtccatttacaaatcacttgattggcaaatttacagcccttgggaattagggaaagaggcgcattggatggggagagatgatattctggagtctgattttagtatctttcagggcttagggtttctcttcgtatgctttaggcattgttgaggttatggacaggccaattgttgccttcagttttgtttctttacagcattttctttctgcaatccagagtttagaataatcttgatttttagaagacacttagaactggcatgtagctcgtagaacattatacatcaagaaaagctctctagtatcttacttaaggatctattcagattcctaaggaatctccactgagcgattctcagccagctagctacaggattgacttcttacagagtcagttatggattgaaattgatataaaatagagttaagctattttgctgttcattttcagtattcagaaatcagaaatacttacagtccaagaatgaaacaagtgaagtggatgtacactgattcatttacatgaattctgatacacaaatatgcgtgttatggctaattcttctaatgttaatatataaagaggggtgtcatgtttgattgtaggtgggcagtgacccattggtgtcttttcaaggcgttactaacattgaaaatatgtggatacactgaagagctatgattggatcagtgtgtttcacccagaaacataggttttgaaaactgtttgcatgccgttgtggaaggtatttctcaccttatttgtttatgtttcattcacgtggttagtgtttttcagctagtgagtttagaaatctacatagcaggtcttgactaaaaattttaaaaaactattagagaatatcagtgtgcatggcacataataaaggtaagtatgttttgacatactgaacaaaagatagtttgacaaaactaagttgtgtgtaggtgtcgtgcagggttaaaatgttaagtgccatgtttataccggctcatcatacatgtcgtccattccccgtgaacatgtagcagttagggttctggtcccatcactgtagacgctgctgtcacttcctgggttctcatcccttttcacaggcatgcatgatatttactggcttttattcccttaattatagaaaccgtttctcatttctgtataatttcttcctccctttggaaaaacccaagtttaattttcacaggacatatgtgaaccactctgtagtccgatggtcactgttctgaacagggggtgtggagaattagagttgtttcagagctgctgtgggactctggagaggtcatttctcaaggcccatcacgatgctttctgtggctgatgttcatggacggctgttgcctcctgcataggatgggtttctctatgatggggagtctctgttcactaattacatgattgtggttaaatagaatcggtagtaagtcctaacctctacattattttgtcaaaatgtcgaacttggttttcaagcagtaaaggattagcatgatctctcttagaagtttggagaatcgtaccctttctcctgcccattgaaactcagactaaaagcctgtaaatagacaagttaggctctgtccaactactgaaatggcagttaaggagaaaaacaacactgtgtaaggtaagcatgcctaaaatggtctcatgtggttactttggtcgctcttccagcaggtgatattggataaagtgagtacaaaatgagggtgggcggcttgagagctgggaggaatggaagtgacttcctcacttctgccggagggtgtctttaaagtggggacatgtgtgaggttgggggcatggaagcatattttcttcctgtcttgattaggttatttgagtgcagggaaggggtcatatgactgaggaggtcacttgaagggctagggactgtttttaattaatgcatacttttacaggaatgtcttctccaagaagcaagttcagaattttcaatatcccataaattaaagtcagtatgctttcatttttaaaaacaatatgagcttaaccttaaccgtcttcaaatttacattcaatctttgtcactatgtgtatagaatgcatttttacattgctgctcgagtacgtatttgagtacatatttgtgttctagttttttattctgtacacattttatagagtatacatatatataatatatataatgcttttttcaaaggatcaacacagcccttagacttatcctttgatggcagtgtacatttccatcttgctattataccagaattcatctgactttttacttccttggaggtatttgggatgttttcagtttcttgctgtcataaattctagaatactgtgatcattttttgtttcagtgtgcttttcaaacaggctttatttaaacattgcaaaagaaactattcagataagtgtaaatagactttaaaagttgaaatgtctgctttataatacaacagtatttccagtcctcttactgttctagattggcctgagtaaatgaaagcaggccaaaagatgcagttggtcatcacagtgagattgcaacgatcaggccttaatattcaaaacgcccctagcttggaaatagccaatggtgttcctctccccctttcttgagtttgttcttgcttccgcttacttgcatttctttccccacagttgtttgttgctggtttgattgtgctgctgttagatgagctgctacagaagggttacggcttggggtctgggatttccctctttattgccaccaacatctgtgagaccattgtctggaaggcctttagtcccactaccattaacactggcagaggtacatcgcacagcgactgcaactgcacgcgttttgctggatgtgtgctgggaacaaacccatcgtgtcgcagtacatgcctagagccgttctggtttgctctcctaggggataaggaatgcgaattcttcaaaacttaatgagcagagatttgtggagtaagcaatactacctcagagagaatagtatcaaaattttagcctctgcttatttaaaatttcagtggttgcaaacagattttcaaaatttcttttgttaaccttgcttaaggcattgctgcagaagtcatttatttgactgatttcagcatccgtagggggataaaaaggtagtggattttagatttttcaaatgaaaagactgttgttcattgaatccacctggagcactcctactctgctgctcttctaattggctttgtaatagcaccaaagttttgaaatatttcattctctctttccccttcctcatctccacttctaacagatactgtcctaagtggttaatacctaaactctgatcccagccttaagaaaactgtaatgatgattaatgttcttggtgcggtaaacttcgaggcaggctcgatagagtgacatctgtctcttattctgacatctctgctctgcttcgctgctgtttatttttcctaaaaacactctctcccttccctgaagtagaggagaggcaaatctctatgaatgaaattttgctttggtaaattttacgttgtatgttttcttcaagaatagtctcttgagaaaacttcggatttatgctataaaaacatagatttgcctcaatgatctaaatatttgtagaacctgctcacatggctatatcataaagcaaacattggcgaattcttttgacccatattttctgctgtatactggactttcacggttagttgtttgagctttgggacagctttggacgatgagtccacaggtcgtgtctgtcttgattttacaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaagtaagtataaccttttcaccaaagtaagtgggatgtagatttttattttgctcttaaagagaatgccatctgacatgctgttgtttaacaagtcagggtttaagatcaagggaaataaaattttgcaattagagtctccagactctgattttaaggtgtgaaatattggagtctctgtactttttttgttttttgttttgacccatcagcaggaagcagactctcgacagtttaaaaggcagaacgtctttgttagcattgtcttttcttttctttttttttcctgagacggagttttgctcttgttgcccaggctggagtgcagtggcgcgatcttagctcactctaacctcctcttcccgagttcaagtgattctcctgcctcagcttcctgagtagctgagatgacaggcacgtgccaccacgcccggctaatttttttttttttttttttgagatggagtcttgctctgtcgccaggctggagtgcaatggcgcaatcccggctaactgcaacctccgcctcctgggttcaagcgattctcctgtctcagcctcctgagtagctgggactacaggtgcatatcaccacacccagctaattttttgtattttagtagagatgagatttcaccacgttggccaggatggtctcgatctcctgacctcgtgatctgcccgcctcggcctcccaaagtgttgggattacaggcctgagcccctgtgcccggccggcattgtcttttcatcccccgcactgttctttgttttccctctctggtctctgttcttttcttaatgtgtctggctcccccacttactctccgtttccttttttagggatttcgcgttgatctgcccattaagtcggcccgttaccgaggacagtacagcagctaccccatcaaactcttctacacctccaacatccccatcatcctccagtcggccctggtgtccaacctgtatgttatttcccagatgctgtctgttcgatttagtggcaactttttagtaaatttactaggacagtgggccgtgagtattatgtttatttacattatttatagtttattataatttgcatttcatggttgtatttttaatggaatgaggtcgacattggagcatttgctgtattttcagattcacttacctatatagcagagtttagtacttatctggaagaactggtaagtgttgcagaagtaagattgcccaagcgctttttattattttgctctctaggaagcactttcacatctcatttgaatgaccttttaagctaaaattgtggttgatttcataaaagtaatttcctattttgtcatcttattccagtattgtctacaataatgctttctaaaagatgctatttgctggctgggtgcggtggctcactcctgtaatcccaggactttgggaggctgaggtgggtggatcacctgaggtcaggagttcgagaccagcctggccacatggtgaaaccccgtctccactaaaaatacaaaaattagccaggtgtggtggcaggtgcttgtagtcccaaccattcaggaggtcaagtcaggagaattgctggaacccaggagatggaggttgctgtgagctgagatcacgccactgcactccagcctgggcgacagaacgagactccgtctccaaaaaataaaaacaaaaaatgctatttgctgctgctaacatgtgagatactggactcatcctaacctttcctatctcccaccctgcctccaggcctcctccatttttcatggtctgaatggcaataagccagcttgtgatgagctgggctagagataggcatgctattaactagacggtagagacagcggtgctgctagtaatataatcctatacattctcatatacatcccccatcataatttttttttcttttttttttttttgagacggagtctcgctgtgtcgcccaggctggagtgcagtggtacgatctcggctcactgcaagctccgcctcccgggttcatgccattctcctgcctcagcctcccaagtagctgggactacaggcgcccgccaccacgcccagctaattttttgtatttttagtagagacggggtttaactgtgttagccaggatggtctcgatctcctgaccttgtgatctgcccgactcagcctcccaaattgctgggattacaggcgtgagccaccacactcggcccataattttttctaaagccatctagccacgctgttattgaagcgtgagttactgtgggactgaattttcattggtttaaattctgtcacctaacaaaggggtattttccctcttaaaattatagattttagccaggcgtgttggctctcatctgtaatcccagcactttgggagaacaaggagagaggatagcttgaaggccaggagttggagacctgtctgggcaacatagcgagaccccatctctacaaaaaaacttaaaaactagccgggcacagtgttacgtgcctgtagtcctagctacttgggaggctgagttgggaggattgcttgagcccaggagtttgaaggtacagtgagctgtgatcataccactgcatgccagcctggttgacagagtgagaccgtgtctcaaaaataatagaattttaaaagactaatgtcctttattctttgccacagtaggtaattctagaatttgcaccccaccaaagaatagtatttttctgtacagttattcttgaaatatggtgtttattctgtgcatttgtcttaatatgctttttttttgcattataagttacaaagactcatacctttctgcttttactgaatgtcatttaaaaaaaaggtttttttaagataataagacagtaactcatatattagttgaagggaataggattccctttattcataatacttctttcccattcatttaagagaaatgtgatgatctctgttgtattctggctaatattatatcgaggacaggaaagtcaagagacaggaataagaagaatgctgtttctgccctccttagaatagtccagcagcagctattactctgatcagaatgtcatagtgatagtgctttgagtagttggtcctgtacaatttgtgttatgattttgagtaagattcttctgaatgagagaatgattgggagatagtgcttttgatctgggattaatgattctaggggcacagtaaagaaatcattgggcagtcataaattcaagaaccagatactgtaatcatcgcaactaaaaattggtttctcaccccctatctgtataccccaaaactttatttaatatgagcaaataatgctgttcctatttctgtaagatttaagtatatagataaaaatccaattattatatttattaaaagattgctccttataacatagaaaccacataaagtctaggcagcaagttaaagtcttatgtcagtattttagttgattgcattaatattttcatatggaaggatcattcatagggatcttaatgtactgactggatactctcatagctcagaaaatttcagattttaagtataatcagaggttgattgtaaatgtaatcatattcctattttcagtaatggaagattttgtaatatattacaatttttaaaaatgactcaatattttcacagtgtcttgcatgtaataggtgttcatcgtataactttgaaggagtgaaggtagtagacacaaaagtacattctgaaactacatagaatgactagctgtagatgccttgaacttaaaacactgtcatttctgagaagtttgaagtgacatgcaaatgtattcctgactaattaggttgaccacttgttctttgtactcctgttctgtaggatgtcagtgggggaggacccgcacgttcttacccagttggaggcctttgttactatctttctcctcctgagtccatgggcgccatctttgaggatcctgtccatgtcgttgtttatatcatcttcatgttggggtcatgtgcattcttctctaagacatggattgaagtgtctggttcctcagccaaagatgtaagtgtttggtttattttaaaataaaactcttggcaatgcatggtggcgcacatctgtaatcgtagcactttggcaggctgaggccgctggatcgcttcacctcaggagttttgagaccagcctgggcaacatagcgagaccccgtcatgactaaaaaaatacaaataaaaatcggccgggcacggtggtgcaagcccgtggtcccagctacttgggaagttgagacggagcagtaacgcttgagtccgggaggtggaggttgcagtgagccaagattgcaccactgcactccagcctgggtgacagagcgagatcctgtctcaaaaaaataaaaaaggccaggcgcagtggttcacgcctgtaatcccagcacttcgggaggccgaggtgggcagatcccatgggtaggagatcgagaccatcctggtcagcatggtaaaaccctttctctactaaaaatacaaaaattagctgggcgtggcagcgcatgcctgtaatcccagccactcaggaggctgaggcaggagaatcgcttgaacctgggagtcggaggttgcagtgagctgagatcgtgccactgaactccagcctggcgacagagctagactccgtctccaaaataaataaataaatagataaataaaaaatttttaaaaaagtaaaataaaactttgtttttggaaaattcatatttaattgtcaaaacagtagtggatacactcctttataacttaagctttaatttatacatttttaatgagtcagtgtcaccccaacaggctaaaaattggttcccaaaaggtaaaaaattcttagatattacagtggtttgcaaccctcctgcaaaacaaaatcttgtttggtaattgaagaagggttgagaagcaccggtttcatatgggtaacatggagcggaggagcactgaagctttggtttcctcaggcttaatgcgaatgatatgacaatgcaactttcaggttattgtatgttacgtgttagtgtgtggcgagcacttcgcatagaacgtggtagatgtaagcagtgaaatgttccagttggattttgaaagtcgtttttctctcggcaggtagctaaacagctgaaagaacagcagatggtaatgaggggccaccgagatacctctatggttcatgagcttaataggtaaggctgctagactgacacctttataggcctgtgtttgtgtttcagtctttcagtgttggctaaatgtttttctttgttcaagttcatatttaaaacccttctattcacacagatgaatcaaaatttcacacaaaacttgttttccatgtcaaaaccaacacctgaatttttcattgaaattgtgagcactgctctgctcatcccagtgataaaatcttgcagatcagtgctgttctcagcattggctggctgcacatacaatcaccagagagcttttaaaaaggatttcccaggaactgtggcttatttggtctggggtgagttccaggcatcagggttttattttttggtaacagctttattgagataaaattcagataccatgtaattcactcacttgaagtatattgttcagtgttttttagtatattcagacttgtacagtcataagtttaaacacattttcaccacccagaaagaaaccctgtacctactagcccaccttcccaaccaccagccccagacagccacttttaactttgtctctacagatttgcctattctgtacatttcatataaatggaatcatataatgtatgttattttgtaagtggcttctttcacttggcatcatgttttcacagttcatatccttaattcttttcatgaataatattcaattgtagggctttaccacactttatcagttgatagaaatctgggttgtttccactttttatgaataatgctgttgtgaacatatttgtacaaattttgtgctgctcagctgtcttccaggttggctgctgtagtccacattcccaccagcagtgtatgaggttccactgctgcctgtcctcgccagcactagctctggctttttaatttcagccatcctgatggatgcgaagtggggcacaatcacagctcaccgcagcctcttgggctcaagcgatcctccccgcctcaacctccagagtagcttgggaccacaggtgtgtgccaccacggccagctagcttttttttttttttttttttttttttatctgagatggggcctcactttgtcacccaggctggagtgcagtggcaccgtcttggctcactgcaacctcgacctcctgggatcaagcgattctcctgtctcagcctccctagtagcagggattacaggcacgcaccaccatgcccggctaatttttgtatttttagtagagatgggtttccccatgttggccaggctcgtcttgaacttctgatctaatcatccacccgccttggcctcccaaagtgttgggattacaggcatgagccaccatgcctggtgggatccagattccttcttttgcttgggggcatcctgttgtcccagcatcatttgttgaaaaggcactagtatttttccttaaactttttatttatttagaacacagactgcagagtagtatgatggatctccagctccagttgtcaccatcttgctgttcttgtttcacctatcactgcctctaatcttttttgagtattttaaatcccatttttcagttttccaggtgattctaatgtgcagccaaaggttgaattactgaaatggatcctcaaaatcttatgacataaatttgttcatacctactcttcattccacaagagggaacgaaaggttactcatttaaaaatcttaaacattttaatatttaaatctgtccaggaatctcatgtcctgtaagattacatattgtctttcttggctgttgactggttcctggaaattagggtcagagtctttgcctggatcagagctcctgttcccatgccgtgccctgcacacccctccacactgcagcctgttccctctggagttcagggaggctttagacccagctatggctgctgcgcctcgacctgtcttcgtctctagctgccgtgctgttcctggtctctgctgccgcctaacttggggttctgtctcctaggtacatccccaccgcagctgcgtttggcggtttgtgcattggcgccctgtcagtgctggctgacttcctgggggccattggatctggcactggaattctgctagcagtcactattatttaccagtattttgaaatatttgttaaagaacaggccgaagttggtgggatgggtgctttgtttttctaaatgttcaaatatttcattttgtgcgtgtgaaagggaaaacactttgacggatcgtttttgtcagatgacactggtggctccccttttctcccctcacagtttcttgtttcgagtgctgactgacccgtttctgaaatgggcaccgagctaagtctgtgtgcagcattagtacccgctgccttaaaactcaagtttacattattcattaaaaaaagtacatctagtgttgcctgtaatgctggaaaccagtgtatctaccttgctgtgttaaatcatgacagtgagacggtgagatggattcgttttgcacacaacattcaaaacacttcatattgcccccacttgttgaaaaataaatgtagttcaaattgccactttccagtatttttgagcttatttaatgagttctggaacatttatatctaatctatattttagataattactttttatacttttttaactcatggtatccccactccccacccccacctcatttttatttgtcccttctcaaagcagccacttagcccacatgggcgaaatcaagtctccagttatttctgccacaactgcttctaaggcctcctccttctcctcctcctcttcctcttcctccttttccttctcctcctcctctcttcccagtgacagcatcatcgtgctgtttgcctgtattggctatgccttctaactccaaccagtcacttgagaatattctttcaagattctgggccccgattcttttctgtttaaatccctaaagcaaagatctaattctcaagcaatgtctgtagttcagtgggggtgaacaatgaatatattcatgctaggaatttgtgtctgttgttgtactcacagcagcaacatgagtgtaaacagtagacaataaacttttatttaagaaaactgattcagttgtgttggaaaaaataaagaaatctgatattaaacgttttctaagatcatttgtataggttcagtgtattcataagaagtccaccctgagatgcctgtaaaagtcaaatgtaattacacttcaaactttaatcctaaattattgacagatagatagatagtgaccaacttaagggtaatcatatatgtgactaacatttgggaggaaacaggaaaacagtggtctcaaaacaacaatatcccagtctccatttgaaagagcatagatcttggtaaatcattttgaaaactatgtgctttatttcccaaaagatcaaacttaatttttaaaagacacccttttcagaagtatgggttttcattgctgtttagtttcttaggtgtggtatgtcttacgtagcttatgcttacaaagccaaataatcgcagggcaaggcagataaaggcaggcaggatagtgacagtggctcggtgagcatccgccaagggcctcagaccactgttaccataaaaacatccacccagtgttatgacgtccgatttttttttcccttaagaaggtggaaatatggcttttaatacataggaaaccttcagtttttaaatgcagggcaaataaacatttttaaacagtgccagccagactgccagttctcaaacagactgaatttccaaagcacaaccttttcatgtttataaaaaatagaaatggcatttagggatacattctaggatttggctctgacttctaagttgcactcttaggaagaaggagaggataagcttaggtcagctgcagaggtcattcccatggggagtggctggggaggaactgggctatgtggaaagactgggctgcgcccgtctacggatgccttctctcttgatttcaatgattgatagcatgtggctttcagacctaaggaagagttagagctttggagaatcacaatgcctgtgattgaaatcaggatttaaaaaagggttagaggcataggggaaggctaccattacaggaagtagttggatcttaattttcacatgtatagggctagacagcttcatctgtaaagttctgtatttccataattgttttatctttaggaagtccagtgtaaagatcttacagtttcactcataaaaatatcctgggctcagacagtgagcctgtggacaaacggaggctactgcagcattctggcattagcactctgattttatctggagagccctttcatatggttctcagggcctggcttacccgctggagccaggctagaaacatgacttagggctggatgagaatcatcctgagaattccgtgggggccagactggaaagtcctggaaaatcatggagctgctggaggccctaaaagtcaacacaaaaagagctaaactcactcaagaagctaagaaaatggcccaggaacactggtagaactgctagatgacagggtttcaggcatgggaaccagatcaatctgtacttcttgctgtgaactactctgtattgggtttcaggtactggctgatcttgctggttctgttcatggtttaacatcaagatattactgccccaaacatgtcagtcttacagatttgttttcagaaacttcaagtactctttgaggtaagaataggaaaagagatcctcaagcacgtgcagatgcttgcgggatggacctgaattttcattagtctcctagccttggtgtagtgaatggagtcaaccgttttccttacttaaaagctggttcagcctcagtaaatagatgaactgaaaactagtagaggattctatcgaaccctaccctagttggattcaactaccctagataaattttgcatagtaaaaattcaattagaagaggccaaaaagccttttttttctttttaacgctgttttaaacactaacggagtacatggttatttgcatacccagcttagaattttatattgggggttgagagtggaaatgacctaattgagaactcaggtctatttctctatacaaatacccctgtctaccagactggactagaaaagtaactgagctgtagttaactgctgttgagctttaaaaaaattggagtaaacatacttgcatttatattctttgttaattttagctggagttataacaaatttaaaggaaggtcacaacctacctgtaattacaattccataccaccaccacatctgttctgtgcttttattttacgaaaaagctaatggcaaatctacattaaactaagttgaatacaaagtcttagtgaagaaggcctggtggtctcgtttacaaaaatggccagtgtcatatttgggcttaaaatttcaagaagggcacttcaaatggctttgcatttgcatgtttcagtgctagagcgtaggaatagaccctggcgtccactgtgagatgttcttcagctaccagagctgtggaaagcaaagaaaacaacttagatcatgccgttaaggaaggacaaaacatcttattcaatcagtgtttgcgcagcaggtactactatatgtcacttcctatgctagatgctggtgataacgttttttttggtctataaggatcttaaagaataaagactataaaggcaagattacattcctagcatgagacaagaacatcagggataatgattttttttttttttggtgagacagtctcgctctgttgcccaagctagagggcaatggcgtgatctcggctcactgcaacctctgcctcctgggtttaagcgattctcctgcctcagcctccccagtagctgggactataggcgcacgccaccacgcccagctaatttttgtatttttagtagagacggggtttttgccatgttggccaggatggtttcgatctcctgacctcgtgatccacccgcctcagcctcccaaagtgctgggattacaggcgtgagctaccgcacccagccagggatgattttatgtgtgaaaacagcaaagttggaagtgtatagagccaatcgctatacctcatttatagctggggtagggctttgcttttctgaaaccagatggtgatgattatgtaggatcttagggattccatcttttctgctgctaggggatacatatgttcccccggcaagttaaactgtgtgcatgttaggactggagatctactaccaagaatgcggtctcaggaccttattaccacaggctttcattaaaatttgtttcactcagatggaggttgccagatgtaaaatcagcctcttgttttcctagccgcttgtttgggaacaagcctggggacatttgcaggcaggaagcatgtcctactcacctgggcacagcaggtgcttggtaactggcagatgctactctttgtagcaaactgatctttttttaattttttttttatgtttttgagatggagtctcactttgtcgccaggctgcagtgcagtgccacgatcttggctcactgcaacctgcgcctcccgggttcaagcgattctcctgccccagcctcctgagtagctgggactaccggcatgtaccaccatgcctggctaatttttgtatttttagtagagatggggttttactatgttggccaggctggtctggagctcctgacctcaagtgatcagcctacctcggcctcccaaagtgctgggattacaggcgtgagccaccgcacccggccagcaaactgatcttaaaatgtaatactttccttccgacttctcaaatgttgctggttgaataaacggtttgattactgtattttgattctgctaaagctaggcaacttggttcttttacccctcctcctttatagccatagtagccctctctccacctcccctcacttattctatttttttctcccttttctaagaccaaaagtgaagttaagaaggtggaagggagaaggaagacattttacaaaaaggatactcttctactaaaagataaccccgcacggcatttcacacttgcctacgtcaccctgctttccacgcacctcctcagagggaggggctgttattgttcctgttttatgaaaaaagccgagagaggctacagaacctgtttgatgtgatagctaattatggtccgcggagcctcaaaccgagtcgggcctgtgactccgagctgcgctgcctcgtattgattgtcatgcctttctccaaatacgcaccagataaactattgtatctattcagtatgattgttctaactctggctttgagctgtcgaggtggcttctaccttaggtctagtttttggaaaggtgaagcaggagtggaagctctctaagggatacgaaatctgattttatccaaagaaatcacagcagcctttgaaagacacattcagattttcaaacaaacaacagacaattcaaaaccaggcgctctgcttattcactgaaaccgtaagctgctgaaactcagggaaaagcttaagaaactggtcttaaagcttcaggccaaacaatgcttcaaatcacatttgaagtaatcacttaaaaacagtagaaaaatcagttatcaattacctaaaacacttatacccaataaaatattcccatgatgacaagtgtctgcttctttctagatgagtgaaagggatttgccagcccatacagaggtgctccttgaagggcccatggtatgtctccatacagtatctcctcgtctccacacagtatctcctcatgtctccatacagtatctcctctcgtggttttatcaaaggacttttctccccataagcttactgtttacaaagtctctaaaagatgggtggccaagaattatacaatgcatctacatgaccagtgatttctaagggccacacagctggtttggtttattatgtgaaaagcatatcacacggagtatacaggaaatacctcaagtatttgttgaaggagcatcatcaatttctccttgaacatacagcctccacaaaggaccatccctcatactagcatacttgaggaaaagctaacagcttatctacccacacctttgcattgctatggactgaaggtttaaagtgtagaatcgttttggctactcagcaggaatgtcatctgggccattctgtaggagaaaaagcctctaccaaaagtttgcacttgacccagaatgctttgctcttattttcaaactctgtgccacccagaaaggaaaattagtagtggtcacctgcagttttacaagttgctaggcatttgactttagtgatacaaaaaagataaagaaatggagttatatttagtacccagtttgctgggatggggacggggagaactggagaaactgggtggcggtctggagaatgcttaccatcaagtctctgcagcaggtcattcttgggtaaagaaatgacttccacaaactctaaacagacaaagtgcaagtgaaaacaaagctaacgtcaagagcctaccaaaacaacccaaaatgtctgcagccatcaccactacactaagtcatacacgctcggccaccaggagttgcagaacatacctccatcccctggaaataaacagaaggaaaacatttcagcaaggcctggagtggtaacatcggaagacttttatacaagaggcgtcaaaaaggctttgagaatttcacagaagcctgggtttctgctaacttaatttatatacattgtcaaactcgagcagtatgaagttattgttctccacataatgttaagtagcaaaatttaaagcatattcgatagtatgtatatttttatagatatgaatctgcgtattatgtaaaatatacagaacatataaaaacttaccttttaaccactatgaaggtacaattcagtagcattaaataacattcaaaaaggtgcacaaccaccaccagtatccatctccagaacttttcatgacacccaacagaaactcgggatccactcaacactaattccccatccctagtagcgcttactctactgtcttcctctatcagtttgtctattctgggcacccagatacgtagaatcagagtatttgcccatcatgttatcgcatgtttcagcgtgtatgtgtgtttgtgtgtataccacactttgtggatgcattcatctgctggcagacacctgggttgtttccacagaggcggccatgaacacaggcacgcaagtatatgagtccctgtttcacttcttctgggtgtagacttaggagatgaaatgccagatcatataataattctgtatctaatatgctgaggaactgccaaacttttccacagtgtctcatatgtatatgtgcagttcaaaaattaagatttattttatttatttatttatttatttatttatttatttatttatttatttattttttggagacagggtctcagtctgttgcccgggctggagtgcagtggtgtgatcttgactcactgcaacctccgcctcctgggttcaagtgattcttgtgtctcagcttcccgagtagctgggattacaggtgcgcaccaccatgcctggctaatttttgtatttttagtagagtcagggtttcaccatgttggccaggctgatctcgagctcctgacctcaagtgatccacccacctcaaccttccaaagtgctgggattacaggcatgagccaccacgcccggcaaaaaataagacttaaaattagttgcagtgggatactgaaacataaatatgaacaactgaagagggtaagaagttaaagaatatcactgatactgatttactgtggtgcacatataaataccccctttaaaaggatgggagagacaacacggaattgacagagacatcacagcttttgaatccaaagttgctaagaaatattatagagcaaagagaaatagtgaataatctgctgcccgttaacaattacttaggccatttttttttttttaagagagacatggtctcattctgtcacagagtggcaccatcatagctcctccaactcctgggcttaagtgatcctcctgcctcaccttccagagcagctgggactacaggggaacttaggccattcttaaaatatacatgaagacagaaaccagggtgatttaagtttctcactgtttactacttaagcctgcagctcatattactaagtgggaatacacttcatatagaaaacagggaaatatgtcatttaacatttttttacaaagaaagcgtaaagatgaatgaagtggcaaaagaaaaatgctaaaatacatgattaggaagagagacaagaatactgatgaagtctatttgaaagaccgattctttccatgaaagactacattcttttaataaatcaaactagcagcaagttccaagacacgtaatgcaaccacaccaccttcatcacagccgacacacacatacctggctttggcttcggccttgcgttttcggcatcatctccgttaatggtgactgtcacgatgtgtatagtacagtttgacaagcctgggtccatacagaccgctgtggagagaagggacagtcagatgcgtcagtccctttggcatttgtttcactatggtcttaggaagaagatgcgtcccgcagctcagcattgacgtggaggtgatgcgggaaaactagttctcacatttggtaggcagatctgcaggctgcaaagcatctgggcactcacactctccccagagctctcgagtcaagcttgctaggtctgcggggttagatggtactgtcaagtcataaaatcccttcaccacatcaaactcaaaaaaatcttccagtgatgagggtagcacatgcatgagatgggtgagcaataaaactcagggggtaggaaattcctaaaggcaattgattttttgagacagagtttcactttgctcttattgcccaggatggagtgcactggcgtgatcttggctcactgcaacctctgcctcctgggttcaattctcctgcctcagcctcccgagtagctgggatcacaggtgtgcgccacccggctaatttttgtatttttagtagagatgggtttcaccatgttggtcaggctggtctcgaactcctgacctcaggtgatccacctgcctcggcctcccaaagtgctgggattacaggcatgagccaccacatccagccaaaaggcaatttaatttcattaattctcccccaacttcaggcccttctggctccagtttcctcctgggaggggagattcccttacacttggtgaccagtcctaatctgtgatttctttctcttcagtgaattctgagcgtaaagaacacccaaataatcaatcccttcccagacggaggaatccatcacttggtgaattttcaagcaataccaacctggagaacattcggcaatgtcccctttgtagccagtttcttcttcaagctcccggagagcagctgcttctggggtttcaccatcatctatgagacctgcaagtccaaatcattggtgtgatgggagcgggaaatccggttctttaaaccctcctttttttttttttgagatggagtctcactctgtcgcccaggctggagtgcagtggtgcgatctcggcccactgcaacctccgcccgtccaggtttaagcaattctctgcttcagcctccagagtagctgggattacaggcgcgtgccaccacgcccagctaattttttgtatttttagtagagatggggtttcaccatcttagccaggctggtcttgaattcttgatctcatgatccacccacgtcagcctcccaaagtgctgggattacaggtgtgagccactgcgcccggctgaacccctcattcttgtaacacacctgctgctgcactacgttaggagaatcggagcactgtgaaaagtggtcttacagagaaacctgaggattggaactctttttttttttttttttgaagatgggagtctcacactgttgcccaggctggagtgcagtggtgtgatcttggctcactgcaacctctgcctcctgggtttaaacgattctcctgcctcagcctcctgagtatctgggaccacaggtacacaccaccatgctcggctaatttttgtatttgtagtagaggctaatttgtatttagtctcaccatgttggccaggctgctttcgaactcctggcctcaagtgattcacccgcctcagcctcccaaagtgctgggattacaggcatgagccactgtgcccagcttggaatttttatagaaacaaaaaggcgaaagaataaaactctgagcagatgaatcaggttctgaaggcatcatccagtcgtcctattcagacccagatccatcatgagccttcacgaccatctccacgctgctctgcacagcacgggcagcatctgtgaggagatgtgacttggtggtgaccaactggcttaggcttgggagcttgctgtgtggctgcagcacaggaagcctgctcatattctgcttcctcacacgtaggatgctgacagcatcacctgtcttgtcttcctccctcatagtaaaacaccgaggcctgggaatgaaaggccagaaaggagcaaactggtggccattaggggactcccatggccactgtgaggagtgaacagagaggccaaggaagaggaagggagcagcaacgcagactctttttcctgaaaggaattaaaaaatataataaggctgggcgtggcggcccacacctgtaaccccagcactttgggaggccgaggcgggcagatcacctgaggtcaggggttcgagaccagcctggccaacatggtgaaaccctgtctccactaaaaatacaaaaaattagccaggtgtggtggtacgcacctgtattccagctacgcgggaggctgaggcaggagaatcgcttgaccctgttaggcggaggttgcagtgagctgaaatcgtgccactgcactctagcttgggcaacaaaagtgaaactgcatctcaaaaaataaataaataaaataaaataaaataatgaaaaactcaggctgggtgtggtggctcacgcctgtaatcccaacactttgggaggctgaggcaggaggatcacttgaggccaggagtttggggccagcctgggtgacaaagcaaaaccccatctctacaaaaaatttaaaaatcgaatgcggtgatgcacgcctgcagacccagctacccaggaagccaaggcaggaggatcacttgagcccagaaggtcaaggctgcagtgagctgtgattgtgccactgcactccaacatgggcaacagagctagacatagtctcaaaaaaagagcccgggcatggcggctcacacctgtaatcttagcactttgggaagctaaggcgggcagatcacttgagccaaggagttagagatcagcctgggcaacatggcaaaaccccatctctacaaaaaaatacaaaaaatgaggtgggaggatcacctcagcctggggaggttgaggctgcaatgggctgtgatggtgccggagcacaccagcctcagcaacagagaccccatctcaaagaaaaaagaaaaagtgagagaagaatttattcacgttaatattaaaagtaattaaatagcctggccaggcgtggtggctcacgcctgtaatcccagcactttgggaggccgagaccagcctgaccaacatggagaaaccccgtctctactgagaatacaaaattagccgggtgtggtggcacatgcctgtaatcccagctactcaggaggctgaggcaggagaatcacttgaacccgggaggcggaggttgcagtgagctgagatcctgccattgcactccagcctgggcaacaagagcaaaactctatttcaaaaaataaaaaaataaaaaaaaaggtaattaaatagccttcagtaaaatggtgaggaaatgagaaaaatcatagttgttaaccatgtgttaccagcagctagccttttaaaatataaaactttggctgggtgtggtagtttaggcctgtaatcccagcactttgagaggccaaggtgggtggatcacctgaggtcaggagttcgagaccaatctggtgaacatggtgagagcccatctctactaaaaatacaaaaattagccgggtgtggtggctcatgcctataatcccagctactcaggaagctgaggcaggagaatcacttgaacccgggaggtggaggctgcagtgagctgagatcgtgccactgcactccagcctgggcaacagagcaggactccgtctcaaataataataataaaacgtataccactaataacaaatagatgagatttaatctctttagatgggaacaatccaataaagtcctacaataatatagggcaataaattttggagagctttaattactgtgcaagaaaaatattctagttgaaatgaagagtctccttggcctgtttccgcacagcagagcaaaccgtcttctccattcacatttcttggagttaagagcctggcctaggctgggcgtggtggctcacacctgtaattccaacactttggggggccaaagtgggtggatcacctgaggtcaggagtttgagatcagcctgggcaacacagtgaaaccctgtctctacaaaaaatacaaatattagccacgtgtggtgacacacgcctgtaatcccagctactcaggaggctgaggcaggagaatcgcttgaacccaggaggcggaggttgcagtgagccgagatcacgccaccgcactccagcctgggtgacagaatgagactccatctcaaaaaaaaaaaaagcctggcctacttatcattggaaatttccattagcagatggctaatgacaaacaatcaaataagctgagaaggggaagggcaattactcaaaaggctggagacggcagggtgcaagggctcacgcctgtaatcccagcactttgcgaggccaaggcaggcagatcacaaggtcaggagatcgagaccatcctggccaacacggtgaaaccctgtctctactaaaaatacaaaaaattagccgggcgtggtggcgggcgcctgtagtcccagccactcgggaggctgaagcaggagaattgcttgaacccaggaggcggaggttgcagtgagccgagatcgtgccactgcactccagcctgggtgatagagcgagactccgtctcacaaaacaaaacaaaaacaaacaaaaaaggctggaggcagcattgccaagaggaggttgggatgggtgggaggtggccttgtgtcgccttcacgggttcagagggttgttggggtgtcctgggggcctggaggagcctcgctacgaaatggtttagttttacttaaaaccacaaggacagattaaaaactgcagagctgagctttgcagttctcaggctttaccctggttcaggccaacatccctaagaagcaattcgatgttgagtgactcacctgcagggaactctatgcagtagccccccattggtggtcggaactgtttcaccagaacgatacactcatagtgaagtgttctctgcagcacggggatgaccgcgacacctgtcaccaggaaatggaaccaaggaaatccctaatgagaggtcagcaatgccagcacattgtttagagcaagctaatgaaaaccccagactttaagaaactccgttttaatctacaatactggcagttaatattggaagctattttaaaaatgtaattaaaaatcatcacttccatgttgtttacactttcttttttaaacaaaaaggctgtttaattgtcacagtttcttaaactaaaatcggaataaaacgaaacatttcctacagggtcaaggatgtaaggtttctgactacactgaccttccacagaaccactttccagcgtgtggcagccctaccactggtgaggccacagccatccctgtgctcctgggtcaactttgagcaagaaatcaagtaagttccactgtctgcaataaatgctagcaagactgattttccagttttagggtaaaagacctttcctctcaagttacttggccttcattaaaacctaagaaaaacaaaaacgactgggtttcagaaaacacaaagcacccaggagggtcccctggctccccacagcttcctatctgtgaagccagcagcagcagcatagctactgtttgcttccagcaaaaatggaaaccaaaactaaatggaaaaataagaaaagcctagtgcccaacttcccctcgaccagagtgattctcaggattgtttgtaggctctttgcagtcaaggcattcatgcctggaggggagggtgaatggaataggctttgcccaattaattccgtgtcctcatcaacctgtaaagcaagtggtccataagcatgaaggtgtgccaagtaactttccaaactaaagcctctcatctagatccttccaacaggacacaaggacttctagaagtcataacacgtctagacacaggtgtggcttcaaactatattgatttacatttagttataaacattagaacaacttcccctcaaaaacaatgttttgggcttagataacagaagccagaagttacttataaagaaagcttaatttcgttacatagtatggcaaaacctaagcggagatttaaagacacaacatcctaatagaagttaacttggttccattgaaaaccctcttacgatcacaagtgctaacttcctttctaaagggttggaataggtttgcactcctaccatccgcagtctgctctttcctggttgtacgtttcactgattcccaagttctgttcaggcagagaagaaaaaaaagtcattagtgctacagaagagaattttcttaggttttctctgtacaaccagaacttcttaaatgcaatgcatgcaaatgtactcatgatactggtcaagaagaccacagcaataaacgtctgcattaaagaagctaattctgctttcctatagcttctgaaaattaacaacgaaaactcttgccaccctacacctcaccttctgggtgcccccgaaacagaaagcctgctaagcatgtgagctgccgctttctcagaaaactttagtttggatcctatgtctctgggcaaggagcacagccagtgacagattaataagcaggtaatgcaaatgaagccataggaaaagactcaccccgtctctaggaacaaaagctactatggacaacgtgaactattgagattttcatatcattttgatttttaaaatatgtgacctaaaacacacaatttaagaaggtagaaccttcccatttattaatggaagaattattaaatgtaggcaagtgcccctactttgcatgtgtgagatcttatctagaaaaagtgggctgagtaacagcacagtcctgctctcttgtatggctttattcctggttagctattggtttctgactgttacccaactcagcttttgggtaacatctgtgctattctactttctggccttggaacatggggcacagttgtacaggaaacccagttactgacacaattatgcagtttaaaggggcgaggcataaaaggaacattctcccttcactctcttctccctacaacagaaaaaagcagtggtaagagaccagagtggagaagcaaacaattttaggatctcttttaaaggaagtgaaacatgtgggtggctctggggcttgggataaaaaggagttaccacctgcatctcgatagtaagagctgcaagatatcctcctcggaaccctcctgctcatgcttcctatccggctgtccttaaaatttggaccttgtcatattttcattaaaattgttcaaatatttaatttgctttttaaaaaacaaaacaaaaagactgtctggaaattgtaggtctttcagcattgtacccaaattccgaaggccaaatatgtcaaaatgaacacaggaaaatcaaacagacttctatgacaactcacagcagcccaacattcctgttagtagcaaggagctgaccaacaagcaatgctggtaagtaaatcatacagattgcaagagatgaacaccttttggcatagctctctctgctgcctcctaaggttagtcctaaagactgaagaagacagtgctgggaaaagcactgaaggtcccatcccaaacactaggaataagggaaacaaaaagaggagcatcattatcgtggttaaggtgaaggaaacaagcagtaacgagccataaatcaccagcaataaaacagaaacgcattgataagaaatctcggaataagattgcccagtgagagctccaacaacttcaaagggcctgtgagatgcacagctgactggaagtcagctcttcgtctctacttgcccgccagctaagcccagagctccagcctccctgaggctcttccctcctttgtaaaaagcaggaatgagtatgttttctccaaaacctcttctagctttaggattctgcttccagtgagatcatcctattcctagtcttctttgttatggaaaagcctgttggccttcctccctctagttcaccaacacaagaggcgggagggtcagagggtgacttcggcactgtcttgaatgtcaatagacacaacactactggaatatttttatatttctaaaattaaccccacatcccctttcatgaatgagacggtggaacataggattctctagctgctattttatctcttagactcggcccttcatatccgtgggttctgcattcatggattcaaccaaccacccattgaaaatatttaggaaaaaaattgcatctatactgaacaggtccacactttttcttgccattattccctaaacaatagagtacgactgttgacacagcatttgcattgtattaggtgctgtgattactctagagatgaagtgcgtgggaggatgtgcataggttagaggcaaatacatactgagtatctgcattttcatatcagggacttcagcatctgtggattttggtatctgcagggggtcctggaaccaaccccgacagacaccaagtgacagctgtacaggttgagtattccttacccgaaacgaggggccggaagtgtttcagagtttggtttttcagattttgaaatatttgccttaccctctgggtgtcatgcaggcctttttgacattttgaacagtatctttaccccacagagcaggaaataagccaaagaaccccacaatgagtcatgcacataggtctcagccctgtgtagggtgttgtggggaactgctgctgggcatccggtctgcacacatgccatttcatgaccctctgtgggagtacctgcagagggaagtcgccgtgtgcgtgcaaaggatatatcgggccgggtgtggtggctcacgcctgaaaccccagcactttgggaggccaaggtaggaggactgcttgagttcaggggttcgagaccagcctgggcaacatagtgagactctgtctctactaaaaaaataaaaattaaataaatttaaaaaaaaaggatatggccggatgcggtggctcacgactgtagtcctagcactttgggaggccaaggtgggtggatcacctgaggtcaggagtttcagaccatcctggccaacaacactgcctctactaaaaatacaaaaatcagccaggcccagtggcatgcacctctagtcccagctactcgagtggctgagatagaattgctagaaccagggaggtagaggttgcagtgagctgagaccacaccattgcactctagcctgggcaacagaacaagactctgtctcagggtaaaaaaaaaaaaaaagaaggatatagctgagctgaaggggagggttccttttcccctggggggacactgaatgtctgtgttgtatgcctgtgttctgactgcagcctgtcacacagagtcaggtgtggaattctccagctggggcatcatgttggcaatgaaaaggttttggattttgcagcattttgaatttcagattttcagattagggctgctcaacctgtacacgcaggcttttatatcaggtcagagataacacatcctataaattatacatcgtggcatacaggaaagtacaaagactcattcttcaaagggtgacattctggtataaaatattagtgctttacataaatcctcttcagaggccaggaaaaaaaccctatgtatggaagaatggacatgaccatgctataaatatggtagtttggtggattttagagcctactcccaatctactgaaatagatattctgaagtgagatttcgtcgtattttcagaaaagtccccatatgattctgatgtacatccctgattaggaaatgcaggaagggcagaagaccagtcaggcgaagagatgagctggcgcgaacacatctttttattttatttttattttttgagatggagtctcgctctgtcgcccaggctggagtacagtggtgcagtctcggctcactgcaaccacctcctcccgggctcaagcaattctcctgtctcagcctccggggtagctgggattacaggcgcatgccaccacgctgggctaatttttgtatttttagtagagacggggtttcacaatgttggccaggctggtctcgaactcttgacctcaagtgatccacccaccttggcctcccaaagtaatgggattacaggcgtgagccactgcgcttggcctcaaacacatgtttagactcattagagttgagggctatgttttgtgttataaacttaatttgacaggcaaaagagaaccaaactgtatcactatacattgggttccaacctctctatagtttcacaaatataaatacatttgaacatatggtgctccctaagacttgggccttgccacatttctgtatcgggtttgggccctacttattttgtacatttagttttccatatcaaactcacttggcatcttaagtgaagagttacagtctttcatggttggtggatcatactgtgcttagctttcttactgctgggttttaattcagcagtgctatctatctcttaacatgtttcctacagctctcccacattaggccttattaagggctttgctagtttagtagatataatcacagttgttcagatgactggcaagcccatgtatttgcatcttgacgatctatttcatcacaaagaaatcatgtactcttattggatcactttgcaaatggagttctcatactgatgaatttttatcacgtgatctggttactaaatttcatcctcattctgttgtactccatttaaatttcactaagtaaaaaattaattttcatagtattttcttcttatagtttataatatcaaaagattgctatgcaaaaatctggaaagtaaaagaaaaaaggttaaccacacagcttttttcccattttgctataattttccttccggctttttcttacacgttatttggcagagtttgaaaagcatatacatacttttctactttgttatcaacttaggagcttttcccatattgctaggttgtcttcagaatctgctttttagacggctgcagagattttaccaagggaatacactataacaattcatttcctatttttaagatatttaggttgctttcagtttttcttttaaaattttggtgaacattttctatacataaatttaattctgaatgctaatttacttaatactttctttttgttgttgttgtttttgtttttttgagacagagtctcactctgtcacccaggctggagtgctgtggtgtgatctcagctcactgcaacttccgcctcccgggttcaagcaattctcctgcctcagcctcccaagtagctgggattacagggccaccaggcccagctattttttgtatttttagcagagatggggtttcgccatgttgcctaggctggtcttgaactcctgacctcaaccgatgccccccgccccggcccccacccttggcctcccaaagtgctggaattacaggcgtgagccaacacacctggcccttaacactttgttaaaactgggattactcggtcaaagggtacagtatctttagggctactgacacatattatgaaatagggtgtacaaaatgtttttttcccaatttgcatttccatgaggcaggcacgtacctcaaaattagcaatgttgttgttttctctttatttcttctaatttagaaattaaaaacagattttactagaaggaagcaacatgtactgttaattattctgtcaccttatcagcttaaattaggtttggcccaaaagttttaggtctacacttgtctacttagggagaatggtattaaaatagttttctgattagttattgtaacacatttacaacccaattttattcagcaactataaatgatgcaaacatcctaacactggaaaaacagctaaatcagattatttaaaacagagtttacaaaaaagaaaacatcaaagtttatgcaaaacactcaacagataacctgagaacccaaataacgaacattttgtaagaaaaaaaaaaagtttacctagttttaccagtaggatccatgtacgttgttttttcaagcttgacccattttccttctgaaattaactaaaaggatatcagataataagttgggaaactttcaaaccaagttgtttttatctaaaagggtttttctttcacatttcctctgtctttccccagactcccaataatcatctttccttcccaataatctgtgggcacgtttttcagttcagagtaggtaggtattcagggttgtttttttaaagggcacttctgcttctttttgaaatttcttggtggtagtagttaacaggtgaaaagaaatgacagtctaaaaactcctgggggctgggggaaggggtggggcatggaggtaactggaagggagcacatggggtgagggtgtcctgggacgctcctgatggtctgtcccctgacctgggtgcatacaacacaggtgagtttcatatgtagaaatggccatttctagacactggtatttttcctgtcagtgatgacacaggaaggcggactgtggggaaacagggtccatccaggattggatctcctatcatgacacgtgggtttcccacccaaccacagatggacaccccaggttcgttctgcctagacactggggagttctggtgttggagactaacttacctacggcactatactgaactgagaggaaagcgtcactgcgtataaagcagtagcctttctcctactatcctatctttcacttcttgccagcagcaacctaatcattttcagcagatctgttcacagacaacatggaaagattttaaaccaaaaggaattccagaaaggtgtcaagatcagagatccaagatgaaggatttaaaatttatccactgcaatggttcctgcaggaagagacttttaaagctaaattgaataacacagagacatacattggttctagaattcactggaatttagactacaattaacaacgtaggtttttattgttcttaaacactcatgttaggccatcaacagccaagttgtgacaactacatatgaaatatctgagtccgcaaatgcatatattctttcttcttctatctagggaaatacaggaaggattaagaatttttctgttaagagcccaaatctcctagagtctcaatttcactaatacacagagagacacactactcctcccacacaagagcaaaatgtgcccgagcccaaaaaagggagtaggaaaaatctttacaactgtcttcaagaatgaaagaccaccattgtaacaacagtctatatatttctgctaaactcagatttatgtgggggagggaagggaaagtgaaaaacaagttatacctcctctgaaatgatatactgtttgccattctgagaagattccgttggttcttggctctccattttcaaacgagtctttacagccctcaggtgagaagttcaccctgcaagataatgagatttgttcaggctaaaattatttttctgaattaaacattcgtccacaggacactagtcaaagtacttaaacggcaaaaaattcatctaccatcaacgctgcctgtctcagtatgtgagggaactgccgcaggtggaaatgtgaacagggaggcccggggattagccaggaaggaagtgacagcagtcctagtcaccctcagccacaacagccaagctcctgccatgcctgttctaggcacttagaggccacccttcttcatcagatttttctttttttttttttcttttttgttttttttgagagagtctcactctgttgcccagggtggagtgcaatggcgcgatctcagctcactgcaacctccgcctcctgggttcaagtgatcctcgtgcctcagcctcccgagtagctgggattacaggcatacatcaccaggcctggtaatttttatatttttagtagagacagggtttcaccacgttggccatgctgctctcaacctcctgacatcaagtgatctgccctccttggcctcccaaagtgctgggattacaggcgtgagctaccgcgcccagcctgatttttctgactccgaatcttaaactctttccaagggaagacagaagaaagatttaccactctccatgcccacctctcagtcttttatccatctgttacacctaaacttacttattttttgagatgtaagatctcactctgttgcacaggttggagtgcagtggcgaaatcatggctcactgtagcctctacctcccaagctcacgtgctcctcgcatctcagcctcctgagtagctgggattacaggtgcatgctaccacagccaactaatgttttaaacttttggtagaggtggggtctcactatgtttcacaggctggtctcagactcccgggctcaagcgatcctcctcccgcctcggtgtcccaaagtgctgggattacaggcatgagccactggacccacctccccacttacttttaagtttcagcatgtatcaaagtcatagttgcagagaaaggatcgagtagtactacaagttctgttatgaaaagagcaggcccttatcccatttattgtatattattatttcctctttctttattccttcattttcggaccttgcctgtccgaaggtcaaagtctttttttcttacccacacacatggttgttaattcagctgtatatagaattatagacccaaagccagttgtctatgaaactgtaaggcattgcttagttgtcttacttctggtgctgctgttgagaagtccaaagctattcttattcttgatctttttgccatgtgacctgtcttcctcctctggaagcttgtagttagtcactttcatgtcgatgttattgtactgggaagtcaagtgggtcctttcaatctggaaacttcttactatgcttctttacagggaatttttttcttgaacgacttcactgatgatttcctcccctgtgttttctctgttgtttcttttaagaactgttacttggaccaggcacagtggctcacacctggaatcctagccctttgggggaccaagagtctgagaccagcctgggtaacatggcaaaaccctgtctccacaaaaataaaaaataaaaaaattagccgggtgtggtggtgggcacctgtagtcccagctactcaggaagctgaggcaggagggtcatttggacccaggagttgggggttgcagagagccgagatcacgccactgcactcttacgttccacggttctctaacctaccccacctaacttcggcttcaaagaaaatacagcccacccagcatcaactctcttcccaactgtcctaaaggaaaaagtgagtctgctctttgtttcttctgggacccaaagtgatcatactacccatctgatcttcaatttgtccccaagacagcaagcttccctattctaaaatacaatcaataacaaaaccaactgtatgaatattcataaagtgcgtttacaaatcaaatatctgattgactatcataggtaacccttgtggccaacctgtgaaaggtgagatgatgttttaggaaagtggcggtgaggccgggtgcggtggctcacgcctcacgcctacaatcccagcactttgggaggccagggcgggtggatcacgaggtcaagagatggagaccatcctggccaacatggtgaaaccctgtctctactaaaaatacaaaaattagctggacgtggtggggtgcgcctgtagccccaactacagggaaggctgagggaggagaatggcttgaacccaggagatggaggttgcagtgagctgagatcgtgccactgcactgcagcctggcgacagagcaagactccatctaaaaaaaaaaaaaaaaaaaaaaaagtggtggtgagagggacaaagaccctcactcccccggacctcattttccagtgaggagaaaggaaaaacagtgaggaagaacacaaaatttatgtcaagtgactcagcgtttcatgaagaaagattaaaaaggatgagaagtgtggggaagatgggaagagtaatctacacggagtgatcaggcaaggcctgtttaatttggtgacttctgaatggagacctgaaagcaataaggaagtaaaccacgtagaagtttaaatatttagagacagacattagcatattgaaacctgcagccctactaagaaaacaggcacttattcctttgaaagtaccatagatgataatttattaggtaaacttttttttttgagatggagtttcgctcttgttgcccggctggagtgcaaaggcatgatctcggctcactgcaacctctgcctcacggattcaagcgattctcctgcctcagcctcccgagtacctgggattacaggctcctaccactgcacccggctaatttttacatttttagtagagatggggttttgccatgttgggcaggctggcctcgaactcctgacctcaggtgatccaccagcctcagcctcccaaagtgctgggattacaggcgtgaaccaccgtgcctggccgctaaaagagagtatttctttggaatgcaatcagcctcaaagggaaacagtatcgtgcagcaatccactgattccgtgaatgacaaaaatgagctatttcaagagcatattcttaactatgagattcccaaacatttcagaaggactgtaaaagtacctcagaaatttttagaaacagaaaaggaatgttgtttttagcaccatttcaaaagcagaagccaaatagtgccattcgggggccagtcactgccagcaacacgctgcagaaagaacgagaaatgagctttaaattccgtgctttgtaagccagcgtctccgccactgcaacggagtttgccttcactgactcaacgctatttcaagatttaaaagcaaactttgatataaattttatccacttcattagttagaatttaaggtaatttgcatattgccaatatgtgtatggtatgaaaaagatacatgtacacgatgttgagtgttctacaatttttttttttttttttgagacagagtcttgccttgtcgcccaggctggagtgcagtggcgcgatctccgctcactgcaagctccgcctcctgggttcatgccattctcctgcctcagcctcccaagtagctgggattacaggtacctgccaccatgcctgattaattttttgtatttttaggagagacggggtttcaccgtgttaggatggtctcgatctcctgacctcgtgatccacccgcctcggcctgccaaagtgctggaattacaggcgtgagtcaccgcgccagcgagtgttctacaatttcatttatgattttccttagtctttaaagtcacaagctgttttaattctcataaatcgttttaactcagttcagtttgaacactgaaggtctaggatgtgttggatgtgtaattctccagagcataaaaaaaacactagtgaggggaaatgctgtaagatttttagacgtcttgcacagtggcaggctaactagcagtctctaactagcttcgagagcaccagcagtggaaacgtctgtgtatatactcagtgcacactgaccactatgcttgcccttgagcacgttacagtttagcaagcacatctggggcaaagacctgcctcagagacaccaccataccaggatgttttaaaggagggacacacacatccccttgggaggcagtgaggaaaatgataaagccttttttttttttttttttttgagactgaatctcgctgcaacacccaggctggagtgcaatggcatgatctcggctcactgcaacctccacctcccaggttgaagcaattctcctgcctcagcctcctgaacagctgggattacaggcctgtaccaccacacccggctgatttttgcatttttagtagagacggggtttcaccatattggccaggctggtttcgaactcctgacctcaagtgatccacccacctcggcctcccacagcactgggattacaggggtgagccatcacacccagccaagatttttaaaagatagtttgatgtgaagacatggtttagagaccaagagtgcagagaaagcattccaactagaagacaccacatgaacaaaggcagagacaccggggcaagggtgagaaattctgagtgtatggcgagctctgtggttctcaagctcctcctccactttctcctttaaaaaacaaaggaaaggccgggcacagtggctcatgcctataatcccagcacttggggaggccgaggcgggtggatcacgaggtcaggagatcgagaccatcctggctaacatggtgaaaccccatctctactaaaaatacaaaaaaattagccaggcttggtggtgggcgctgtagtccgggctactcaggaggctgaggcaggagaatggcatgaacccgggaggtggagcttgcagtgagccaagattgcgccactgcactccagcctaggcgacagagcaagactccgtctcaaaaacaaaaacaaaacaaaacaaaaaaaaccacaaaggaaaaaccaccaccacaaaactcccaaaacaactccacatataatgatgatttgcgaacacatttctaaggccatacacagatttggctggatctctgcccccaaaactgcaggccaacaaagcacacaaagctaactggcatggcacaaattactgttgtgatatgaggtagttttgggggccagtgccatgcactgcatgtgcctatagtcccggctacttgtggaggctgaggtgggaggatcgcttgagctgaggaattcatgatgaccctaggaaacatagtgagatcctatgtaaaaaatgaaaaaacaaacaccaaaataaactaattttggggttaggcagcaagtacagccctctacagaaagggaggaagtgattaatttttcaccaacttcagtatgccagtattagtaacaacagctgcataaagagttaagtgggagtttagattccagaagttaaactatgaactcaaaagcctggttctgcagttggcactgaggctcattactcaatcaccgtacccgaatcccggccatctgctgaggctgcaaagtgaagcaaaaaatcctaacaagaaattgtatgttggctaggtctctcctgataaaagatgaatattgttaatatcaacaatactcaaccaaatacaagatgcaggagcccacatcataagtagagcctctgactgacaaaagagggtcaggcacttggaacagtttaataattgaatagggaaatcaacaaggcactttgaaagaaattaagtggggagctgaggcaggagaatcgcttgaacgagggaggtggaggttgcagtgagccgagatcatgccactacactccagcatggtgacagagtgagactctgtctccaaaaaaaaaaagaaaagaaaagaaaagaaattaagtgggagagaggatcaattttttttgcagtaataacttactttatgattgtcttgttaaagtcaggcatcaaattgggcatgtctaaagtggcaatctacattctggcagaataattacaaagaaaagtcacttgatttagaaggaacaaagaatcaaataatttgcagttatatttaataattttggtcatagttaaaaatttttaaattctatttttaaaagataatattctggccgggctcggtggctcatgcctgtaatcccagcgctttcggaggccaaggcaggtggatcacttgaggtcaggagttcgagcctaaccaacatagtgaaacccccatctctgctaaaaatacaaaaaattagctgggtgaggtggcacacgccagtagtcccagctacttgggagactgaggcacgagaaaagcctgaacctaggaggcagcagttgcagtgagccaagattgcaccactgcattccagcctgggcgacagagcgagactctgtctcaaaagaaaaaaaaaggataatattctgatgtatccttcttttgtgccatttatggtaaaaaatttgggtacccacaattgaattcacttatgggtttttttttcattctcttcaggtgtggcagttgggtgggcagggagtaattaacgtttactgaaattatgctacttggtgatctccaggaatcatttagcaggtggtttaaaatcctcacatttaatgctggttgagcaagagtgaactgactgtaatgacccttgggaaggtgaattggttacagacgtatagtaacgacactgtaaagatagtccaggcaggagatgacaggtctggagtagagtggtagccgtggcaaagtgacatttaatttccacgaagacagttttaagggagactgggacatcggaagaaaaaaggggtgatgcagagctcaaatctgtacacgcttgtttgaggtgatagcagacatccagatgaagaaaaccagcagacaggtgaaaatcttaatctaggatgattagtcatgctatggattcagagaaagaaatgtgttttttcattacttcattaggaattgcacaataaatctcctcccccataatcacatgactactgacttttcagcatgcaggagaaaaagcaaatatttccactgttgaaaggttttattggagaaacttgatgaatacaatgacttcatggcttagtgaagacaaccacggtggttaaaatacagtgaaccctcatttagctgtatccattcaaagtatttgagcatctcctatgtataatgtcaatttatttgatgctggttaaatgtgtaacaagttacttaaaaccaactgtaataccaaaaagtcattgaacacacttctaaagtatactgcctgaataaaaggtatctataaaaattccttccctgtagtatctatatatttaagcttacaaacttagctgcttttctacacacaactgcaattctatattaaagctttgcaactgccttaatctctacactcttttttttttttttcccgagacggaaaaaaaagagtctcgctctgttgccaggctggagtgcagtggcgcgatctcggctcatcgcaacctccgcctcccggattcaagcgattctcctgcctcagcctcccgagtagctgggactacaggcatgcgccaacacgcccggctaatttttgatattttagtagggacggggtttcgccatgttggacaggctggtcaaactcctgacctcaggtgatgcgcccgcctcggcctcccagagtgctgggatcacaggcatgaggcaccgcgcccggcctatgctcaaatgtttcttgggctgttaaagtactgctcctcgcagaagggctatgttcccgggatctattctcttccgtacattcattcctatcttcattagaaaacatctgacctaaataaatcccccatcgatgctaacatctccttccgcgcaattttttactttctaagtcaaatcaaaacaattatttgagcgactgctcctgtctgccattaagtctttctggcaccaccctccagacatatatacaatattgcttctttccctcaaatcagaaaggactgcatagttccggatcaaggcataaatgatgaatcatgactgtccatccccaccaacatactctgcaacattataatctatttacctctgctttgaaaatgtattctttaaagcactgcttccaactagccacttagccagtaacatttttgagaaaaacaaaacacaacccaaaacaatgtatatattcctggggggaagagtttctaactcaaaatacgcagataattgtttattattctaaggaacacccttctgaagaggcctgcagtcggtggggctgtttctaatttaaaactacttaggtgaaccaggaagaatgtacatttaaggagatacttttagacgcagatgcctcgcgcaagcctaaagctcgtgtggtaagcgacacgactaggggttaaaagcggctggttggtaggcccggggccgtggctcacgccttgtaaacccagcactttgggaggctgaggcgggcagatcacctaaggttaggagttcgagaccagcctggcaaatatggtgaaacgccgtctctactaaaaacacaaaaattagccggcgtagtggcgcgcgcgcgctctcagctactcgagaagctaaggcaggagaatcacttaaacccaggaggcggaggttgcagtgagccaagattgcgccactgcactccaatctgggcacagagtgagactccgtctcaaataaataaataaaagcagctagttacttctcattcttttaacgaaacaaacaaaactgaactttgctgggtgacaggagtgaagcaaaggaaaaaacgatagtacaagttcgattcgaattcttccagtcttatgattcgatcatcgcaggaatactgataaaaatctgcgttttttccaggttgacaacttttgcgaggccagactaaacgaattcagcgctccaaggagactcctctttcctctgctttctcacatttacctctcgccttttacctcccaaagtcgaaccctccaggatcgtacaggcggtattccctctaccaagcattctactcctctgcagatgctgcaatctttacactggaactaacacttagctgtggtgttccccgctttctttactcggagtagcccaggctcttcctctccaatccacaatttccctccaatccccagtttccctcttgggcgcctggacgcgtgcccagccgcagcctgggagacaccgcgcggctgcacgcaccatgcagatgtggtccctttccccttcttcttctcctccccaaagaggttttgtgctgtgactggcttgccccggttacttactccaaggtgtaggggtgaagaacggaagaggacgaaataactagctggaggcagcagtgtcagccgatgccggtgccacggctcgaaacaccggcgcctctcgcggtgctaaaaggatgggcgcgcaccctccttccggcatccgtagaacccccgcctttgacctagcttcaggagattactttccgggtcagcgtgcgtttagggcgaagacggagttgtaaacttcttaaaattcctctctcgacacttcggtaattcctctttcgagactaaagctctttttgtatgcgtgtgtgtcaagcgtatgccccgggattctcctccgcttccttttctcggtcttccttcttgctttagggaccggaagagtccttgaaccaaaatagctcggcgggcacttccggggccggcgcccagagttccgggagggtgcaggcaggagagggaaaggcagcagcggcggcagctggaggatgaagaaggagcatgtgcttcactgccagttctccgcgtggtacccgttcttccgaggcgttaccatcaagaggtgagatgggagggggttcgcccggtcgaccggcaaaagggaactgcgacttctgagcgaatcttactgctatccaaaaaaatgcaggccttctagcgactgcatgggagggagtgtgtcgagagggaagtacatcagcaattgtctgcgtcctgttgcgagccagcgagtgtgctggctaggagggtcagttgtggttttcagtgagggtcggaggcgggaggaatagtggattaacctagtttaggcttgggagttcaccaccactacttttagaatggccccaggcgcaaggtgatcactgcctaagtgcactcggagaattaattgcttttcgccatcaccccagaggatggagattgggaaggtgaaaggatacgtaattacagttagatacgagaacaagttcacagatatgtcgtacagcatggaggctatagttaatgacgatatacgtattcttgaaaaacggagagtggatgttagtgttctcaccacaaaaataactatgttaggcaatgcatttgttagctaaatttattccacagtgtatatatacttaaaaacatcaggtaggcggcaagtattaatatatacaatttcatctctcagtttttttaaaggcgttgatagaaaatctgggctttgcacttaactgattttctgagccaacatttcagtaattgctgattcattatatgatggtttcattcaataaagatcggatatgtacttgaaaatgtgtaactggcttagaatggttaaaatgtataagaaaagtttcaagttcttaaatagtattggaatgtgtggtagaaccttagattcattgtacttaacaatttcgcttgttagctttgtaagagtaaaatacttaggaaggcttatttgtaatcagcaaatagacatattaagaaagaaaattgagtggtttatgaatagaatttaaaattttaaagagacttttaagttgcaaagtttcgcttgaaattgtttaaaatttagtagattttcaaacgtaataagatttgttagaagaaattaaaagcctgaagaactagattttttttttttgagacagagttttgttctgtcgcccaagctggagtgcagtggcagcgatcttggctcactgcaagcttcccttcccgagttcacgccattctcctgcctcagcttcctgagtagctgggactacaggcgcccgccaccacccccggctaattttttgtatttttagtagaggcggggttttcaccgtgttagccaggatggtctcgattgcctgacctcgtgatccgcccgcctcggcctcccaaagtgctgggattacaggtgtgagccaccgcgcccggccagaactagatttttgaatgtgaaattgtacctttgataaatcaaatatttatttttaaaaccgaagtttttgctctgtcgcccaagctggagtgcagtggcagtgatcttttatttatttaaaaataaataaaaatacttatttttaaaaccgaagtagcccatgaatactcttttttgtgcaaaaaaaccatttgtaatgtgccaaaaaaaacttcttccataaataaatgagacatgttataagtcattgatgttctgttaacttcgggaaagcaggctgtaatcttttccactttttgaagatgtatatgcctcaaaatcaaaataataccagcactcttagggatctgtggtagggctttttgataatttattatttcaaggtaaaaaacaaattatcccataagtttttaagagacttcaggtatggctttgccatccttaattatgattacctgaaacaaattaagctaaagcatgcctagtttaagcagctttatatctctggtgatcagttgaatagaaagccagcaagacacatccaaaagtatcatgaattcttagcggtaggtgctcactgccaacccaagaatggtttccagatcttgactctacttctgccctctatctttagaaggtgaccaaatgctagtcatcttctagttgggtttgctgcatttcctgtgttgcagcaaatatctgctggtctctgatttcttaaagacacataaatgttgtgctcactcagaatccttttgagcttgttgctttcatactgtgatttccatctggtggtttggatttggctggtttttgtttactacaaagaccattgtggcaataagatgaaccgcagtaatcttattattctgatttcttgtctactgctaccaaatgtacatcattaacattttctactttatattaaaagaaagacaattccaaaattaatcaagtgtagagatttttctctctgcttatagttggtcttttaaaatgatgccttttttggtgttttttttttagtgtcattcttccacttcctcagaatgtgaaggattatttactcgatgatggaactctggtggtttcaggaaggtaaagtattttagaaaaaaatttcttaaactttatcataaagaaacacataaaatgaatgaattagcttaggcaccattctttccctttagctctttttctctcctagccaaaatgatgtgctgatctttgtctcatattccttctcaatgttcacttaatattttcaacattaagtacttttccctctaataattacaagttgtgaaattgagcagttcctttcatctctgtctttagaaaacagttatgatgacaacttttccttctgacggtagcagggtgggggaagtacatattaaaattctttgagatccttcagttttgacgattaaaaattcactgttgcaaacaggctttatcatctaattcctcaacattttcttccccacgattgaactaccgtggccccccctccactttctagaagctgttcaggtagtttccctatttatagaataaagggaagaagttactgtgtttcagtcttttggatgcaaacttgaaaacgttgaagaatcataggatttagtgaagttctcattttttaattcgagtctgctcagaagtcacgttatgagtgttcagccctcaccagcctttctaaaatagcctgacagtaaccctatgccctgacctcccttcatttttctgcataacacttacttccacctgacaattgttaattgttccattagaatgcagtttcatgaaaacagggacttggcccatttgttcaccccagctcatggaacagtgcctgatatagcagaagtgcttgataaacatttgttggatgaaggaactatagaaatacagtaagaattgtgtgttttcagtactactaactggaccccatatttttgcctgttgggtttttagtgtggttttctggattatatttctgtttttggtattcacagagcctcaataacctgaaaattattaatgtagcgcctcattaactttgaataatttgaggctgaggaaacagtaggaaagtcagataagtctcaactttaggatatttacagatataattttttttgttttgtttttcttttgagacagagtctcgctctgtcacccaggctggagtgcagtggcgtgatctcagctcacttcaaggtctgcctcccgggttcacgctattctcctgcctcagcctccaagtagctgggactacaggcgcccaccaccacgcctggctaattttttttatttttagtagagatggggttttactgtcttagccaggatggtcttgatctcctgacctcgtgatctggctgcctcggcctcccaaagtgctgggattataggcctgagccaccgcactcggcatttttttttttttttttttttttaaagatggagtcttgctctgtcagccaggctggagtgcagtggctcaatctcagctcactgcaatctctgcctcccaggttcaagtgattttcttgctacagcctcccaactagctgggacaacaggtgtgcgccaccacatccagctaatttttgtatttttagtagggatggggtttcaccatgttggccgggctgtcttgaactcctgacctcaggtgatccacctgcttcagcctcccaaagtgttgggattacaggcgtgagccactgtgcccagtcagttttattctcaaatacgtgtacctatttgctttataaatgagcttatatataataagcttatgtaaatgagactataagtaaaatagcttttaatattagaaaataattggtaaatctcagtagtgtaaacatgttgaagagctcctatgatgattctccctggccagatgtttgcatggcctgtggcttaggcaagcactgatgttaaatactgttaaacagggctgggcgcggtggctcatgcctgtaatcccagcactttgggaggccgagttgggtggatcacctgaggtcaggagttcaagaccagcctgaccaacatggtgaaacctcatctctactaaaaacacaaaaattagccgggcatggtggtgggcacctctgattcctactactcgggaagccgaggcaggagaattacttgaacgcaggaggtggaggttgcagtgagccgagatcatgccattgcgctccagcctggacaacaagagctaaacttcgtctcaaaaaaaaaaaagtactgttaaacaacacgatacagtgctttacagtaacccacaaatcacatagggaccctgcccttttggagttgacagttcagcttcatatttgtgaaagccagcatggcatggtgctgtttctttagtcagattgcttaattttaagtaatatctttgctattttctagcccttccctctgtgcctcagtttccttgtctgaatattgggcaaatgacagtatagaacttactttgtagggtcattgcaaagatacaaagtgataatacataaaatgttcagtctaatgcccactatattgtatgctcttaaaacatggaactacttttattatcattgatctaagatgaacatagcaaacacacaagagaatatataatgaaaattgggataagtgctatgcagaaagtggggtggtcattacccttaaattgctgggagagctgaggatcgcgaggagggtcggggaatgctccgaagaaggatctttggagcctctgagatgtgaagattggaggaatgtagtcagttgaagggtgaagggaagaatcttccaggtggggggaacagcattaatgaaggctctaggcctggaagatcttgacatacaagaagcttgggaaaggtcatgtagctagagtatggggagtgagagaagggtaagtggcatgagattcacagttgatgacatgggggaggacagttaagattaggggtgtgtgtgggagtcatgttaaagatgctgcaatttattctgagaacgtcaggaaggcattgaagggctctgagcaagagaatgactcgatcagatttcagtttgcagctgtggcaggtgactgtggaaatggaagacgggttaggaggatattgcatttgactgggtgagacctgctagtggcttgaactaagatggtgacagtggggttgagggaggaagtgggtttcagaagattgggagcttgcaccttcagaacttgatgacaggaatgtgtcaagaattcctctcagattactaatagaacaactagatgaatgaagatggtcatttgctcaggttgagagaagcattgtctgtggagcctttttgaaacctcacaatctgttgagaattttgaaaagttagtgattttaggttaggttacttctacagataaaaacttgaaaattttaagtataatttaaatgaggtacatttatgataaaatgtataggtcttaagtgtacaacttggcgaatgttgctaaatggttacacctgtttcaccgtcactccattcaaaacatggaacactttcattccccagaaaggtttctcttgtccctttcttagttcagtttcgtcagttctagaatttcgtataagtggagttatatagtatgtattcttttatgtctgtgtaagtggaaaaaatgcaaaccgtttttcctctgctctcacaccacaacaatcaacacagaagacctctgtgaccacatgtgtggggttttcttcccaccaagaagcaatcggttctgcagcagacaccagctaagggtcctccagtccaattcagttgacactgtctacctggaggagcatcagatcccacaggttgaggctcagtctcacaaagactgccccccactctgatgtcagctgcaagccccaggtgcctctacctgtgcaactgaccaggcggctagaaatgagggtccctccttgggtttgattcatttgctagagcagctcgcagaactgagggaaacatttacttcggtttaccggtttatcataaaggatgttacagccctggtgtggtggctcacgcctgtaatcccagcactttgggagcccaaggcgggcggatcacttgaggttaggaatttgagaccggcttggccaacatggcgaaaccacatctctactaaaaatacagaacttagccagacgtggtggcgcactcctgtaatcccagctactcaggaagcttaggtaggagaatcacttaaacctgggaagtggaggttgcagtgagctgagatcgcaccattgcaccccagcctgggcgacagagcgagactccgtctcaaaaaaccaaacaaacaaaaataaaggatattaataatggatacagatgaagagatgcgtagggtgaggtgtaggggaagggatgcagatcttccatgccctacctacacgtgccaccttccagaagctccatgtgttcagctatccggaagctctttgtacttcacaagaaagtgggagatggctgtggaggtctgccatggaccctaattcttcatgcctcatcctccattacttccacatatagtacatgcctttctttccagactctataaggtatagtcttgtttacagttagaatttagcacatagtctgggttcaataaatattggttgaatgagtgaatgaacatgcttatcctactttctctccatggtaacctctactgagttcagtgaatagaataggccaagtatgatgactagtttaccttgtttgccgactcagatctaatggtaatggtttcctggagtgatatgtagaggattctgaggctgcatccagggttcggtgagaaagcatgcttggtttgattctcgttgcctgctgtgggtgtaggaaaggaggctggcaatgtgcttttctgatagagacagtgattcaatttcactgaacagttattgcatgcctagtatgagatgggcaccaaggaaacgggcaccaagcttgatactagcgtaacaagatgagcagggcatcctaccgtaggagtctaggcttattagcaagtcaaacataaataaataaataaatgtcttgagttgtgttgcgaaaaatgtttttgaataaaagcatcaaccagctgtggtggctcatgcctgtaatctagcactttaggaggcggaggtaagaggatcacttgaggccaggagatggagaccagtctggccaacatagtggggccccatctctacaaaaaaataagaaattagctgggcgtgttggcacacacctgtagtcccagctgctcaggaggctgacacacaaggatggcttgaacccaggaattggaggctgcagtgagctatgatcatgcctctgcactccagcctgggcaacagagcaagaccttgtctcaaaaaaaaaaaaaaaaaagtatcaggtattctgataagtaatgtatttggggtttaattaatcactgtgagctggggtcatccagaaagtgtttacagtaaggtgatacttgaactgagcccacacactgggtctgacgcaggtggtacctcccttccaggcactaatcctcattgtttcttcttggtcacgagttctttcctgaccttgtctcccttaaggctgaatagtaaaatgagttgagcatccctaattagaaaatctgaaatctgtccagatgggtgctgagatagtgacatttttgctttctgaatattgtataaaattacctttgagccatgtgtataagatgtatgtgacactgacacataaatgatttttttaaattttttaatttttagtttttgtgggtacatagtgtacatatttatggggaacaagagatgttttgatccaggaatgcaatgtgacattagcacatcgtggagaaaggggtgtccatcccctcaagcatttattcattaagttgcaaacaatccaattacagtctttatttttagatgtacagttattattgactatagtcactctattgttctgtcaagtagtaggtctgtggtcgggtgctgtggctcatgcctgtaattccagcacttttggaggctcaggtgggcagatcacctgaggtcaggagttcaagaccagcctggcccaacatggtgaaaccccgtctcaactaaaactacaaaaattagctgggcatggtggcaggcgcctgtaatctcagctgctcaggaggctgaggcaagagaatcacctgaacctggaagatggaggctgcagtgagccgagatcgtgccactgcactccagcctggatgacagagtgagactccatatcaaaaaaaaaaaaaaaaaaaaaaggtcttattcattctttctactttttttggtactcattaacccccacctcctcacagtcccctactacccttcacagcctttgctaaccatctttctactctctatatccatgagttcaattagtttttagatcccacagataagtgaaaacgtggtgtttgtcttcctgtgcctggcttacttcacttaacataatgatctccagtttcatccattttgttgcaaacgactggatctcattcttttttaatgactgaatagtactccattgtgtatatgtaccacattttctttatccatcatcagttggtgagcacttaggtggcttccaaatcttagctattgtaaacagtgctgcaacaaacaggagtttacgtttagacttgggtcccatccctaagatatctcatatatatgcaaatactccaaaatcccaaacacttttgaccccaagcattttggatataggatcctcaaccagtagatgccaattataaaatacattaggcatattcatattttgattcttcacaattctgtgaagtagttgctattttcccagttttatagatggcatattgatgcaaagttcttggctgacagtggcagaactgagatatttaaactctgtctgcctgcctctagagccactgctctggtgtgccagctctgtgtaagttgtaatatagaaaatatagcatcctaaatattagcaccatactttatccatttagttctctgcatgcagagggttaccttagaaagccaagtctaataaactttcactttttttttttttttgaggcagagtctcactgtgtcacctaggctggagtgcaggggcacgatcttggcccactgcaacctctgcctaccgggttcaagcgattcccttgcctcagcctcctgagtagctgggactacaggtgcctgcgaccacgcccagctaattttttttgtatttttagtagagatggggtttcactattttggccaggctagtcttgaactcctgacctcatgatccacccgccttggcctcccaaagtgctgggattacaggcgtgagccaccgtacttggccaaacttgcatatttttatacattgtcaccttttacagtgaataaaatttgtcatactttacagtaggcactgcaataatttctgaagaactatatgaataccttgataacaagtatgttttttaaaatgtatgttgttatactaacaaatatggtaagtgatttttagagtggtagaatacattttcatatttcatcttatattgtaagattaggtaagcagccatgttaaagataatgttgcatttgaaaatattatgtggcatttaaagagagacgtaagagagaaaggctggccccttgggcagggattcacacgctgacagtgtgttagtatttccactatagaacagttcttagctttgactggttcttagctttgtgaatctggaaaagcaagaattacaaagagttgattaaaacttggggaaggccgggtgcagtggctcatgcctgtaatcccagcactttgggaggccaaggcggttcgattatctgaggccagcagtttgagaccagactgaccaacatggcgaaaccccatctctagtaaaaatacaaaaattatctgggcatgaggtcagatgcggtggcttatgcctgtaatcccagtgctttaggaggccaaggagggcggatcacaaggtcaggagatcgagaccatcctggccaacacggtgaaaccccatctctactaaaaatgcaaaaaaattagccgggtgtggtggcgggcgcctggagtcccagctactcgggaggctgaggcaggagaatggcctgaacccgggaggtagaccttgcaatgagctgaaatcacgccactgcactccagcgtgggcaacagagcgagactccatctcaaaaaaaaaaaaaaaaaaagattggaagcattattgtatccatttttgcccatttaaggtattttttctccatttattgtgttaagtacttggtgagccctttcattctaaagactttaattttcctgtttcaggatattaaaaaagaatctttgataatttcctctaatttcttgcttctctttctggatctcctattattttggtgtttgatcttttggcttaattctctgaattttattatttcttctctattttctctttccgtgtcttttttgttctactttgtaggtaattatttttccattctattgaattttaaaatttcaactatcatgttttcagtgtctacaagttcctctgttccttttttatagcctcctgttcttccttaatggatgtgacatcttttatattcgaggatattaatgatttttaaaaatatctttcatctggtccctttattgtctttttttcttccatgtcccttttttctctcctttttgaaaacgtttttcatcttggagttttttgtctgttttctaatcattgtaggccttccttcatatttaagagtgaggaggacacacacagatatttgcaaactttgtgtacctgggtggagcttgatgcctgaggatgccagcaggcagcaaacattgatggaagattcccagataatggtgtgtcctctggggttgctcagtttctgcccagaagaatcctttaatctgtctgtgttgtgggagcagggtgggaggaaggggactaggggtcgcagtgttcagtttgactttcacataacttgtcatcatagtccaggtccagcatttcacccccatattcatttgggccattatgtacctcaaccctcttgagttcattttttccagagaataaatctgcttaccaaaggggctgaggagaattagttgctaggatgtgcaaggtaaggagatggatatgtctcgctgctccctggatggacttcagagcttcctttccatgttccaggataactcttaagttctaacctgttgctccttggcttattcctccccttgactttctgttttccaaacttttgttgccctctttcttctatggttgattccttttcactcagcattgtccttgggatcttttttttagtagagtttccagagggaacacagagataaaagcacatgtttaaccagaatcttccttttccttttctttctttagtctttgcatagctgctatgctagtttttatgattatttttctcaatgatatgagttattcctaggctagttatttgtagttgtgtgttgaggaggggccagagtggtgttctgagtcttccctctgagttctttcagcctctgattccctctaggcaatgaagatgggctgctgggtggcccttttcagcccttgtgttgcaggtgagcagtgactatttggggccaatggtgtgggtggtaagaagaatttaccatgacagttggaggcagagaaaggcaaatttattagagaaagtgtgaaaatatgttgcaagggtacaatgggcaggtcagcaagaaaggagctgactgcagggagacagaggcttgctggggattttataagatggtacttgtgctgtgtcctgaagagggctttgtgcagcgctgataatgccaaggttgcagtgagctcacttgcatttttctgtcaattgagggtgcggtaatagctgggcatggaaagatagtgagttacttgcgcaggagggctgtgtgtcctggaccatgaagaaaggcagacttacagcttatctgccttgtctttttgctttcttctgctcccgccagtccaactcctcttccctaatgaggactgcacacctcgctttgcttctgccttcttcaaagacagcatgcctgtttattttcccctctctctctcaccctttgctgtggttcagtctagatgcagaatgaatttctgacaccagcccgcacaccctgttttcactgtgcaaagaaaagattcttggttttgcccccacagtagttccatcatctgtgtagacaggtcttcagacattcgcttctggtgtcttcctttatcctattccatctttcctttcttgagagaactttctcatatactgaggttcagagtctagatgattctcagtattatcagcaatggagtctttttttccctttcccttgtttttaatgatatctgagaacaggacagaaaggttttattctgtcatctcttcatgcaactgtactctcatttatttatttcttctttttttgagacggggtctcactctcttgcccaggctatagtgcagcggtgtgatcttaggtcattgtagcctcaaactcttgggctcaagggatccttctgtgtcagcttcctgaatagctgtgaccacaggtgttctccttcacacctggataatttttaatttttttgtaaagacagagtctctgtgttacccaggctggtctcaaactcctgggctcaagcaatcctcccatctcagcctctcaaagtgctgaaattacaggtgtgagccaccatgactggccttgttcttcaattttaaggcttttatttttatttatttatttttgagacagtgttttacgttgtcacccaggctggagtgcagtggcacgatcttaactcactgcagcctcgacctcccatgttcaagtgatcagtcctcccacctcagccccccaaatagctgggactacaggcgcatgccacctcgcccagctaatttctgtgtattttgtagagacagggttttgccatgtagtccaagctgatctctacctcctgacctcaagcgatccactcactcagcctgccagagtgctaggattacaggtgtgagccaccacacctagcctaattttaaggctatttaaaaacatatactcagtacccctgaaattaggagcatgcggtgcccaagtccttttctttcttgatgtttgtttgtgtttttttagggatgatccaccaacacattctcagccagacagtgatgatgaagcagaagaaatacaggttggtaccaaataaaataatctgttctgtagactgttgtaatttaaatgatctctgagatggttctgacttgtagatcttatcttacatctgataaaatgagaaattacgtgagaatcttactttgacatatattttcacatatgctgtattccggaaaagatgtctcctgtttgatttataatttttagatggagcactgctttttgaagcccagtgcagtatttaaatttaatgttttatttttttcctctttttcatgcagtggtctgatgatgagaacacagccacgcttacggtaagagcacagcagactcagcgtggggacagcctcacactgtcacacaagggttagcgtcaaggtttaagtgcatacctctcttaaattcctagtcagtcaccatctcatatattattttccctgtgggctgtcgtttttattttgaaaaataacttgaagcatcatttagcaggcaaacatgatttgccctttttccctttgattgcaaaggaaatatttcgagtgcgtatttgatgccttgacttctgttaagctctgactctctgcaagaaggaattacgcctaacattaaactctgagattcctaaatctctggaacataaagtgaaaatctgtatttccttattcaagtatatttatttagttagttagttgttttgtgtatttatttttgagacagattcttgctctgtcgcccaggcaggagtgcagtggtgtgatcttggctcactgcaacctccgcctcccaggttcaagctattctcctgcctcagcctcctgagtagctgggattacagtcacctgacaccatgcccggctaatttttgtatttttagtagtgacagggtttcaccatgttagccatggtagtctcgaactcctgacctcatgtgataacacccgcctcggcctcccaaagtcctgagattacagttctgagccacagcacctggcctcaagcgtatttaaatggcataaaaattactgtttctttcaagcgagagtagagaggtatgtgacttttaccagtgttttacataaaaatgtagaagttatcaagcatattacagtgtttcaggataagagtgctgttgtgaaagttaacctaaaattttttaaatgaaggtatttttaaaggagtgagtgaagcaaatgatctatttctaaaaataggtgaatgaaactcctcataccttgagttgacgggaaagtttttagtgaaactccttacaagtaaatgtaaaggcagaaatacagaaaactagttttgtgggagggtctgttctaatccagctctagataagaagatacttgtttattttaatgaacaagatatgattgccaggatagaagaaaaaaaaagaagtggagctgctcaaaactgacatatttctttagatttaaaaagggaagcctgccagcaggtgcctaagtggaaagtttgcgtgtttcatttactccagatgccattcagatcactctccttttatgaaaattccattcagtgtcatgtaaatgttacttatctgccatactcagggcactaaactagattccgtgagatgaacaaagatgaatatgatttcatttccaccattaggggtttgtaaaccagtgggaaaggtgacacaggcagggggagatgacagtgctgtcagatcagagacagcagttacagctgagggcaccagaatgcctgacaggacaagtggtatctgacctggattttaatagtggtggggagtatcagtatcaactcatttttaaatatgtatagatgggcctggcgcggtggccgatgcctgtaattccagcactttgggaggccaaggtgggtggattacttgaggaccaacatggtgaaaccccgtctctactaaaaacacaaaaagctagccaggcatggtggtagacgcctgtaataccggctacttgggaggctgaggcaggagaattgcttgaacccaggaggtggaggttgcagtgaaccaagattgcgccactgcactccagcctgggtgacagagagagactccgtctcaaaaaataaaataaaataaaataaatatgtatagatgatagatacagcaattaataatataaaggtgtgtgtgtgtatttaccaaactctgctcactaagaagttttagaatcaatgacatgtaacatcctggtagcagtgagcacgcctgatgccttgatcttggtttctaaataccattctccactaaacaaaattgaagcttcttggagatattctggactgggattgggaaagtaaaaatgagcctgcaacaacttgtgccagaaactgtggaagtgctgaaacaatgatgtgacatgacaaaaagatgccagaagctagctttgggctctcactgtctaaaaatatgagcatcataacaaatagagtttgagtattcttaatccccaaattcaaaattgaaaatgctccaaattccaaaactttttaaaaagactgactatcactgtgttgcccaggctgcactcaaacttctgggctcaagtgatccttctgcttcagcttcctgagtagcaggtactgcaggtgtgtgccagcatgcttagctcccaaaactttacgagcactaacatgacaccacaagtggaaaattccacacctgacctcatgtgacaggtacagccacaatgcaggtgcacaacccagctcattcagcctccccaagggaaaaatgaaattaccttcaggccgtgtgcataaggtgtatatgaaacgtaaatgacttttgtgtttagatttgggtcccatccccattatgtatatgcaaatattctgaaatccaaaacacttctggtcttacccattttggataagggatactctatgtgaagtataagaataggttatgacctattgactaaaataagaattgctgatcccatagtgacatacataagtgattaaataagtggggaaaaaaggaagcttgtctttatagtactaaaggcactaactaatacatgtagtaggaatgatggaattaggaattactatttggcaaccattgtaataatatttgattgaatagatgctaaaattagtgggtgaatatacagtgagaaagaggatagttccatcttttctaagtatcttcacccaaattacttactgtttgcgcaaagaaaaatagtaatgttacaatgcaaagacctggcagccaagtgatcagtattaaccttgtcagtgatgggacagacctgtcatgtgtgcctcctgatacgatgcatgggaaggacaccacctgtcacagctgcgcagcctgagtctgcttgggaggagacatccaacagactcaacttttagaaattgtatagagtagttgccctgaacttttcaaaaacgtcaaggtcataaatggtaagaacaacagagagaggaactgccacagattgaagaagattaaagggacctgacaactagatttagtccatgattctggctagactggatgcctggaccagaaaaaaagtttcagttttttttttttctgtagaagacgttactaggacacttggcaaattttgaataagatctgtattgtgtcagtgttagttccgtgattttgatagataatttatagaaaatggtaaaatcatgactcatataaaactctttaatgcgtgttgaagatgttatttaactcatgagggaaccagacagattgttagaactggttcaaaagagaatccaaagaaaagatatatttttagatcaggaatattgaaatgagtatgtaaatgaggcaaaactggttttgcctccctgcagtatgggagaaaagacaattggacctcttccagatgagatagaaattgcctgtccgtaagaattagttcatgtcactatcacttacctagaatttgccaagttgtaaagtagctcacagacctggctaaaaacagataacctagaaggttgtgctgtatgtaaacagtacatagtcttccacttaagactgtgcataaactttttataatttaaatttgttttaggattcttatggcaggttatcctaaagttgaataattttgaggatttgaggggactgatcacatcttttaaaaggcatacatgaaaagtaatccttagatgtcaagctttatgggataggaaaattaaattgctttgtctttgaaagttgaattctttcccgttgtaaagtttgtgcaacaatgccgttcataggaaatactgccagtgcccatctcacagaagtggggtttatggctagagcggtaggggagccaagtcagccgcttcaggcaattataaggaaatgccctcacataaatcataattgctttggatggggagagatgaatggaaaataaaggactcagtgctgctgttcattttgaaaacctctctaaattactctagtctcatttcatgtatctaagctgaagtcgtctagtggaagatagatagttattaaccagtctagaggtcagatttatctgtaacagaaagaaaggcagcctaattggaccttaagctctcgtttttattccctagccttttgctcaaagctgtttcttgttttgggggatatatgaccatgttttaaaactcatttctttggtcttttctcagactcttgtcacagttttttctctcgcatagctgggttagatcttggggatccacataactatttgatgtcatcttggaatgtgtagtttagttaattcaagatgtagtctgtcttttttttttcctagggaagaagttgattactggattttttcagaacttatagttgcccgatagggggcagcaatcctctttacagggtataaatgaaaattaatgactgcgtggagaatctgttaatgtttttgtttttttatgtctcttgagggccctacttccccctctcttacttacctttttttctttcttatgtccataagctcctgtgatagtgacctaggctcaaggcaggacataatgacatcaggcttaagttcctgtttaacagcagtatttctattcacttccgggtcgaaacaaacacagaacgttttggtcactagcttatataaaatatgcattttaaaaatcatccaaacaggaaagaacgttttaccttgactaaggttcacattttgagttttgcttgttttaaaacttgtctggaaatagcagtgtttaaatacagtttgccacatcatttatttttcattctctccgtggctttggggaataccatatggctaagactcttcctgcaagtggaagggcttctagctcttcaagtagggatgttatttctgacaactagagtattgctacaggtgatattccacctgtctattttctcttgatgaatgctggttttatgtcggtgtacagagaaccattcactccttcctcacatcctcagaagcctagtgacttgtgtcatttcagctttgcaggctttgattgtctggaaaatgccatttaagcagctgattattttatttctctttttggtaaatgtactttatcactgattttatttagctgggttcagaaattctgatagtaatttgtattctaaattctgtttttaacaccctaaactataaccttgagattttgatcttgttttatatatatactgtgatgatattgacgtgcccaatgatttcttctctctctgtaggcaccagaatttcctgagtttgccactaaagtccaggaagctatcaattccctcgggggcagtgtctttcctaagcttaattggagtgccccaagggtaggaacacataagtaattctcttactgtttgaatattctttgttttgctgtttatttcatttcatatccctacagagggtctaattatattcctaattctaggaaaaatactgtggaatttattattaatttccctctactgttttactttccggattttgctatacacttgcctgggtctgtgaaatactgtatattctgccaaaaggtagtttccacgtcttgtgttgctgattgtttttgaattctgaggaaattcatactctgcccttttcaaaacttcagctgttcagtttaacagagaaatttttctttgttgaaaagtaataaaaataaaaaaagtaatagtgtcataggctatagaaatagagtggttggagaagtcaactgatcttttcttaaattgtgtcttattattttaatactgcattgacaagatttttataaaagttaaggcctgtggaaaaatccgttagttgttttaatccaatagaaaacagttttgtattagcaaagcttatttaaggaatcagagacctatttgtaatttcaaaagttatctcatgccttttttattctaaaatgaatgataatttgtacttaatctaagttttgtttttacttttattattttttcttttttgtttttacttctaaaaattaattatactctacatgtacagaatttaaaatttcaaatagatttggaagcttgccatgaaaatcagcaggtcttgacacctattttacttcaccatttcctactccccagaggtagctgttttcaaatattttagtacttttcttccatgtagtgtggataactggatagtggtttgcaactgttagttttctcaaaattctgttatatcctgtgtctgatctgtctgtgggagagttgtattttttaaatgacttaattattctgtaatttttaggcatgttccactgagctttgtgcctgctttgcatttgccttcccatcttttgttcttatgtatgagacattcaccatttaaagttgtagtggttcagaatagctcacctccttctctttcagatttgatagacgtggggtgtaactgctccagccgccaaagttcaagtgtttggctgccactccccagaaacgggaagagtggaaattgatctctcttttcttggagagtagctggtcaggctatttctttactaccttaatcttgtagccaaaatgtcgatgtttctgatacctcattttcttctcttctattatcagtaagaaaaacactgggaagtacttaggcctgggctgaaatgtgaggaccctgacatctcagtgttcataaccaagtgtctgaaatgcagtggtgacgctttttgttgttaagcataatttaacatttgacagtactgcttaaatttacttgactttcttccttaaacccttgaagtgatatgcattattgattttgttataggcctgagcattcatagcagccaacatggaatatggactaaatagcatgtgcttcattctttaggatgcgtattggatagcaatgaatagttctctgaaatgtaaaaccctcagcgacatctttctgcttttcaagagttccgatttcatcactcgtgacttcactcagccgtaagtatctcttattctctcatgtcaatagtttcagtatttgtgcaaatttctctatagatgaaattccattacttatagtactattataaatcatagctccatataacaaagctatttcatattgccaaaatgacctgttaaagcaaatctttcttttccctttatagaaaatggtgtataatgaatatctgaaaatgttaaggacttcctgcgtctctgcccattaaacatttcagtaattttttttctattataaaactgataaatatttatcatagaaaagcaaaattagggattacagctaaataaaaacaggaaatataaaagctctcatggccgggcgcggtggctcacgcctgggattcccagcactttgggaggccaagacaggtggatcacctgaggtcaggagttcaagaccagcctggccaatatagtgaatccccgtctctactaaaaatacaaaaaattagccgggcgtggtggcacgtgcctatagtctcagctactcgggaggctgaggcaggagaatggcttgaacccgggaggcggagtttgtagtgagccgagattgcgtgccactgcactgtagcctgggcgacagagcgagactccatctcaaaacaaacaaaaacaaaagcactcatgatcttgccacaattggttattatatttctagaattctatctatagataaatataatataaatacatctatctctacctatatacagatttttttaatgggatcctatagtttgtatttctttttttttctttttttttttttttttgaggcagggtctcactctgtctcccaggctggagtgcagtggcacgatctcagctcagtgcaacctctgggttcaagcgattctcttgcctcagcctcccaagtagccgggactacaggcatgcaccaccacacccggctaattttttatatttttagtagaggcagggtttcaccatattggccaggctggtctcgaactcctgaccttgtgatctgcctgccttggcctcccaacgtgttaggcttacaggtgtgagccaccacgccaagcctgtggtttatatttcttagtgggctgcttttgcacttaccagtgtgacatcattgcgtgtctaaattcattattttccattcccttagtgctgcgcctctggagagctgtaccatgacatatttgacctaccctctgttcttccagagctgcaatgaatatccttgagctaactctttgtgcactcccctaattttctccttaggataagtttctagaagtggaattgctgtatttctttccttttgccagtcactctatagctaaagaatttgacagtgcagtcagcgttgtaggtggacggaatacctgccctgctgagccgcaggtgctctctttatgcttcttttgttgtcttcaaatagcagctatttttctaggtttttcttcctgttgcatcttaaacagaccagttatctcaggtaaactcatctttaaactggtctttaaagcatatcccagaacctagaagcaggagcatgagagtgaaaatcttgcataagcatgccacttccgccctgtccagttgagtttgtcctgccagttcgttccatgtcagactcaaatcctttttttgaagtggatcgtggcatgaataacttaagttcactacgtgtcggtcgtgcatcaactctggcgtgtgagctctgcagcttggacataaggttgtagtattatattaattcaagaaagggaagttaagtaatcagtgagtgtggttgtgttacatcgtattacatgtttattgtataaggattttacttgtattggtatttctagttttatagaaaaaagtgtgtgtgtgtggtgtgtgtctgtgtgtctgtgtctgtgtgtgtgtgtttaatagagatggggtctcactatgttgcccaagctggtctcaaactcctggtctcaagtgatccttctgtgcctgagcaagtattgttttgacatttaattgtcaaccctctggttgtgttggcacaggtgttggtagcctgttttagtaaccagtagtattttcattctaggagataccctctgaaaaatagaacaaagttgtggctcttttttccattgtaaagctttttgacatctaatgctttaagaggtcttaaaatatgttacactgaaaatgctgtctacttgataattcaactgataatggttttttttttttttgacggagtctcactctgtcgcccaggctggagtgcagtggtgcaatcttggctcactgcaacctccgcctcctgggttgaagcagttcttctgcctcagcctcccaagtagctgggattacaggcgcatggctaccacgcccagctaatttttttttgtatttttagtaaagacggtgtttcaccacgttagccaggatggtctccatctcctcacctcgtgatccgcctgcctaggcctcccaaagtgctggaattacaggcgtgggccaccgcacccggccatgcccaactaatttttgtatttttagtagagaagcggattcaccttgttggtcaggctggtcttgaactcctgatctcgtgatccgcccgccttggcttcctgaagtgctgggattacaagcgtgagccactgtgcctggcccttataaggatttttatatgcctttagtgtcagttgcagtgagtgtgggaagacacttttgcctttccagaactaactataaattgcttttaattctgaggctgatgttttttttaaatcagctttgcaatttaatgatcagctgcctcctcttaagctacgtcttgctttttatcttcgtttaactgatgttccagtggatggtatgaataatagtctgttgttttgcattttgtactttttgacttttgcatggcaa

SEQ ID NO: 183 - DNA, 114711 bp, Homo sapiens
ctcaacaagccctgctattatgcaagagcaaaaatattgagaaggaaaacaaaatggtgaataaataaaagcctaaagaaaactagagaggaggaaatgtgtgtttttcccatctgcccttatggaggaaaaaaaaaaaaaaaaccctctgcaaggaaggacttaattttcaagggaaaacctataaactgctaagccactgccaagtgcctgctcccacaaacagaatcatcttcctacaataggaagtcattttcactgtgcaattttccctcttctagacttgcatgctttatgcctctcttgcaacactttatactcatagtaaaggcttttgcttccaggtcttacctttccattatgagagaaacattcttctttttaaggcctttgtggtctagatcagggttatataaaatggaggttgtgatccatttgtaggttaggaattcatttagtgggtcatagtgtttttctttaacaaaatttcatgctattcagcaaccaagttacagaatttgaaattatttctattaagaaatcttaaaaatctaagtgacctgaaccattatgccccggtgagtgtattaattctcacttaatggctgtgtgtgctctctacttgagggacaaccacccgttcaacgtcatctgaagatgtaattacagttcaggcagcctcacaaagtagagcacaggtaacatccaaatgctacagacagtaaggactagggcacctgggggtaggacagcccccgctgggctgagtcagcggggaaggtttctctgaagatgtggggtttaagcagggccctataaagcctggattggacaaaaggagaggagaaaaaaaacatggtgccagctggcctgggctgaatctaaaagaacagagggactgaagggggtattataataagttagcctggaattatatggtacaaactggtaaccctgggaaagcaaagaaggggcagaaacgaggatggaatcttggaaatgtcttggtgattgactggattttggtttggatgtgaaggtgagagaatcagaaaattccaaagttttctatcccatgtgaacaggagagtgcaactgacccttgaacaacagggtgattaggggcaccaacccaccctccacaacccacaaatggtcaaaaatctgcctataacctttgactcccaaaaacttaatagaacatactattgaccagaagccttactgataacataaagtcaattaacacatattttgtatatgtattatattctgtactcctacaataaaataagctaggtaaaaatgttattaagtaaatcttaaggaagagaaaatatatttattattcattaagtgaaagtggatcatcacaaaggtctttatcctcatcttcactttgagaaggctgaacaggaggaggagaaagaggaggggttggtcttgctgtctcaggggtggcagaggcagaagaagtggaggaggtgaaaggggagacagaagagatgtattgaaaaaaaacgtttataagtggacacgtgcagttcaaacccatgttgttctagggtcaactgcagtagtattcatagtaatgtgaaaaattcagagaagttttaaaaagaagtgttatgtaataacattaacatttgctatagaagttaaacctgttttggacacctgagttgtgctgagatatccatattagggacactaagcagtacagacagaatcccattctgtaggcactcactacctgggaggaccaaagctgatactgagccagttctttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgagccagttcttaaaatactgaaatatttccatatgagttggagaaaaactacctgtgcaacacacacacacacacacacagccctactgccacagacccttttttagatctccagacctaaagaacgatgatacttcaaaaggcctcaactccatgactagcttctgttcccactggccagtgtctatgccatattggtagtacaatactggcagactgttgacaaaaccaagtactaatggtagaagaataacttcagcttgagccagttatttgtctgaagagctgatgaaggcacacactgagatacactgatgggtggagtcctagcactcaggctgctcacagtctaacaggataccaacatataaataaataaagcaatgcgatccagagtagcagcatcgaagtagctataaagtgcaataagaggcacaaagaggatagtagtcagttacccagcccatggcagggaggcaaagcagttcctaacaagaggtgatacaagacctgagcagtgaaagatgaacaggagtttgctagggagagaaaggaggaagacaaaccattccaagctgatagacagcagcactatgtaagccacaacccaatatactgtgtacaaaataatgaaatgaaaaatgtgtaatgtctggcacacagtgtcaataataaataacaataaataataaatattagagtttttctggcagatttatttctctgattatgtttttaaaggttgatcctaaaatatatttgcattgtctaagcctacactagctaagcaagggatgggcattcaagatatcccggaaggcaggggtcagtcagtttggaatttaaaaataaagcacgtaaaaataaattcacaacatcaattagtgttgactgcacttgttagatgtgtgtaagcaaagatgagacttggtgctgctgcaggcctctcagatgcacagatgagtgtgacccaaggttgcttaatgaaatcacagaagggtggttggtaagtgtaaattcccatctcttttaaagggttgttgtttttttagaaattagactacataaaaaggcaaaccacagcctgttttagtctgcactggtcactgtcatctagagccaattgttcaagaggaaggaaacactcaacgccaaggagaagagagtcatcaccgctgctttccaaaattgttgtatgagctgctccctcaaaggaagaggccatcagtgctcaggaagaggcagagatttccgacagttttaaaggacagtgtctgcagtgtgacccacagttcaagctgcataaaaatataaattcactgacaaatgataacaagtacttccttactttcctatctgctgaatcacagccattgtttgggttgtagttcctggtttaaattagattattcaatcacaatgatgctggccaaacatgctggtcatatgccatcaggaaaacttatcaaaaatatcatttgtgctgggcacagtggttcaggcctgtaatcccagaactttgggaggctgagtaggaggatcacttgagcccaggaattcgagaccaacctgggcaacctgtagaaaccccatctctacaaaaaaatacaaaaattagccaggcataatggtcatacctgtagtcaagctcctcaggaagctgagatgggagaactgattgagcccgggatgtcgaggctgcagtgagccatgatcacaccagtgcactcccacctgggagtgagaccctgtctcaacaactacaaaaaatccagttgtgtcaagtcttaaacatataaacacacatacttttgcactaataaaatttaatctgtaccaaggcaccttttaacacccttttttccctccttctgaagaccacaaatgttctgatgtagtggaaaaagaagagaatttgcagacagacctgactttcagtgccatcttggccatttattagctacttaaccaagttcatggctttcagcttgttttctcaaatgcagaatgaaaaaaataacacctaccagaggagtcttgtaatgatttagttggataatacatatgtgcaactgcccagcagcaagggcctgcaggaagtaaaggcttgatttattactaatatattttgaaaggttttactagcacacacctcccagctcaaacaatatatgccatcagtgctcaatattgtcatgtgaaagaaaaaatatgatataaaacttcagcaatttgttctgagtggtcacttaagaaaccatgacttgcaaagtaaaattacttttttaatggcagctatcttggaacagataacagaaacagggtagtgtcttcgtgacagtaagaacctcttatacaccaaatatgatgtggcctggtatatgacatgtttttctttttcctttctgttcagttatagtcaccaatgctgtgacatgtgtaatatatatttaatatacattcctcattgtataaataactgagctatgaggaatggtacatattgcagaaatataacatgagtgctttggatattttattttttaaataacctgtgacatcactttcattgttccacatactgaagattataaacccacatctcaagggactatttatttccccttagatggcagaataatacaactacaatcatggtccaaacagccaggcttctcataaatgtggttaaggagactagcttaaattttcagtctaatatccttttaaattatacactttattaaatagaagaacgcatttttattctaaacaacatgttaaaaataagaccagtctccaggcttttaaagaaaacaaaatacttaggtatagttcatcagatttgactccctagtctaagagctggtagactttcaaaagcagaatgcaagatagggacatgcaaggacctttcactcttccaagagtgaaagatgaatacatggcagtgaccagtccatgcagcatggattagagacttttacacaaactctataacttattccaagccaaattttatactcaagttgttgggaaagcttaaaatggataatttgctcatggactgagcaccaagcttcaggagagaaagttctatagtagtgacttcactcctgcctcaccaaagatgtatcttcctttattcccttggataggacctttttgtgatagtcaatggaggtctcttaacatccttcactcaatgaatatatagagctatccaaaataactcatagagttattttagaagttttcatagtccccttctgatgctaacatagttcccattaatttaaatctcttctttctgtaacacaaagtcaaagtcagaagaaagttctgtataattgaaatctccattatatttttgctgtccaaaattacccaacctggtgttaggagaactaaaattctgcttattcttcaactttattactgtctaatatgggttaatatctctaaatcagccatgaacttcctgaatttttttaattcttaaattttttgacagggtgtcattctgtcgcccatgctggagtacagtggttcaatcatagctctctgcagccttgacctcctaggctcaagtgatcctcctgcctcagcctcccaagtagctgagaccacaggtgcacaccaccatgcctggctaatttttgtatttttttaaagacagggtcttgctttcttgctcatgctagtctcaaactcctggtctcaagtgatcctcctacctcagcctctcaaagtgctggaattacaggtgtgaaccaacatgtttggttgaactacatgaattaaatataagccatgaattgtaaaaccttctgtctatttctgaaatatgaggcaacatggtacaagggctgtgatgctgacagagccaggtttaaatcctggctctatcacttatcagctgtgcaatcatgcataaatcacttcagcctctgagccctttttcctctataaaattgtagtaactccctacagggtaaaagataaatatgcatttattcagtgccatcacaagatgaatacaaaacaaccatactctgatcaactgtgttctgtcccacaccatctcaacaccaagctatgctcttaaagtcaatgaaagctacagagaaggaatatccacaccgtgtgtatgtaaatggaaataatgacaatactgacctcacagtgttggaagcccacctccaaggtcatcatctttgaccctcccatctcagtcttactgacctcttttcagttcctccaacacagcctggtctttcctaccttaggatcttgtacatgatataccttctaccttgacagaaatctttatcatctcccttcttctagttcactcctaatcatctttctggtctctcctttaacatcattaccatctataggattccctaatactccagacttaggatcccattatagacatctcatacttccttaaagcatacatcacacctttaattacttgtgactatcttctttctcactaaactgtaagctgcatgaggcctatgtttgctctccatttatccctagctattaactcggagtatggcacaaaggaagagttcaacaaatatttttaaatgaatgtatgactgtgctgttttactgtgtaactgttaggtattatatcaactatcatagagtgatacttcattgttatctgttggagctcagaaaacaataccccaaagtattgatactatgtcaactatcatagagtgatacttactgttatcaaagtattgttccttgggagtactttgaactgaagaacactggaagagtctcagaagcaaagtctctttccctcttctgtctttctctctcctactcctctttctcccccaaggcaggtcatagaaactaggacccttcttcctgaaagccagccatgaagcctaaaaatactaaatctaaccttccccttcctttctgtataggagctggttacaaagaaattatctgacctaccttgtcccatagttgatcttaagaccgtcattccaaaaggggtctgacactacatccaggaggaaagaatgccacacagagaccaagaagaatcagaacagatagaccttgctgagtttccccattcagactattaccactaggatctttccctttttgttccatcacttttctacaggactgtccattcttcatcaaacgtaagcctaaaaatgaagagtttcccctgagttttttgggtcttcatttctgaagactcccatatcacataaaactgtgcttaaatacacttgttatgcttttctcttgttaaactgtattttattataggggcattgaccatgacccttatgatgggtgagaaaaagtatcgcacctttctgcccatacataccgtacaaccaaattgcagggctgctcagagaaagcttctaagaaaatctgcctttaacaaatctgtttctcctaacctgtgtggtcaatctgcaccatatgagcagcaggaaagacagcatcatgggcttgacagagacacagctgctgcttctctccagccgcagcaccacagggcaacctgaactaacatgtatgccatagaaagtaaggatttacaaatatacacagttaactggcttccacttgcaaatgaaaaaccgaaatcataaaaagtttactttaacactccaataataaatacaggtggtacacaattaccacagaagtagcctgtaaggagacattcctcttgtgttcattctccatcccagccctcgcccatacacaaaacaaagaaaaaacaagaaatgcagcattccctcccttaatcctttctctgtagatatgttgggagaaggaaaagcacaaacttctagccacagcttccagaccccaaaataagaaaattaaaacaggtaggtctgtctttatctgacattctatcatgctctccaaaggatgtgagacagctaggatccaagtttccttaaccttcccctcctccatatacacacaccttccttacctcagtgtgtagaaaaatgggagagaaggagggggaaagatagagattcatcagatttgtgaaaataatactctaggaaaaacaatgtcacatgtgctatggaggagtatggatgtttacaagacaggattcctgctttaaatgtagaataagagaggagtataaaagattatatataacacaaggctagaataagacatgtgccataaaagtacaaaaaaagatttgaccaatcacacactgtccaggagatttaaaaatgggctgggtgcagtggctcccacctgtaatcccaacactttgtgaggtacaggtggaaggaaagatcacttgaggccagaagttcaagaccagcctgggcaacatagcaagaccccatttcttttttttaaaaaaaatatccaggcatggtggcacaagcctttagtctcagctactcaagagcctgaggcaggaggttcacctgagcccgggagtttgaggccaagtctgcagtgggctatgatcacaacactgcactccagcctgggtgacagagcaagactctgtctcaaaaaaaaaaccaacaaaataaaaaagaggaagaagaagaaggagaaggaggagggatggaggaaggagggggaggaagagaaagaaagaagaggaagaggaagcgagaagaaggagaaggatgacagctcctggaggaggcagaggcagaagcagcagaggaagctgcagaagcagcagcagaagacgcagcagcaggagcagcagaagcagaagaaaaaaaacagctcctggaggaggcagtgttagaggtaggggttaaaaaatggaatgggattgataaaagaggtaaggcccatgggagagagagattccaggcaaagggaacaatgtggattaacacatagacaggaaaggaatgggcatatgtggtgaatagataagcaaaatggaaaggcagttagggccatagattgaaaggccttaaatgctacaggattttgttcttaataaagcaaacaataaagagtcgcagtttctgaaaagaacagtgattcaactggaggagaggtgatttatgtgacaacccatgggagctgtaccggagggggaaactgcaggaagctaggaagaccaactggtttactcttctagtagtcaggggaggcggtaataggggctgcaaaaaggggctgtaatcactcccttgcatgcaattctcactacccaggcctctctcacctttttgttctcacttggcaaaagtgcaattcaccaactccacagccatacccaagaaactgaatgtagctagagaaacatacagccacatcaaatggccttactaacttacataacagttacatcaaatggccttacaaagttagaaaagctgccctgcaatcaaaccatatgcccctagtgcatttactttccttctctgctagaggagcatttctgttctctccctttctcactctcagctgatgaccttccatcttattttgctgggaaaagggaagcgttctgagaaacagcacacaagttctcactaccataccaccttcttaccttcatctgtgcctatatgatgtgcctaacccagtttgactatggtcaaactgttcatgctcttgttttttcattagatcccatttcctcttgcctaagatatcccactaccaattctatttctttcttgttccgtcactttctcactctctcggctcatttcccttagcatacattcgattatttctcccatcttaaaaatgggaaccctctccccctccatctaccacaccatatttctgctccccttcacagcaaaattccccaaaagattaccacactcgtggtctcaattcagcttctcccattctctcttgcatccactccaatgaggctttcgcctccactcaccctctgaggaaattgctgtcaaggtcaccataacctccacattgctaaatcaagtggccaattcccagtcatttatttaggcactactggttaccttcttacggaaatgcttttttcattaagtaatcagggtatcacaccctcctggttttcctcctccaactgttccttctcagtctccttaactggttccccatttccctgacttctaaatatgcagtgttgagaagatcatctttaaaagaaaagatcatcttcactaactcctttgttgctctcttccaatctcatggttttacataccatctgtatactaacagcttcaaatttgtattacttgccccacctttcttctaaattcttgacacaataccatttctgaaaccaagttcctcttctccttccttccccaaacctactccttctgcagctttccccttcttggtaaatgacaactcctaccttctaactgctcaggccaaaaaccttggagtcatcttcaattctttatctcacaacctacatctaattcatcaactatacctctcagctacaccttcaaaaatatccagaatctgagcacttctcagcctccaccactaccacactaatccaagccaccatcgtctctaatctgaaattttgcaacaacctggtctttctgtttaccccctttcccctacatagtctattctcaacacaatagccaaagtgtttcttaagatttattaatcagagtcattcttctacccctaaagctccaaaggcttctcatctcattctgatttacggccaaattccttacaatggcccagatgtccccgcattatctggctccctgaacctcctttctgtcctcctctagtactctctccctggggcatgtccctccagacataccatcctccctacagttcctcccactgagcacacacctacctcagggtttttgcacttgaccttccctgcctagacattccctgtgcctagaatgtttttccccatgcctagaatgctctttccccagtgcctcgaatatagtaggcacctaataaaaaattaggtaaatgaatttagacagacattgaacattcattttccattttgcttttttcatttattattaacgcataaacattttatcacattgtcagaatactttaagaccataattttttgggctaacaatattccattttatagacataccacaagttatttacaatttgggactgaaaaaccaggatatttacaaatgggatattttggatgtttcttcctttgatatttgtgaacttcacttcacttttagaagtgaatctactagtgagaatatgtacctcacaggattgttgtaaagctgaatatgaactaataagtggacacagagacatcagttttgttactactgcttagattacagagacatcatgatgtcaatgaaagatcatagatcttgaaagaaacagataaaaaacatgactcacaatattgtcctttaatagcttaagacacttaacctctatgagtttcaattaaaccatctatttcaaaaagcgattatattaataataattaaaaagagatgtaaaagagtttagcataatattgagctcagagtagataatcaataaatgttcattcattcacttctcataaacaatacctagggtttttaaaattgtgaaccagaaagaaaaaaatatttttataaattatcccattacatacatattgttaaatagataataaaaattttcagtacagaattattctttttaattaacaattactcaacacttaccaaagcacacttaagattacaaaaatctatatatcaattttgtttcttttattataataaagctaggcaaaacaattatttttaattactgaatgatggtatcaataaataagttcctttttatcatgtgctttaatgtacacacacaacaggtcagtaaactattataatgatgacaagttaagcaagaaaacattttaaaaattcgcctcacttcagggctatttcttgaagcaatctgtgtgttggagtcagatgaatgccaagacattacaaaattttcagtgttttccatgttgtttcgatataagtttgagtatatgcagttggaatggtcaacaagtacaatttgaactccttcagggtatagtcatctatgcctggccaggacctagcccagtgcctgacatacaaaagacaccagatcagcactgagtaggtaggtaggtgggtgggtaagtgactgattgagtatggtagtcattagtgctgtctgtctaggcactacaaagccaatactttttgtctccctaccctgtgattgggtacagtcatttaaccagttctagccaaggaattgtgagaagaagtgacataagtaatttccattttggagcattcatatgagatcttccatgttctttttccactgctaagtgttcatgaaagcatatgctaaaaaggaaaccccgatcagccacttagtctctgagtgaaagcaggagcacagccccctgctcattcaattggaagtttatgacagtaagggtcatacattttgttaggttaagtgaccgaaattcataaattttactatagcagcaaaacctaacttatcctggataatacaagcaagctaatggcattcatttcagcactagaaattaatcagagtttaatttcagaaaaacaaaatggtacagataagtagtatagctcagtataataatttaacctctctatatgatagttctcttgctcgccgagtttgatggctcctgcctgtaatcctagcactttgggagaccaaggtaagagaattgcttgaggacaagagttcaagaccagcctgggcaacataacgagatcccatctctacaaaaagattaaaaaattagccaggcattgtggtgtacacctgtagtcccagctacccgggatgctgaggtgggaggatcacttgagcccataggttcaaggctctagtgagctatgatcacatggcttcactccagcctgagtgacagagcaagatcctgtctaaaaataaacaaacaaaaaggatagttctcttgcctacaaaatggaataatagcatctacctcatagaacagtaatagggattaattaagtgaatgtctattaagtacttaggataatatttacggtatttgaagctttcaataaatggtagtaaattactatcattaataatgcattagacacatttacactacatatgtaattttactttcatctcttactccttattcattttaatttatggtcaattttttcaattcataatatctttattaagaagtaccatatcctgtcagaaccatataaaaaaataaaaagaagtaccatccaaggcactagaaatgaagacaaataagatctaccatcaaggtattctccttacctatgattctcctttcttctgcaatagacccacaaccaagcaaactttaaaatcataaacacaatgttttattatattataatataaatcaactatgcaatattataaatattgtaccaattgaagaggtgattactttttaatttaaaaacactttatatgttatgggtctgtgtcttattcaaagtcaagatagtaaagttgtttaggtccaattcatcaaaggcaattaatgttatggcaaaaaacaaaacttgtacccacattcccactgttcctaacgcagtgccctataaacaggaggcactcagtgaacaaaattataggtaaatcagagatcagcagatccaatccatttatcttacaaattagtacaatgagatctagagggttaggcaacttgcccaaaagtatgatgtgatttagtggcagggctgatcctagaacccaaactttgaaaatgttttaaaagtctaaattctctaaagcacaaagttcctgcagtatgctgacagaggaatataaacaagtcagtgaaaaacctaaagttaatttttattgaaattagattttagcattagctagtaagaaatttaaaactcagctatcagaaagacagtgttagatttactattgttatcaagagaagaaggtacttccaaaaacctaaaagggtaaattcattaccatatttccccccaacactttatcaacacttaaaatagcatagaaagaaaaatagaaatagtttcatatgcttctttttatgtacagaatcttgtgtgaaaagaatgattttaagcaagaaaaaaggttaattcctaggccacaaatctattaaagtattgattattttaatcctattgattttaaaaaagtgaaggggttaattaaagccatgtacattaggaaactgcaagataaaaataatgtttatcatttattgtttactaactgttatgcactgtgctaaatatgcactttacacataccacctctttttacaacaaacttatggtataggtaatataattatctccattttgctgattatgaaaataggggctgcctctgagtaacttactcaggtagtggcagaaacagaacttgctctcaaacctgtttgcctctaaatggtatgctttaggttttgttgtagttgttttttgttttttgtagagacagggtctcactatgttgcccaacctggtctctagctcctgccctcaagtgatcctcctagcctctcaaaatgctaggattacaggtgtgagccaccacacccagcactaaaagctgtgcttttaaccaccctcctgttcaagctctatcaagtttctgaccctctataatttagatcaaggtcaatccatcatatctaaggggaaggctacatgatctctaaggccccttctaaaaatgattctgtgtcaccaaacacataaatcagttctgaattcacacaatatttctgacaggacactccaggcctaagggaaagtccatcaatagatgaacagataagaagaggagaaaggggaagaaaaatttaaaggaggaggagaaagatctttatcaacatgccctacaaggtgcctaacatagctagacataacattttactagacatcagggccactgtgacaaaggtgggaaaggggaacctagaacagcaattgaaagtggaactataaaggatgtacataaatttaaatagcttagcccactgatgtgatcccctcacagcaaatgaggaaggagctgcagaagtcagtgaccatgagctcaatgctgggccaacacacagacttgtaacagaaacaatgatcagcagttaaataggaatagctgggtactaagttttcagaagaggcattaccactattgtcatgcatttggatgagagtgtattttcaggacagagttgtgaaggaactagcacttgttccatcaagttgtttaaactcctaccatgttttatgcaccatccatgtggctttcatttgttacgacactgaactctgacaacaaccttggtggatgtgatgattaattttatatgccaactttataggccatggtgcccggctatttagtcaaatatcattctagatgtttttgtgaaggtattttttggatgagattaacatttatatcagcggactttaaatcagtggactttaccctccataatttgggtgggccttatctaatcagtttaaggccttaatagaacaaagtttgacttcccctcactttgggaggccaaggtgggtggatcacttgaggtcaggaattcaagaccagcctggccaacatggtaaaaccctgtctgtattttaaaaactgcaaaaattagccaggcgtggtggcgggcacctgtaatcctagctactcgggaggctaaggcaggggaatcacttgaacccaggaggcagatgttgcagtgagccgagatctcaccactgcaccccagcctgggcaacagagcgagactccaactcaaaaaaaaaaaaaaaaaaaaaaaagactgacttcccctaagcaagaagaaattctgccagcagaatgcctgggcatccaaactgcaactcttccctgggtttccagcctccaacctaccctgaagattttggacttactaagcctccacaattgcatgagccaattccttaataaaaatctctctcatagagagagaaacacacagacacacaccctaatacaatagatattgctcccaattttaccactgagaaaaatgatggcctgacaggacccattctccctcttcactacatcacacactaaaatgtgtgatttgggactcacattctagcctgaggggctcaggtgggaggtacaaggtaataagcatgcaacattgtaaccacaagccacatattccagagagccctttatgacactgataccacacatactacacatgtacccagagcctcgatgtgcccaagtgatgtactatcctctctctggtctcctaattcagttatttcaggtaaaagaaatcaaatagtcctacctaactcaatatttgaagaccttgaaaaaggaggaaaaaataattagtaaagaattaaagtaaaagataaaaagaaaaataaaaaatgatttgtgacaattaaatgatggtagcctttgctttgtttaggttctttttgaataatcatgcattcactctttcaacaactatttattttgtgctttatacttttttataggctcttctaggtattgtagagtactaacgagctggagggacacatacaatatagtaaatgtgcaggatgaaaaaagaccaactaaatttccttaaagaagtcaaagattcgcagaagaggtgagacatttctgctggaatagaattatgagtttaaatagtggggaagagggatggtattccagacagaatttctgacacagtaaaagtcacttgagtctgttaggttgctaaaagtgggagctgggatggggaattatggcagaatataaagttggaacgaccagctagggttacatagtaaggaacaatggattcccatgccaaggtgtttggcctttatcctgcaatcagagttatgaagaatttctaagcaggggagggataagaccatgggctaagccttcttagagaccactccataaaaccacatcctttatatacatagaaggacagctgggtccagcttggtcactggggcagatataaccacaggtaaatcattataaagtttaataaaaattaaaccttgaataaaaaactaagccttacagttttaataataagtttattactagaaggcatcaaagtatttcatgtgctctaacttaaaaacttaaagttgagttcacacatagtcctaactaaaaatcaatggttcagaaattggcaactagtataattataattatgcaataaatacatatgtaaaagttttcctcagaaaatgaaataaaactcaattggaatagacagaagaaaaattattattatggtaataaatacatacgtggaatctgtatcctaaaatataaattaaatataagccagtggacaaaatgtggctgagtaaagctggactttgcatatcatcaaaaatggaaaaagaaacagtgttgaattatatttctaaggagtgtagtggccaagaaaagaatctacaataaaggaacataaattaggaactaaggtactaacaactcatttgttcccttcctcttttctgctgatagttctctttttcatcaatcccaatgggattttagagatctcccaatccaatagtcctccccaccgttttactttagcagttgagttctgcaaatagttgtatataaaatcccagcatataaaacaggtaaaagctgaaagagatccaagagagggtactagagcacctaatttggcctccacttcagccttcatccactttccctctgaaacagctccccaaagagcccttaattttcctcagtaaagtgtaaaacacattggtccttgtcccaaccctcctaatttacaaatgagggaattatgccctagagaattaatttaagggagttgcctgagaaaaaagattatttcctagtacccctgctaaaattaaaatgttttctcttcctcataaacttgaactcaaatgtctgggttaaaaattgtttcttggctggggacacagtggcacacgcctgcaatcccagccctttgggaggccaagacaggggcatcgcttgagcccaggagttcaagaccagcctaggcaagatgacaaaatcccatctctatttttaaaaataaaaaaatttttaaattatttctaagttattctggaagtctatgacatccctctaccacaaattcccattccaaattcacataagggctgggctcagtggctcacacctgtaatcccaacactttgggaggctgatgcagaaggattattgagcccacaagttcaagactagcctgggcaacatagtgagccttgtctctgcacaattaacaacaacaaaatttcacataggtctataaccacatattatatgagtgcctacttgaagccagatactctgctaagagtacgttatctgctctcattcaaccatcaccacaaaccccaagagatcaaggaactaggctcacagaagtactgtaacctgcccaaggtcacagagctagcagggtggaatccggttctatctgactcctaaagccaagcttcagacccttgcactctttctaatcccaaccttttccaaatcttttcctatttttacacaggctttcagaaatgctgaactgtaaggattacttgtcatttcacagaggatgtacttttccatcaagacctgtgggggaatgcctcatgctgcagccaagcacaaaggcatcaagcccaaaaacctctaatttcacgttacagaccatagaaaggctaatccccacccccaccacaaactcctacaactccttttacaagcataggctacatacattcagtcttatggggaatagggactgtcaacaattcttaataatagggctacaaaatcagctctgagctgaccccttctgagaggctggcttttaggatggataactatccaatattttctaataggtaaagatattaaaatttgtatttagggctgccttggggcaaaggatgactatcaccgcagactaggtaccagagctggcatttaataatttgaatttgagggaaggtcaagggagttcggattggggcaccctctgggagcagagggagttgaagtgactgtcgtgtccaattacagaaaagcctgaatcaagagtatgcagccaaaactactaccaaattattggtaatgggaggagaaaatttaaacagaactgggatttgggaccaccttctggaagatgttagccaaaaaccgaacagatcctaggcatcaaggggtgtgaatttcgaggtaggctccgttgcccgggctctgagggtcagggttcccggcggttgggcctgggacggcgaagcccccgctcccccttaccttctgttggaagtagagaaccgaatagttcttggctacagccgggagggatgtggggttggttggcaagtgtaggctgccgagggcccttaaggccggccggagggctatggtggcccagggcgccagaaaagacagaagcaggagcaggagggctcggcggcccatggctcaggctggagactgcagtgcgggtgggagggcgaaaaggaggccagcagaagcgcacaggctaagccctgcccagcctgcagctccgcccgccgcaaaacagctcctcccaggggaaacccaaagccagccagctcctcagagacgccgcccaagccaggtcaccacagccactccgcccccatccccgaggacaccgcctccactccactttcctctcgtgccatctgctccttagcactcaccttcattgcggtcacaccccaagtctgcccttatcatgctagggcctcttcctaactcatcgctgtagcccatgctttatctatagcgcccccgaagcccacctgtccttcaggtcacccaatatccctaccattatcatcaccaccaaaccctgccctggccaccgcaattccattgcgacacctcctgccttccgcaaatcctacgtaacggcaataacagctaccatgacaatttattgaaggttcactacaggccagtgtatcacgaggcagggaggcacacgcatcatctcctctaactaaatcgtcacagcaatcttgtgcgtcgtatatgattgttattcccatctacagatgtggaaactgaggctcagagaggtgcgggaacttgcactagatcactcagcagtgagcggagcacgtcgtcgcagaccgctgggtccaggtccaaagactgtgctccttgcacccacctccatctggagcctaaccactccctatgatactccgttcttgggtcaccccaaaactgtgttgctcgcacaacccatccattacacaggtcgccccgggtccacatcgcccctaaatcccgccaggtcccggtcccttctttcaaataacgccccctttcttctccggcacccgaaaacccactccgcgctccacccccctcctgcctcctgccaccgcccccttcctccctccgcccgtgggtagtgctagcccctaggacagcgccgggtctggcttccaaagctccctcaaccctcttcatccagcttccattccctctttcagtcaccccgccagaccccagggcgctgcggctcactccacactttcccgggaaccctacgcccaggaggctcagcgaagctccaaaaccaattttacggactgtactactgatccacctgtcggggagaaagactctacccgcagtttgacgaaaatggtcgtttccagatgcttgtaggatttcctcgctaagctccaccctctgcggcgccttcttctgattggctctgagtaatcagagccaaagcgttacttccggcggaaaaggacgcgggagattcgattggaaggctgccggcgtgctactgagttcggccggtccgagtcactgtgcgtcgcctgggcccgttcctggtcttctcccccaggtgagctgggtaaaggggttctcgggaagccgaagagccggagactcctaaggaggctcttaacttcattatgaatgagacccacccagagcccggcgcttgttttttcacaagtggttctctgtaaacgggcagccatgagggtaacagaatataaacgtcagttattttattttagactcagtgcttttgcaatcacctaacgaacgtttattgaacacttacagtgccatcgagctagactcggagtgagcttttagaatcggaaatagagaggaaaaggcgcgactcttgcttctgtaatgtgcaaatacgtattcagtgggccactgtgcagagtagtacgtgctgaaaggggatcttccaaaatgctatgatggcttagaaggaacatattttaactgagccatgtgcttaaaccagagcttgaaagttttcttccttttcacatccagccagtccctaccagcctcttgaatatctcagatctgttcacttctctccgttttttactgacattattttggttcgaccctatgactgctacatagctgtgacagtaacccccccctcccccgccgccccagctggttctcctgctttcaatcttgctaccttccagtccagtctccacattgctgggctgataaagttcatatttgaccgaggcactccccattgaaaacctttcagtcgctcctatttgccctcaggtttaagcccaaactctttaacatgacttacagactctttcctatctgacttttgcctggctcttcagccctagtggttttccaccgctccagccatatagaatgtcttttgtgttcctgaagtgcactatcctccttctcaccccaaaccgtcttctgaccctgtccctgacctggctaattcttagtcagtttgcaaagccttttaaatcagaaaccctttcctgaccccacaggactggatcacagagcaccaagtaattatttgtttattctgcagatagttaaatgcttctttcgtctgtgccaagaattgctaggtactgagatccaatgatgaacaaggtagattcctgttctaatggaacttaccttttatggatggaattaaggagaatttacaaggaaactatgtgaattagactggtctaagaagacctttccaaggagttgatactgatgcctaaaagatgagcgtgatccaaccatgcaaaagagggaaagaaaaacattctaaacagagtgaacaggttgtgcaaacgtcctgaggcaggaaagagcttgacatgttaatgttcaagaatctaaggaaagaccagtatagctggaatatatttagaaaggacagttgtatgagatgagtctggaaagatgggcagagaccggatcatggttaggaggttaatccagcaccataaacaggagataatggtgatttggattaagatgatggcagaatatatgagggaaaagtgaatgatggtttctaagtatggaagtagattcaagtaccttctgatgagtgtgatgtgggatatgaaggaaagggaggaatgacaaatgactcctaggtatctggtttgagttactggttagtgagtagtaccatttactgagatgtgaccttctccatccctgtaataaatgtctcataaatgatatcaatggaaaaactgtatcgtactaagattttcctggttcatgtttttaaagcatttttcatcagtatttctcctttcactgaagattttgtctctttgtttttttgcttacttaattttcactctcctgcctgcctctcttacttttctagaattttcgtgtcaatgttactaaattattttttagggacttattatgactgcctttagaaaaattaaacaagtatgtgccattggaggagaccattagacagtgttaagaaaacaattcaaaacagccacccttcccatagctgaggcctcttggcctgtaaaatatgaaacagaaaattggagaattacaaggtgacaaagattttcatgcaaggcaagaagggtttggagaggaacgaagaaagggagaaaaattagtcatactttcttttctttatgccattagaagtggaactagttttttaaaggagtaatttcatcctttgggcacagtcttgaagcaaatacacatagtttctttcaagtgtgaagcttgagcaaagagagtaatggactagaaagactggtaagctactcatcagaaggcatgagttccagacctgattaacttctctgagtggatcagataatgttgcaaaagcactttgcaaactgtaaagcagtcaaatgaactcaaactggattatgaactttaagataggattcacatcttatacttttatgttctcttcagccccatccccagatgccagtttacactaaatacttaattgaactttttctctaggatctaacatagaataagaattagtttagattttctaatctaacccagtttttctagatcttctagtctagccggaagaagaaaaaaagatgtgttggtatgtgcatgtatgggcacggtttttcataaatgattaagttgccttctgagaacttgattatgaggtagttaagctgaaagatcaccaaataatggattagagtaaagaattgcaaaatcatccaaatgagactaagatgctgtcaggccttggggatttaactataaccatgtttatcacaagtgttacacaccatgagatagtctcaatgactaggctactggttttcaagtgtgggcaatttggccattacctgggaacttaaaatgcagattctcaggcccttatcccagacttactgaatcaaactctggagttggagcccagcaatctgttttatcaagccttctgggtgattttgatatatgataaagtttgagaaatacttgtctagtatgaaaatgggatgcagaggttgtaatcaatgagtttatatatctggtaccactgacaaaaccatctctagaatgaaaaatgcatcaggcattagcttgattccattaaatagttgattcaccaaacagctcttcttcaagcaactttctgtttataattttagtataatatgaggttataccaaatatacaaatatgggcttctgatatgtcccttccctgtgatggtaatttttcgtggtaaattagtagaacatctttggattacagttcagctccccatatggcttgtctaaaaggagagaaagcaagtattccagaatatcccatggtaaattagatatgtactatagtgtgtccacatggaccccacatattttaataagcataagtctattggagccttcattcctggacattgacctaggtaatccctggtatgtgccctttgaaaaatcaaaggccaactgaggccttaattagttctgccccaacacttacacttttgtccctctttctaccctcatttctacttttatgtgtgagagatttaaagaaagcaagattttctttgtatattattgctaatgtccctatccagcatttttatagtatttattgatttttttctaattataaaagcaatacacttagattgtatttattgattttttctaattataaaagcaatacacttagaaaatatcttaaatatataaagaaaataaaaatcgcccttaacactaccaccctgagaaaatactttttaaaaataagattatatactttcctaactatcctcttctctttccccattcctcccatcaaaaactaaattagtccccctgttatattttctcatggcactatgcatttccaaaatagaatttgccagaattgcagttaaattttttgtgtgattattttaatgtctgtctcttacactagactgtaagtctagtgactaggtagggaccttgtctgtttgtccatcaatcacactatccccacctagcatttagcagctgcacaactaataactgatgaataaataaatatgttcgcatattaaattgggatatggtttgctgtgatggagctgaaagaaatgtaatactatatcatcatccttcccaataaatgtgaaaagaaagataaactgcaaaagataccacatatgaaattgttcccaagtgtatcatcatatcttcctaattttagtatttacttattcctgatgtttcattcaattattcatcagacatgcatccactatactgcaagtcaagcagtagagagagacagagaaataaaacaaagtataaaaacacccccagagcctaggtaaataaataaataaatacaaaaataaactaggtggcaagtatgaaggaaatattatgaaaacaccaaaggaaattaattaacagtaactgtctgaaacgatcttattctattattgtccaacagacaataaatgggaagcctttttgccattttctggggttcaccaggtgaaatacaaatagtaaaaatactaatgatccctttcattacagttctcaaatttgctgtttttatagatttttagacttacttatttgatccactagagggcagtaaacccttaaataaagacaatgtaaccaaccttcctttaaaagtatagtaataagtgctggcacaattaatttagaaatgaacccaaaatttcctgcttatttaagtttttcatttattagtgagttgtctgcccaattagcaattttttttaggacagacagtatcttattttcacttagcccagtgtacgagtcatgttacaagtttattacatttcctaaagtttgaataacaattgtgtaaagaacatgatttgatgaatgcccatattgttgtggtacagtataaaattctgttttagagccctaaagaaaatagtctctgctcacaatatgaacagaagtaaaaaaattagaagtgaggataagatgtaagtaatgattaaaataagtatgaaataaggtactatatatgaaactaggctgtgtacttcgtatacaaatagaagataattttatgatttggtaaaattgtgttttatatttaacgctatgtgacaaaattgtggcttgggaagaggaaatgcaaatcatgaagattaatatctgaagttcagattgacaatttctgagcttggcactgaagatataaacagatagtccttctacgatcttactttgagtccaggaaaaacaagccatattgaacagataaatttaatataatgtggcatgtgatgaattaaagagtaatttaacttctgggaaaacgtcctagaaaagaagacttctaagaaggatcttaaagaataataagcattaccaagagaatgaaagcattttagagagaagaatggaaaaaagcaaaggcatagaaatgtgaaacatattgtgggggtggggaagcaaggaacacaactcagattgtttctcttggcataaattactagcacataaagagcaaaaagaaagttaagagaataggcattagggagaataaaaccaaatagacaatacactacaatagacaaaacaaatggtaggactacagaggtacaatagtatatggtgtagaaaaaaagaaaagccattccctttgttaataaagaaagactttttaggggaacttcaaatgaaataggaagaaaattctggttatcgtatggcgtctgcctactctgttgtaaaaattttcttgaattgcaaaattctgcttatagttcttcattcatgcaataaattttgttttgagactagtctttgttgcccaggctggagtgcagtggcgcaataccgcgcactgcagcctcaatctcccagactcaagtgaccttcccacctcagcctcctgagtagctggaactacaagcatgcaccaccatgcccagctaatattttttattatttgtagagatgagttcttgctgtgttgcccatgctggtctcaaactggtgggctcaagcaatcctcccaccttggcctcccaaagtgctgggattataggcctgatccaccacacctggccccattcaataaatatttattgtgaacttactgtgtactgagcactgttctaagcactggggttacagtagagaacagggtggactaggtccccgtctttatgaaacttaggctagtgatgggtagatgaacaaaaataagtaagcaaagacatacataggatgactatccagcagggttagtaccatgaaggataaaacaggtgatgccatagaaactaagaggaaggaggattctacttgagctaaagtggggctctctgaagggataacattagagttacagattgaaggacaataaagaaccgactattccaagacctaagggaagaatatcgtagccaaagagaatagtaagcacaaaagcctgagaagggaaatcgtttggtgtgcttgaggagcagaaagaaggccagcatggcttgaaatacagtgattgaggaggagagtggtacaaagtgaggtcagggattggcaagatctacatgacccagggctgcacagaccattgtgagatattgaggcttcattctaaatagcaggattttaagcaggtaagagacagcatgttcaggagtgagctttatgctcttttagctcccctaactcacaggtagatgtacctccatactaaaccctacactaaattggattttagaatgtggaggacaatgcctttgttgacataacatcatttgttatgttaactaaaagttataggaggcctttgttttggactaagctcctgcactaggccccagtggaccagactaaaaatcaaaatagagtcatttatacttaaagttccacctcaccaaatcaaaactacattgttatctgaccttcctagaactcagaagagagaaataaccaaatttcccacatgtgccagtttcaattgtcataacaacgaacttcgctctgcctttgatgcttacaacaaaaagtagccttatgttaaccagttattcctgtatttttctgttcctctgttcccactttaggaggaaagtaactttgaaatgaccaagctgctttttgttctttgtttctactttctttagcccttctctttctgtaaaactgaacttctctgctcagccccttgggtcacttactctattttatggaataaagtatttcccgattctagaattgttacaggaaagtagtcccaattcagacccccagagaggcttctttgatctcgcacaagaaagaattcagggcaagtccataaagtgagagcaagtttattagggaagtaaaggaataaaagacatagaacagccccgagggctgctggctgcccatttttatggttatttcttgatgatgtgctaaacaaggggtggattatttgtgcctcccccttttagaccatatagggtaacttcctgacgttgccatggcatttgtaaactgtcatggcgctggtggcagtgtagcagtgaggacaaccagaggtcactctcatcaccatcttagttttggtgggttttagcaggcttctttactgcaacctgttttatcagcgaggcctttataacctgtattttgtgccgacctcatatcttatcctatgacttagaatgccttaaccgtctgggaattcagcccagtatgtctcagcttcattttacccagcctctagacaagatggagttgcttttttattcaaacacatctgacagaatcataaataaagccaattaagatctttcacaaaattgttgtaattttgtcttttgacagttgcaatggcaaggaatttgaggttttagcacttacaatggcaattttctttgacccttctttctgcctttcctttgtatcctgtattacctaccctaccatgtcctttgagattgccatgtagcctaaggtgacaaccaaatctaggaatacataatcggctttggcagaaccttactaatgtatatataagagtcccaacaaggatagcaaaaaattaggattagcgttctcttttctgtgctcccttcagtaatacagattagtgatttatttaaattatttatctttcatctgtaaatttccatcttattaccttgagtggcaagattttatttttatagaaatgttattttgattgactatcagaattagtatcactttaacatctcccttccatagtcaccacatttctatgtttgtcatcatctttagagtactataccgaaaagattttattattttaaaaccagtgacctccactttgtcagtttgctgatgccagtgtcaaaaacagcatcacccatttcagaattgaaagtttttgccatgtgtttaaaaatgaaagtttcttaatacagctttatctcaaacagttacaaagacctttgttgtaaggcatgtattttatgttatatgttttatgttatgctaatccatttaaaaaattagtaaacaaaccaacctttttttttttttttttttgagacagagtttcactctgtggcccaggctggagtgcagtggcatgatctcggctcactgcaacctccgcctcccaggttcaagcaattctgcctcagtatcctgagtagctgggattacaggtgcacaccaggctaattttgtatatttttgatagagatggggtttcaccattttggtgagactgatctcaaactcttgacctcagatgatgtgcctacctcggcctcccaaagtgctgggattataggcgtgagctaccacaccctgccacagatcaagcttttaattttttctctctctctctctttttttttttttttttttttttttttgagaacaagtctcactctttcacccaggctggagtgcagtgccatgaatacagctcacttcagtctttacctcctgggctcaggtgatcctcccacctcagcctcccaagtagctgggaccacaagctcatactaccacgcctgactaattttttttgttttttggagagatgaggtctcaccgtgttgcccaggctgaatttttaaaaagaaagtataaagaggagaacattgctacaggcataccttggagatattgtgggttgtgtttctgaccactgcaataaagcaaatattgcagtaaagcaagtcacacaaattttttggtttcccagtgcatatattaataaaatgtttacactatactgtagtctaagtatgcaatagcattatgtctaaaaaatacatcttaattaaaaaacactttattattaaaaaatgttaatgatcatctgagccttcaatgagtcataattttttgtggtggagggtcttgcctcagtgttgatggttgctgactgcttggggtggtggttgctgaaggttggggttgcagtggcaatttcttaaaataagacaacattgaagtttgctgcattgattattcctttcacaaaagatttttctgtaccatgtaatgctgtttgatagcgttttactcacagtagaacttctttcagaattggagtcaatcttctcaaaccctgccactgcttatcaactaagcttatggaatattctaaattctttgttgtaatttcaacaatgttcacagcatcctcaccaggagtagattccgtatcaagaaactactctctttgtttatccataaaaagcaactcgtcataagttcatgccttatcatgagattgcagcaattgagtcacatcttcaggctccactttttaattctagatctcttgctattccaccacatctgcagtcacttcctccactgaaggcttgaacccctcaaagtcatccatgaggactggaatcagcttcttccaaactccaattagtgtggatattttgacttcctcccataaatcatgaatgttcttattagcttctagcatggtgaaaccttttcagaagattttcaacttactttgcccagatccatcagaataagcattatctatggcagctatggccttaggaaatgtgtttctgaaataataagacttgaaagtcaaagtgactcattgatccatgagtagagaatggatgtgttaacaggtatgaaaacaatatcaatctccttgtgcatctcatcagagctcttgggtgaccaggtgcgttgtcaatgagcattaatatgttgaaaggaatctttttttctgagcagtaggtctcaacagtgggcttaaaatattcagtaaatcatgccataaacagatgtgctgtcatccaggctttcttcttccatttctagagcacaagcagagtagattcagcataatccttaagggccacaggatttttggaatggcaaatgagcactggtgtcagtatcaagacaccagctgcattcacccctaacaagagagttagcctgttctttgaagccttgaagccaggcactgacttctctagctatgaaagtcctagatgtcattttcctcccatataagtctgttgtgtctacatttaaaatctgttgtttagtgtagccaccatcatcaactagttaagatctacttatcttaactagatcttttggataactttctgcagcttctacatcagcgcttgctgctttaccttgcagcaagttatgttttatgttttggaggtggcttcttttcctaaacttcaagaaccagcctctgctagcttcaagcatttttttctgcagcttcctcaactctctcagccttcatagaattgaagagcattagggtattactctggattaggcttcgatttaagggaatgttgtggctcgtttgatcttctatccagaccactaaaattttctccatatcaacaaaaaggctgttttacattcttacttatgtgttcactggagtagcacttttaatttccttcaataacatttcctttacattcacaacttggctatttagcacaagaaacctaacttttggtctgtctcggctatcaacatgctttcctcactaaccttaatttttgtttctgtcttttattttaaagtgagagatatgtgactcttcctttcacctgaacacctagaggtcattgtagggttaataactggcctaatttcaatattgttgtgtctcagaatagggagacccaacaagagggagagagatggtggggcagtcagacacacatttatagattaaattcatcttatataggtacagtttgtggcaccccaaaacaattacaatagtaacatcaaacatcactgatcacaagtcaccatcagatataataaaaatgaaaacttttgaaatattgtgagaattaccaaaatgtgagatggaaggtgagcacatgccactgaaaaagtggacttgcttgagacagggttgctataaaccttcaatttgtaaaaaaaatgtaatatctgtgaagcataataaagtgaagcataataaaatgaggtgtgtctgtattttattatttgacttctctgattttgtttatttggagatagggtcttgctctgtcacccaggctggagtgccatggcatcatcatagctcactatggccttgatcctcctgccttagcctcccaagcagctggtattacaggtacgtgccaccacactcagctaattctcttatatttttgtagagacagtgtctccctgtgtttcccaggctggtcttgaactcctgggctcaagcaatccccccacctcagtctctgaaagtgctgagattacagacataagccaccacacttggccttcctgatgtgttttatacaaggatattaaaacactttgagctatcatttgacatgtaacattttgctttttctgtttacaaaatctgaagtcttttttttctcttcaagatgtatcaaatgagcacactgaaatctaataaagtgatatttcagctaaaaaagaacaatttccaccaatttaggttctttaaaagattcatgtaagttcatgtacacattgaatataccttatctgaaatgtttgggtccagaagtcttgtgaattttggatttttgaatatttgcacataattaatgagatgcaggaatgggacccaagtctaaacataaaatttgtttatgttttatatacatcttatacacatagtctgaaggtaattttatacaatacttttttttttcttttttagatggagttttgctcttgttgcccaggctgaagtgccatggtgcaatctcggctcactgcaacctccgcatcctaggttcaagcaattctcctgccgcagcctcctgagtagctgggattacaggcaccccccaccatgctcagctactttttgtatttagtggagatggggtttcaccatgttggccaggctggtctcaaactccctacctcaggtgatccgcctgcctcggcctcccaaagtgctgggattacaggcatgagccaccacgcccggccacaatacttttaataatttagtgcatgaaacaaagtttgtgttaagtacttatgtgtggaattttgatttgtgccatcatggtggcactcaaaacatttcagattttgggttttggactttcagattcaagatgctcaaccggtagtttcctttgtattgatggcagacacaagttgtgtatcttcttgtaaaggtgtgaagaagctaaatgacatctttcctgaattactgggatagagcatttattaagaaacaggatacaagaattttcttaaactactctgttttaaatgtgattttcttcctattaatattttaaggagaaaaagaattaattttccaatacattgataccaccttcactttgaaagtgaaacaaatgacatctattagctttgcagtagaggttaagtggttttcctaagaaaagaatatgcactgcaatgaaagatttgccagtcatcccaatggctattttgttttgcagaccacggtgtgaacacatgaacagaagacgaaaatttcttctagcctcagtacttgctctccagaattcaagttttatatatccatcatgtcagaagtgcttctctaggataatcctggtctccaaaaggtaaaagtaaagtctgtaagtgtgagagaggaaatacaaatgcacactgtagatttcctatggctcaagggcaaggaccagatttaccaaacaaggacattagattctctcaggggttggttcttctgtaaatcccagaacagatttcactgctaatcctctattactagagaaaagttttaagttactgtcaagtcctttgctaaatacttgcctcattgaagaaaaataacttctcagagagtaagttccaatactgggtacaaaacttagcccatttctgggatatccctgggaataatataggagacttgtgtttattctttgtttatttttgcatgatcagtagaatagttgttaatataaataaataaattccttgagaccagggactatgttatagtaatttctatcctttagcaactagaaaggtgtttggcgtataattctttatcatggtgctcagatgcaagccaactatacctgagagcctaaggtcttcctctgatctttatagagtagaaacgagaggttaggtttgaagtttctccagaacactgtctctctgcatcgaagagaggacaagaatacctagtaagtaactagaactatgtaagaaagagtagtgtgccagcaatattcttaactagtctttttgtctagttagcattgaatggggaggcagaaaaggattggcagttctaactcatatctagactctaagtaatccttgaagtagttatcacactgttcctttattaagccactctctcaagcactcatttgttagctctaagagaaagaccctgtttgtgttattcatcattaaatccttggctagggcttagttcatagaaagtgttcaacaaatgttggttaaatgaatgaataagtgatagcatgatagtgtttagattgtcttaggttcaccccttttcaggttcttgcctgtcatctgaaacaactaaaacccatgggctatttgcctttcatcaaaatctgtacttagaagcagtgtggtatacagtccttacttaatgttgttggattcttagacaccgcaactttacgcaaaatgatgtataatgaaacaaatttttttctcatcaacgttataatgatgttgtttgagaatctgctataagtagttttgcttaaagtcacagtatccaagaacctatcactaacattaaatgaggacttactgtaatggaacaatttcaagcttcagagaacacaacagagtttcatgtaggctctggctctcattaactatgtgacctagggcaagatagttaacttctgtgagtctaattactcatttgtaaggtgggatcatggtacccacaatatgggatcattgtaaagttagagataatgcacagaaatgttctagtagaatacataacatatattaggatttccaaagtggtagctattattattataatctattataagtatactttaccttattgcagtatgttatcatgattaaaagcataattctctggagctgactgcctggattcaaattgcaaccctgccattatagctgtgtggccttgggcaagtcactttaattatctgagcctcaaaatggggaaagtaatatctgcctaataaggttcttgtaaggatcaaataggttaatatacataacatgcctagaacattgtctgatacattatcagtaatatatagatataaaatatttttaaaactctttctttccagtcatttattttaaagataatctgcaacaaaaatttaggttgaacaataatgccattgttacttatttagacgggtaataccagtagataacattagtgagtgtttgctgtacagtaggcactgtgctaggaactttgtgggcattatatcttttaatacaatagccctatgaagtgaatgctattgttaatgccaacctttaaaggagacaactgaagcttgggaaagttaagtaacttaccgcaaatcatcacacagccagctagttaggggcagaaacatattcaagcctaaacaatctgaattctgtctaccttcatagtcaccatattacttccaaattagcagcgaagtttgtattcagaatgacatcttcccctctctttcttagaacttaaagtgacctcggaaaggacttgtgactggacccttttggaatataaaacccatggcacatagtccttgcctatggaaacatagtccatggaaatataacctgttttctgcatatactacattgacacaaaaattttttaaaactatttccataatttctggtgcttacctttttttcccataggttattggggtacaggtggtatttggctacatgagtaagttcttcagtggtgctttgtgagattttgctgcacccatcacccgagcagtatacactgcaccctatttgtagtcttttatctctcaccccctcccacccttccccccaagtccccaaagtccattgtatcattcttatgcttttgcatcctcatagcttagctcccacatatcactgagaacatatggtgtttgattttccattcctgagttacttcacttagaataacagtctccagtctcatccaggagactgcaatgccattaattcattcctttttatggctgagtagtagttcatcgtgtatatataccacagtttctttatccactcattgattgatggacatttgggttggttccacgattttgcaattgtgaactgggctgctataaacatgagtgtgcaagtatcttttgcatataatgacttattttcctctgagtagatacccagcagtgggattgctggatcaaatagtagttctacttttagttctttaaggaatctccacactgttttccatagtggctgtactagttcacatttctaccagcaatgtagaagtgttctctgattgctgcatccacaccaacatctactggtttttgattttttgattatggccattcttgcaggaagaaggtagtatcgcattgtgattttgatttgtatttccctggtcattagtgatgttgagcattttttcatgtgttttcttggccatttgagaattgtctatttatgtccttagcctactgtttgatgggattgcttgtttttttcttactgatttgtttgagttcgttgtagattctggatgttagtcctttgtcagatgtatagattgtgaagattttcttccactctgtgggttgtctgttcactctgctgactgttctttggccatgcaaaagctctttagtttaattaagtcccagctatttgtttttattgcatttgcttttgggtacgccaatgtctagaagggtttttccaatgttatcttctagaatttttatagtttcaggtcttagatttaagtccttaatccatcttgagttgcttttatataagattcattctcctacatgtggctagccaatgatcccagcaccatttgttgaaaagggtgtcctttccccactattgttcactttgtcaaagatcagttggctgtaagtatttgagtttatttctgggttctctattctgttccattggcctatgtgcctatttttataccagtaccatggtgttttggtgacgatggccttatagtacagtttgaaatcaggtaatgcgatgcctccaggtttgttctttttgcttagtcttgctttggctgtgcaggccatgttttggttccatatgcattttaaaattgttttttctaattctgtgaagaatgatggtggtagggattgcactgaatttgtagattgcttttggcagcatggtcattttcacaatattgattctacctatccacgagcatgggatgtgtttccattcattgtgttgtctatgatttctttcagcaatgttttgtagtttttcttgtagaggtcttttgcctccttggttaggtatcttcctaaatttgttttttttgtgtggtttttttttgtgtgtgtgtttttgtagctgttgtaaaaggagttaaattcttgatttgactctccacttggttgctgttagtgtatagaagagctactgatttgtgtacattaatcttgtatccagaaacttggctgaattcttttatcagttctagcagctttctggaggagtctttagggttttcgaggtaaacaatcatattgtcagcaaacagtgacagtttgacttcctctttactgatttagatgccctttctttctttctcttgtctgattgcattgtctaggacttccagtagtatgttgaagaagaatggtgagagtgggcatccttgtcttgttccaattctcagagggaatgctttcaacttttctccattcattgttatgttggctgtgggtttgtcatagatggcttttattacattgaggtatgtcccttgtatgccactttcgctgagagttttaatcataaatggatgctggattttgttgaatgttttttctgcatccattgagatgatcatgtgatttttggttttaaaattctgtttatgtggtatatcacacttattgacttatgtatgttaaactgtccctacatccctggtatgaaacccacttaatcatggtggattatctttttgatatgttgttggattcagttagctagtattttgttaaggattttagcatctatgttcatcaaggatatcgggcagtagttttcttttttgcttatgtcctttcctgatttgggtattagggtgatgtcgccttcatagaatgaattagggagggttccctctttatctcatagaatagcgtcagaaggattggtaccaattcttctttgaatgtctggtagaattctgctgtgaatccatctggtcccagactttttttcgttggttttttttgagacggagtctcactctgtcgcccaggctggagtgcagtggcgtgatctcagcgcactgcaagctctacctctcttcacgccattctgcctcagcctcctgagtagctgggactactggtgcccaccaccatgcccagctaatcttttgtatttttagtagacagggtttcacggtgttagccaggatggtctcgatctcctaacctcatgatccgcccacctcagcctcccaaagcgctgggattacaggcgtgaggcaccacgcccggccttttgttggtaattttttaattcccatttcaatcttgctgcttattattggtctgttcagggtatctaattcttcctgatttaagctaggagggttgtatttttccaggaatttatccatctcttctaggttttctagcttgtgtaaaggtgtttgtagtagtcttgaatgatcttttgtgtctcagtggtgtcagttgtaatatgtcccgttttgtttcttaatgaggttatttggattttctctcttcttggttaatcttgctaacggtctatcaattttatttatcttttcaaagagccagcttttggtttcatgtatcttttgtatttgtttttgtttcaattacatttagttctgctttgatcttggttatttcctttcttctgctgggtttcggtttggtttgttcttgtttctctagttccttgaggtgtgaccttagaatgtcagtttgtgttctttcagtctttttgatgtaggcatttaggactatgacctttccttttagcactgcctttgctgcagcccagaggttttgataggttgtgtcattattgccattcagtttgaagaatttttaaatttccatcttgatttcatttttgatccaaggatcattcaggagcagcttatttaatttccatgtattggcatggttttgaaggttccttttggagttgatttccagtttattccactatggcctgagagagtgcttgatatgatttcaattttcttaaatttattaaggcttgttttctggcttatcacatggtctatcttggagaaagttccatgtgctgttgaatagaatgtgtaatctgcggttgttggatgaaatgctctgtatattatctgttaagttcatttgttccaaggcatagtttaaatccattttttctttgttgactttctgtcttgatgacctgtctagtgctgtcagtgtagtattgaagtcctccactattattgtgttgctgtctatctcatttcttaggtctattagtaattgttttataaatttgggagctccagtgttaggtgcataaatgtttaggattgtgatatttctcgttggacaaggccttttatcattatataatgtcctttgtctcttttaactgcttttgctttaaagtttgtttttgtctaatataaaaatagctacccctgcttggtgtccatttgcacaaactgcctttttccactcctttacttgatgtttatgtgagtccttatgtgttaggtgagtctcctgaaggcagcagatggttggtgagttcttatccattctgctattctgtatcttttaagtggaacatttatgccatttacattcgatgttagtattgagatttgaggtaccattgcattcattgtggtatttgttgcctgtgtaccttgttttttttgtttttgctttttaaattgtttttgttttataggtccttcatgatttatgcttttaagagattctgtttttgatgtgtttccaggatttgtttcaagatttagagctccttttcacagtttttttctttctttcttttttttttttttttttttttttgagacggagtttcgctttttcgcccaggctggagtgaagtggtgcaatctcgtctcactgcaccctccgcccccccaggttcaagcaattctcctgcctcagcctcccgagtagctgggattacaggcacccaccaccacgtccagctaatttttgtatttttagtagagacagggtttcaccatgttggccaggctagtctcaaactcctgacctcaggtgatccacccgcctcagcctcccaaagggctaggattacaggcatgagccactgcgcccagcctagcagttcttgtaatggtggtttggtagtagcagattctctcagcatttgtttgtctgagaaagactgtatctttccttcatatatgatgtttagtttcactgggtacaaaattcttggctgataattgctttgcatgaggaggcttaagatagggccctaatcccttctagcttgtagggtttctgcaaagaaatctgctgttaatcggataggttttcctttatagattacctggtgcttctgtctcacaactcttaagattctttcctttgtcttaactttagataacctgatgacagtgtgcctaggtgatgatctttttgtgatgaatttcccagatgctctttatgcttcttgtatttagatgcctaggtctctagcaaggccggggaaggtttcctcaattattcacccaaatatgttttccaaacttttagatttctcttattcctcaggaacaccgattattcttaggtttggctgtttaacataatcccagactttttggatgcttggttcataatttcttattcttttttctttgtgtttgttggattgggttaatttgaagaccttgtcttcaagctgtgaatttctttcttctatttgttcatttctattgctgggactttccagagcattttgcatttttgtaagtgtgtccagtgtttcctgaagttttgattgtttttctttatgctatttccttgaatgtttctcccttcacttctcgtattgttttttggatttccttgcgtcaggcttcgcttttctctggtgcctcgctgaattctttttcaggtaaatcagggatttcttattggtttgaatccattgctggtgagctagtgtgattttttttggaggtgttaaagagccttgttttgtcatattaccagagttggttttctggttccttcttatttgggtaggctctgtcagagaggcaaggtctagggctgaaggctgttgttcagattcttttgtcccacaggatgttcccttgatgtgatactctccccccttttcctatggatgtagcttcctatgagccgagctgcagtgattgttatctctcttctgggtctagccatccagccagtctgtctggctccggggtggtattcagggtttgtctgcacagagtcctgtgatgtgaatcgtttatgggtgtctcggccctgaataccacacagtatttggggtgtctcccaggtcctgcaggagcagtccacttccttcagagggtctgtgggtcctcttgggattcctggtttgttcttgcagttgttctggagctaaaattcatagtgcgagccccaacatgctgctttgtccgagttggagctgcaatctaatcctgcctcccatccgccatgatgatctaaatcctggtgcttatcttttctactgttgtttttgctttccctttttcttacttggaatcagttgtaagccaacacaggaaacagaaattcctcatgttcatttccccattgctatagcactgcaagcttatgacagaggagttccatgctcttgcctttgcagaagatcttagagatgctgaagaacagagagacgtccctaaatattttctttgaacctgaaatttttagtgactataatcataataagtattttgtgctttatggaattaactttcttacctccaagatcagatcagtagattgaatgtagttttcaatctataggtattctgcagagccttggggctccatggaagtgcttatggagggagatgggattagagtagtaatagtacctagtgctgagtagtaggtaagactctagggcccccacgttagtttcaacaagatctctattctcatccttatattagtgttccaagttaaatttcatttgaaagggggtttcattatgtaaatatacaaacatagacatacatctataaaaaaaaatgtgtacaaagttagttcggtccttcatatgaagcagtaactacacatacacacacaatagtgtatgtctgtactctccccagattataagctggagaagggatttatttatccagacaagctatctacatagaaattgcccttctgggtgactaatgggacccataattccttttagcctagaaatccatttctaacactaataactttcttttcctatcttaaaataggactcatcgctcagaggctacctatcctctcccccattcccaactacccaaaaagtttatatcatttacttaagcaagtcaaatttaatttcacacatatagatcatagttttcttactttgtgggggaagtgatatgtggaagcattaagagatatgttttttaaaatatgtctcattactttgtgtgtatttaatctgggtctataaacttggaaagggatgttatataatcatatagtcaggatattcttaagctggaatctgtggatacattataggtatgtatgactcctccagtccctaagatatgtagaatatcgtgttcatatctgttttttgtggggagagagtgagtccattgctttcatcagattttttaaggttttcaagactaagaaaacattaaggattacttatctcaccagttcttctacatctgggctaaatataagtacgctagaaaaataaacaaatgaggctgggcatagtagctcatgcctgcaatcccagcatttgggaggccaagatgggaggattgcttgagtccaggattttgagaccagcctgggcaacatggtgaaacctatcctctaccaaaaataaacaaaattaggcaggcatcgtggcatgtgcctgtagtcccagctgctcaggagtctgaggtgggaggatcgcttgagcctgagcggtcaaggcttcagtgagccaagatcataccgttgcactccagcctgggcaacaaagcaagaccttgtctcaaaaaaataaatgaataaaaataaaaaaaaaacaaatgaaacttggtatttttttaactgggatcaaacaaaaaagatagcaaattacagctattatttcagatagatcctttcagaggctccttgaactcaaatctattttcataattctaaggcattatttgccttttcactttcagtctctcatgagtgcataatggagtttcccagaggctacataacacgtactatcacaacagattgagcagagaagcagatatgagaatccagctgtctttttatgaaaccagacattaaagagatttgcaaaatgtaaaacaatgctggtctcttcttactaatttttaaaatttgaaaaacataactatttttcataaaagtatgttttttgtgttaaccatgtaaagggtctgtttttaatgaattaatatttttttgatttctcagttttaatttctcactttcatttaatttctcgttttatgagaaatgtagatagaagccaggtgtgatggctcacgcctgtaatcccaacactctgggaggccgaaacaagagaatcacttaagcctaagagttcaagcctagtcagggcaacacagtgagacccccatctctacaaaaaaatttaaaattagccacatatggtggcatgtgcctgtggtcccagctactcagaaggctgaggcaggaggatctcttgagcccaggagtttgaagttacagtaagctatgatagcaccactgtcctccagcctgggcagcagaatgagaccctgtctgaaaacaaaccaaaaaagaaatatagacagatataagataaacaagttctatggatctaatgtacagcttgagtggtaatggatgatgtgttaaataattcgactatggtagccaggtgcggtggctcacacctgtaatcccagcactttgggaggccgaggtgggcggatcatgaggtcaggagatcgagaccatcctggctaacacggtgaaaccctgcctctactaaaaatacaaaaaattagctgggtgtggtggcgggcacctgtagtcccagctaatcgggaggctgaggcaggagaatcgcctgaacccaagaggtggaggttgcagtgagccaagattgcaccactgcactccagcctggccaatagcgagacactgtctcaaaaaaaaaaaaaaattttgactatggtaatcattatacagtgtagacgtatttcaaatcaccatgttgtataccttgaatatattcaatctttggcaagtaatttttttttttttttttgagacagggtctggctctgtcacctccagactggagttcaatggcacaatctcagctcaccacaacctctgccgcctgagctcaagcaatcctcccatctcagcttcctaagtagctgggactacaggcgcatgccaccacgttcgttaatttttgtattttttgtagagacacagttttgccatgtttcccaggctggactcgaactcctgagcttgagtggtctgcccgccacagcctcccaaagtgctgggattacaggtgtgagccatcacgcctggcccaagtaaatatttttgaataaaaaaaatagatactattcacataaacaaaactctttgatattctcaataattttttaagagtattaaaggagtgtgaaaccaaaaagtttgaaaactgctattctgtaacaaatgacattttagaaatatgggtgcctctagaagttaaatcgggacggtgatgtgaatatgttgtctatatccttgtttctcaaagtatggcctaaggtacatctgcatcagtattacctgggagcttattaaaaatgcaggatcttgggcctcatcccagacttcctgaatcagaatcttcattttaacaagatctctggatgatttgtatacatattaatgtttgagaagctctaatctgtattacaccacactaacatttattttaatccagcatcgttcctaaaaggattaaagaaaactatataaataaatatcttcattatacatatgtactttataaaaatatatatagtttaatatgtaaatgcatgaacactaatagacatagttttttgaggctattattgatactgtcattgcaagcagttctttattttaaccatttggtcccactgttatcatatcataatatcagaacttcatgatacgagttcacagtcttgggtttgggtcatatatttaccaactttgtcatctcagataaaaattcaaactaatttccccatttgtaaattttacctataaaaatgaaataatgtatgttgaaaacatttgtaaactgaatgctaatgcatattagtctaagttttgctaggaattttacattaaacctgtatgcattattgcatagcctttaaagaaattccaatatatattttaaacagttcatttccctagagtttggtactaatggagttttatcccctagtgagtcaattacctttaattcattctatggctaacctacagcacaaactctagcagatttgtataggattatatgaatgggttggtatagatctatcctcagtatggcagaagaataacagcacagatctaataaaggtgagtcactttcagagctacagattttagactccccctagtggccatctggcaacaatcaaatttatacaaccatctttcaccttgctttctgtttgccttttgccactcttttttaagatctttagcaatctgaagaaaaaacaaaattctagtattagccattaccataaaatgtttttaggtgcttgttgtatttcaaaaaaattttttaaactattctgtctgttaaataaagttaacctaactgaggggtggacattaagaacctgaaagatagaaatcagagttataatacattgcaaactagaagagaagttaacagtacaagtgacagtaattatcacaatacttgatataattatgagggagaagcagactaacactaatttcacagtatttgcactagaccctttatttgtctattttaatccttcttcagccctggacttcatagatgaggaactcaagaatttagtaactgtcagacaatgagtacatggcaatagagttacactgccatgtagatgtgtactttttgactagaaagcctttagccaccattacatactgtcttaaaaaaacaagttaaattgcatggttttcatatcaaattttataatctgataagttatcaacatagtctaatgaattaaagaaagtaattttcattatggtgagaaaaatgcaattaagtgctttgtgtataaataggtattaaatattttgagattattttttgtcctctttttttttttttttttttttttttttttttttttttttgagacggaatgtcactctgccccccaggctgtagtgcagtggtgcgatcttggctgactgcaagatccacctcccgggttcacatcattctgctgcctcagcctcccaagtagctgggattacaggtgcccatcaccacacccatctaatttttatgtatttttagtagagacagggttttaccgtgttagctaggatggtctcaatctcctgacctggtgacccacccgcctcggcctcccaaagtgctgggattacaggtgtgaaccaccgcgcccggccttttcgtcctctctttcatgcacagttctcctttagttttccatcaatttggtatgtatttctatcaacttggggctgtttaatttaaatcagtaacgctaactattctgactagagaaatttaaaataagttgatctgaaagagtttaagaagaatttgagttgtgtaggagcatttatacacaaaatgttattttaaatttttactgttctggatttttcatcatatgaaaaacatttaatgaacatctccacacttttttccaccacttttctaggtctaattgtccaaaatgtggctctactggtgaatctggaaatgccaattacagatacaaactttccttaaaagttgcagaatcaaacaaattgtttgttattactgtatttggaagttgcttagatacattttttggtcttactgccactggtttgcacaggtaagaatacttaaaacatcctttttcctgactgcccttagaatttgaagatacaagtttataaggcaatatgcatttttgtagaaagataatcattcaaccccagattgtcaattcctttaaaagacaagcaagtaagaaagatgtttatttcctgaatacatattatgatgatattaaaacagtctccttttatttagggtaattaatctgtaattagaatattaagttataaatctctaatccaagttacagaaatagaggctaagaaagtaacatcatttcaaattgaagaattatccaaattgaggttagcattgaaacagttaggttcccctgaggcagaagaatctatttgagggaatatttgcatttcagaaattgaaattttattttttatctgtattgcaatttaatttgcatagtttgaccttttacgacattgtcctgagaatataagaataagcaattaaagcttttcttggccgggcgcggtagctcacgcctgtaatcccagcgctttgggaggccgaggcgggcggatcacaaggtcaggagatggagaccatcctggctaacacggtgaaaccccatctctactaaaaatacaaaaaattagctgggcatggtggtgggcgcctgtagtcccagctacgccgggaggctgaggcaggagaatggcatgaacccaggaggcagagcttgtagtgagccaagattgcaccactgcactccagcctgggagacagagcgagactctgtctcaaaaaaaaaaaaaaaagcttttcttccccctcagtcttctgccctcctcccctaatcacatgcaagaaatctatgtccacatttttgtgcttgagacaataaagggaccacaaccaggcttatcagagaaaagggatgactttttcctgctttcaagtgaagagctagagatgccaccactattcccactgccacttttatttttccttataatcattgccgggcctgatggttaggcaggtaactactttactcccacttgatcaattggttttgttgatttttctgtgctatgagaaactagagagaacaaactgcctggctcttaaagtcactttttttcctctataaaaggttcatgctgcattttcaaattaattgtgtctctgactttatggcaagtaaaatttcaaagttcattgcttcacattttttactttttttccaatcaaggtacattcaggatcctaataaaattccagaaacactggacaatgatacaactcagaatctattaactaaagcagttgaaacttgctttgttggacaaagctttatttttggagtgacggtaattgagactagctttctttttaataatctgttaacatttccattgtaatgaattatgtgaattttctaaatagttgttaggagttctgtacatgtgaaggcctgtagaaacactttaaactatgtaaaaatagcctataggtggtctgttaaaacaccatgtgtgacaacttcctctttcgaaagtcaggggagcctacttcaaatgctttcagagcttaaaaatataaatttattatatatttagaaatgttagatatttgtttttggtatttagtatttattttgccctccggattttgttcaaattctatagtaaaacttccaccaattctctagctttttaattctgtcttctataaaagagaataatggaacactgaaggcaaagtatcttgagtattgataagaatactaaaactagattaagaaagatggtcttaaatataaaagtgactgtagaagaagttaaaaaaaaaagaagttactcctttgactttgaaggagtaatagttttctgtctcatctatgctaaagggaacaaagagacatttttttccacactggaatcagggttttaaaagaggactccacaacagaagagtgagaaaaatccaaagggaaggtagaatcaacggctacagagctttacttgttaaaatcgtagacagtccttttctctcctctcttctttttcctcctcccctttttcccctcccctcccctcctctctttccttagctaaagagaactatgatagttgccatttattgagccactgctattttctaagcactgtgcagttttccattttattactaaacagtaatcctgcatttttatttttatttttattttataaaggagaagactcaggttaaataaattgtccaaagtctcaacactattaataaatgcgggaactaggatttcttcaaatcagtttaaacaagctctttactctaaggtttatattctcttacatatgctactttgcctataaaactaacagaatcgaaattggaattgggggatggaggtaatagttgtatctgttttaaccttttaaatctgtttattttattttatttttgagacagaatctcactctgtcacccaggctggactgcagtaccaagatcatggctcactgcagccttgacctccctaggctctggtgatctcccaccccagcctcctgagtagctgagactacaggcacacgccaccatgcccagctaatttttgtgggggtattttttttagaggagaggttttaccatgttgcccagtctggtctcaaactcttgaggctcaagtgatctgcctgcctcggcctctcaaagtgctgggattacaggcatgagccactgtgcctggctaaatttctgtttcatgtttaagtaaatggaagacaattttattcttacttaaatttctttgcttctttcacagaattttgaaaaccaacctggacaaggttcagatgccagtaacttcttacagcaatgctctgaccacaaaagaaaagccaaagcactagtggcttgccagattgttctaccagacccaggtattgcaggctttactgtcattgactacttccatcaacttttgcagacttttaatttcaggaaacttcagtgtgactctcaggcacctaacaatcacttacttgctttagatcactcaaatagtgatctcagcagcatatatacttctgacagcacttctgattttttcaagtcctgcagcaaggatactttttcaaaattctggcagccatcacttgaattcacttgcattgtttcacaactaacagataatgatgatttttcagcttcagaacaaagtaaggcctttggtactcttcagcagaacagaaagtccatctccattgcagaggccactggttccagtagctgccatgatcccattcaggattcatggagccttgtttcatatatggataaaaagagtacagcagaaaagttgggtaaagaacttggcttacaagctaaggagctgagtgcagttcacagcagtcatcatgaaattggagttaatgactctaatttattctctttggaaatgcgagagccccttgagtcaagtaatacaaaatccttccacagtgcagtggaaattaaaaataggtcccagcatgagctaccatgttttcagcatcatggtatagataccccaactagccttcagaagagatctgcatgttgtccaccttcgttactcagacttgaagagacagccagcagttcccaggatggtgaccctcaaatttgggatgatctgccattctctgaaagcctgaacaagtttctggcagttcttgaaagtgagattgctgtaacccaggcagatgtcagtagtaggaaacatcatgtagataatgacattgataaatttcatgcagaccacagcaggttatctgtgactccccagagaactactggagccctgcatacaccacctatagctttaagatcatcacaagtaatagtcaaagcaaactgtagcaaagatgacttccttttcaactgtaaaggaaatctaagtcctagtgttgaaaaggagtcacaaccagataacaaagtagaggctgtctctgtaaatcataatggaagagatatgtcagaatattttttaccgaatccttacctgtcagctctgtcttcatcttcaaaagatttagaaacaatagttactcttaagaagactatcagaatctcaccacacagggagagtgaccattctagtctaaataacaaatatttgaatggatgtggagaaatatcagtttcagaaatgaatgaaaagttgacaactctgtgttataggaagtataatgatgtctctgatctttgcaaattagaaaataaacaatattgtaggtggtccaagaaccaagatgacagttttacaatttgcaggaaacttacatatcctttagaaactctttgcaatagtccaaatagaagtacaaatacattgaaagaaatgccttggggacatatcaataacaacgtaacacagagctattctattggttatgaaggtagctatgatgcctctgctgatctctttgatgatattgctaaagaaatggacattgcaactgagattaccaaaaaatcacaggatattttgttaaaatggggaacatctttggcagaaagtcacccttcagagtctgatttttcactgagatcactttctgaagacttcatccagccttcacaaaaattatccttgcaaagcctatctgactctaggcattcaagaacatgctctccaacacctcattttcaatcagattcagaatataattttgaaaatagtcaagactttgttccatgttcacagtcaactccaatttcagggttccaccaaacaagaattcatgggataaacagagctttcaaaaaacctgtattttattcagatcttgatggtaactatgaaaaaataaggattttccctgaaaatgacaaacagcaagccagcccaagctgtccaaaaaatataaaaacacctagccagaaaatcagaagccctattgtatctggtgtttcacaaccagacgttttcaatcactacccttttgctgagtgccatgaaactgatagtgatgaatgggtccctcctaccacacaaaaaatatttccttcagatatgcttggattccaaggcataggtctagggaaatgccttgctgcctatcatttccctgatcaacaagagttaccaagaaagaaactgaaacatattagacaaggaaccaataaaggtttaattaagaagaaattaaagaatatgcttgcagcagttgttacgaaaaagaaaactcataaatataactgtaaaagttcaggctggatttccaaatgtccagacattcaagtcttagcagcacctcagctgcaccctattcttggacctgattcttgttcagaagtcaaatgttgccttccattttcagaaaaaggcccaccttcagtgtgtgaaactcgaagtgcttggtcacctgaattgttttcataaaaagtcacctgaacccaattcctgaacttttaaatctgtttggaaatgtttgccttcaggggtacggaaagcattctttacattttgaacacttggagagaagcaaattgaaaacaggactctgctgggagctactgtgccttttaaaatataaagccattgttttccccagggttttatctagaatactatgattaggtagttgagcactttatcttatactgtttattgtactttaataatattgttaagattgtttttgaaagtattaatgtttgttaaaatcacatatacatccagaaataaagactttgcaaaccaaaacttagtcttttttaattgttcagctcagaccagaaaatgccagctatattataggccaatgagtgtgctgagtttgggatagaaagctacaagatcactgatcttaaaatatgttagtctgctggataagacagataaacaggtaacttcaatacagtgcagaagatgcaatgatatgggtttgtaatgggcatgacaaacatttacgttgctatgagagcatggaagaaaagcagctaactcatcagtgagctgagggtaagaagaaacgttttaagaaaaaaagctatttagaagttgtatgtgaaactgttgctattttatttaatacgtatacactgaatgcctactctacatgccaagggccgtgcttagtgctggaaactgaagataaaaatcaagctccttccctcaaactcatgagctattggaataatcaggtaattagaatctggtaggttctatgataggaggtaagcttggggtgctaacaggaacaaaaatgaaaagcaattttcagacactcaagtcttagcagcagctctgctgcaccctgtgaaatctttcacatatacctggccaggttcctttgccattccccacagcaaccattccaaaacaatactttcttcatgccacaaagcaactgctactctccttgcctcctacttcatggacaatattgagatcacttgatattttctcaacttctcgcacccatacctacccacatgtctatctgtactcacccacagctgctttcctctagtctcagaaaataccatctaagtgctaatctttccatttagactattgatctattacacccatctttgaggtcttataccaaatattccccctatattttcaccttcttgccctactgtgtctctccctctccacaattttttattttgaaaatttgcaaacagaaaagttgaaagcggccggacgcagtggctcatgcctgtaatcccaacactttgggaggccgaggtgggcaaatcacctaaggtcagtagttcgagatcagcctggccaacacggtgaaaccctgtctctactaaaaatacaaaaattagccaggcatggtgatgcatgcctgtaatcccagctactcaggaggctgagacacgagaatcacttgaacctgggaggcggaggttgcagtgagtcaagatcttgccactgcactccagcctgggcaacagagtgaggctctgtctcaaaaaaaaaaagttgaaagaatagcacaatgatacggaatgatacggtatctgtacataccatttagattcaatcattttaaacattttgcctttgtgtgtgtgtgtttggtttctgtgtgtctaaatagatacagttttgctttgctaaaccatttaaaggtaagctgcagacaggacatttcacccctaaattcttcagtgcaaattttcttaaaggcttctctctacatagccacagtatcattatcacaccaaggaaagataacagtaatccccaatatctaatattcagcccataatcaaatttttctacttgtccccaaattataattgttatttaaccagaatttcatcaaggttcatccatagtgtttgcttgtctctttttctagaacctcacctcttatttcacataatagtaactttatggaaaaaaaacctcaaaccactgttctgtagaatgtcccacattctcgactggtatgtttgcttccttatactatcagtacattgtttctctaccccaccccagtccccacatttcctgaaaattaggcctaaagactagatgtgattcaggttttggcagggatattccatggctcatgttgtgtactttatgttgtaacacatgaggagacacaatatcaagttgttccactattagtaatgctaagttagattgcttggttaaaatgttgcccaccggatctcgatgttaaatatactttatttttcctttttaagagtaaagagtcagtggtggtaaattagtttgcttttccttctatcactacagactcaagaatttttatttttcctatggaaagaaaaacaagccacgtctggtagcttatgcctgtaatcccagcactttgggaggccgaggcaggaggcttgcttgagtctaggaattcaagaccagcctgggcaacatggcaaaacctcatctctacaaaaaattagccaggtgtggtggcacacgcctgtagtcccagctacttgggaggctaaggtgcacccaagaggtgcagcttgcagtgaactgagattgcgccactgcattccagcctgggcgaccctgtctcaaaaaaactggtgcatatttattgtccaatcatttcatacaaagattcttaattctttctagactgtttcctagtctttgggactaggaaatagtctgtgttctttttgtcagatgttctattcctggctaatttcatacctccctctgtgataaaagagtaacgatgctgttagtatttacaatgtcatgacttcagaaactgtttttgttgagctatatagatcttgccttagcagttacctaatgtcatttgtttaatgctagttcctctgtgatgcagcatccgttgtgctactgtgaatactggtttccaatgatctctcaaaggttgttactatactttgctggtgactaccgaaaagcaagtcctacccagagtgtgcaggaaaataaataataatccattttttggtcctatttaccatttgtactaaatattgcttcccaaccatgcagtcttttgaacattttaggctgcaattactgcactcctatactgtgatctctttcaatgttggctgcaccctggaaggataggcaagagcctatccttgctctgtggttggagcaacaagagcggttccatttgtgcaaagaatatctattcctccatcagcatggcttaacgcctaatctggaaatcacagtgtcactatcaactggaaatgagaggacattgattggaagtgcccactggcattgtggaccaacagtcttaaaaggcctcagagaagataggcatggcctgcagaagggggaagggtgaccttcctggtgtcagtggctggaggcagacagggtaaataacagctgccactaccctcacagaccagggagagccaatgcacaggcctacacacagaactcaatcccaaggaccagtggtgacctttggtagccacaaccctgaacttgtgagagtcacctaaatgaatttgagagtcacctaaaaatatgtcagcaccattctggcagcccaatcttgtactattttatgaaagcactattgcctcagccaatgggaatgacccaggtttgatttcataggcgcaagtcccaagctcctcaggacatttggtacacaccaaacatgatgtagagggttggagaatacctcaaatgggataaatggcactgtcacaagcacaaaagtgagacttagaaaatttcgagggaggcacttctggcaactagctcccacgtgggaccaggtccaggctcagggtggacttctaccaggcgctagaggagaatttagaaggaaacttgaggaaggcattccaaagccttagtctccctgaagcgtagagggctgtgacaggatcccctctcacccaggcctcagaggtactttcttatcatccctccttattgtccttttgtgcctccttatttgcctgttttaaaaagatagtgcctttttttgttttgttttttgtgttttggcaggatctcactctgttatccaggctggagtgcagtggcacagtcctggcttactgcaacctccacctcccgggctcaagcaatcttcccacctcagcctcttgagtagctgggactacaagcgtgcaccaccatgcccagctaattttttttattattatttgtagagacagagtcttgctgtgttgcccaggctggtctcgaactcctgagctcaagtgatctgcctgcctcggccacccaaaatgctgaaattacaggcatgagccacctttcctggccaattttttaaatattttgtggaagacagagtctccctgtgttgtccaggctgctctcgaactactgggctcaagtaatcctcccacctcaacctcccaacatgccgggattacagggttgagctgccatgctcagcccaatgatggtgcctcttatagagtgtctgaatggatagagaaacaagggctaactacaggaaacccacttcacctataaagacatatgtagattaaaagtgaatgggcggaaaaagatattccatgcaactgaaagccaaaaaaagaacaagagtagctatacttagataaaatagaagacaaatcaaggaacgttaaaagagaccaaaaaaaatcactacataatgatgaataggtcaattcagcaagagggtataacctttaaaaatatctatgcacccaacatcagaactttcaagtatgtaaagcaaacattaatagagctaaaggaaagataaacagtaatgcaataatagtaaggggctgggcacagtggcttatgcctacaatctcagtgctttgggaggctgaagtagaggatcacctgaagccaggagttcatgaccaacctggtcaaccccatctccaaaaccccatctccaaaaaagaagaccccatctccacaaaaaattgtaaaagttagctgggcatggtggtgtgcacctgtagccccagcttcttgggaggcttaggtaggaggatcacttgagcccaggagttcatggttacaatgagccactactggagttcacggttactgtgagctaccacaccactgcactccagcctaggcaacggagtgagacactgtctctaaaaataatagtagaggactttaataccccattctcaggaatgaacagatcatctagatggaaaacacctaataaggcctatctgacacatactgaacatttcacccaggtgctgcagaatacacatacttttcaacatcacataacactctcaagaatagaccatgtcttaagccaccaaacaagtctgaacaaattcaaaaaaaggtaaaaaccatattaagtatcttttctcaccacaatggaataaaacaagagatcaatatcaaaaggaacctcagaaactttacaaaattaatttccatggaaattaaacattctcctgaacaaccaacaggtcaataaagaaattaagaaagaaattttaggccaggcacggtggttcatgcctgtaatcccagcacttggggagaccaaggtgggcagatcacgaggtcaggagttcaagaccagcctggccaacatggtcaaaccttgtctctattgaaaatacaaaaattagccaggtgtggtggcgcatgcctataatcccagctactcaggaggctgaggcaggagaattgcttgaacccgggaggcagaggttgcagcgagccgagatcacgccattgcactccagcctgggcaatagagtgagactccgtctcaaaaaaaaagaaacttaaaatgatggtgggtatacaaatgaaagtgggtatacaatatatgaaaatctatgggacatagcaaaagcagtactaagaagtttatagcaataaacacctgtatgaaaaaaagtcaaaagattcaaataaatgacttaatgatgtacctaaaggaattaggaaagcaagaacaaacctaaaattagtagaaggaaagaaataataaagatcagagcagaaataaatgaaattgagacttaaagaaagcccaaaagatcaatgaaaaaaaaaatggttttttgaaaagaaacaaaaccaacaaacctttagctagactaattgtattagtccattctcacactgctataaagaaatatgtgagcctgggtaatctgtaagaaaagaggcttaattggcccaccgttctcagactttacaggaagcatgacagcatctgcttctggggaggcctcagggagcttttgcttaaggcagaaggcaaacatggtgggagcaggagcaagagtagggggcaggagtgctacacacttttaaacaaccagatctcatgataactcaccatcacgagaacagcaccaagtggatggtggtaaaccactcatgaaagatccacccccatgatccagtcacctcccaccagtccctacctccaatactggagattacaattcaacatgagatttggtggggacacagattcatgccatatcactaacaacaaaaaagagagagaaagaagaaccagacgaataatattagaaacaagacaacagagaccacagaaatacagagaatcagactattatgaacaactacacaccaacaaactggaaaaccaagaagaaatgggtaaattcctggacatatacaacctaccaagactgaatcatgaaaaatatagaaaacctcaacaaaccaataaaaagtagtgagatcaaagctgtaataaaaagtctaccatcaaagaaaagcccagaaccaagagcttcattgctgaattctaccaagcattttaaaaagaacaactacaaattctactcaaactcttcaaaaaataaaaattgaagaagagggaatacttccaaattcattctacaaggccagtgttatgctgataccaaaccagataaggacacaaagataaaactccaggccaatatcactgatgaacatagatgcaaaaatcctcaacaaaatactagcaaacctgatttaagaacacatttaaaagatcattcaccatgatcaagtagaatttatcacagggattcaaggatggctcaatatacacaaatcaataaacatgacacatcacattaatagaaccaagaacaaaaactgtgattatttcaatagatgccaaaaagcatttgataaaattcatgtcctttatataaaaaaacctcatcaaactgagtatagaaggaacatacctcaaaataaaggccacatatgacaaacccacagctaacattgtactaaaaggggaaaaattaaaggcctttcctctaaagtctgtaacaagaagaggatgcccattttcaccatttccactcaacatagtactggaagtcctgaccacaacactaaggcaagagaaagaaataaaacctaaagacttaaaaaaaaaaactactagaactcataaacattcagtaaagttgcaagatacaaaatcaacatacaaaaatcaataggatttatatatgccacgagcaaacaatctgaaataggaatcaagaaagcaatctcttttacaatagctacaaagaatagaaaatacctaggaatcaatttaaacaaagaagctaacaatccatgcaaggaaaactataaaacattgatgaaaaaaattgaagagaccacaaaaaaaggaaagccattccatgctcatgggttggaagaattaatgttgttaaactgacagtaccacccaatgcaatttacagattcaatacaatccctatcaaaataccaatgacattcttcaaagaaatagaaaaaaaatcctaaagtttatatggaaccatggaagaccccaaatagccaaagcaatcctgaacaacaacaacaaaaaaacctttcagctcatcacacttcctgacttcaaaatttactgcagagctagagtagccaaatcagcatggtactcttatgggatccttggggtgttgcttcaccaaccagaaacctctgtggccaatggtgcctttgccagagtttttctcaggcccactgggcccattcagcttggcagactgcacttggttcatgctaccagcttggatcccatgcctgtcaagggtgaaaggagcagcagggggtgtgtgagtgagcgagtgagcttgaggtccagccactgcgcacagccaggcatgctaactgcagcaggatgggcagctccaggaaccagcacaagcaccagctctctgcaaggctgtggctggaccagtcatcccacaagctacttccacagctgacattggggaatgtggtggggcccagaagcttggagatgccaggaactgcagagccccaaagaggatgtcacagccctggcttaaggagctactaggtctgggatccccaaagggctgcagcttttctttcttttttctccctgcaatatggtgagcaaggggcatgtatcagccctgtttgtgttagagctctttcatccccgccatttggtgggtcctgagttcttgtcctgcgccctggaagaataaggtacacagacaagtggagggtgggcaaggcgaataggagctttactgagtgatagaacagcccagaggagactcacagtagataacttctctccacagccatggtgtcctgatgagtgttcagctctcagcagagaggagaccctgtaatgggtagttcctctctgcagttggttgccccaacatctgctcagctctcagcagagaggagatcctggagtggcagctatattagtctgttctcacactgctgataaagacatacccaagactgggtaatttatacagaaaaagagatttaatggaatcacagttccacatggctggggaggcctcacaatcatggtggaaggctaaaggcatgtcttacttggcagcagcaagagagaatgagagccaagtgaaagggattttcccttataaaaccatgagagaatagtatggaggaaactgcccccattatttaattatctctcaccaagtccctcctgcaatatgtgggaattctgggagatacaattcaagatgagatttgggtggggacacacccaaaccatatcattccacacctggcccctcccaaatctcatgttatcacatttcaaaaccaatcataccttcccaacagtcccccagtcttaactcatttcagcgttaatctaaaagtccatagtccaaagtctcatctgagacaaggcaagtcccttccacctatgagcctataaaatcccaaagcatgttacttcctagatgcaatgagagtacaggcattgggtaaatacagccattccaaatgggagaaattggcaaagacaaagggctacaggccccatgcaagtccaaaattcagtggggcagtcaaatcttaaagctctaaaatgatctcctttgactccatgtttcatattcaggtcatgctgatacaagaggtgggttccatggtcttgagcagctccacccctgtggctttgcagggtacagcagccctcctggctgctttcacaggcttgtgtttagtgtctgtggcttttccaggcacacagtgcaagctgttggtggatctaccattctggggtctggaggatggtagccctcttctcacagttccactaggcagtgccccagtgaagactctgtgtgggggcttcaaccccacatttcccttctgcactgccctagcagaggttccccattagggctccaccctgcagcacacccctggcctggacatacaagcatttccatacatcctctgaaatctaagtggaagttctcaaaccattattatgacttctgtgcacccacaggttcaacaccacatggaagctgccaaggtttggggtttgcactgtctgaagccatggcccaagctgtaccttcatcccttttagtcatggccagagtagctggaacacacagcactaagttcctaggctgcacacagcagggataccctgggtcctgtccacaaaaccattttttttcctcctaggcctccaagactgtgatgggaggggctgccgtgaagacctctgacatgccttagagacatttttcccattgtcttggggattaacatttggctccttgttacttatgcaaatttctggaggcagcttgactttatcctcggaaaatgggtttttcttttctgttgcatggtcaggctgcaaattttctgaacttttatgctttgtttctcttttaaaactgaatgcttttaacagcacccaaatcacctcttgagtgctttgctgcttagaaatttattcttccagataccctaaatcatctctctcaagttcaaagttccagaaatctctagggcaggggcaaatgctgccagtctctttgctaaaacacaacaagagtcacctctactccaattgccaacaagttcctcatctccatctgagaccacctcagcctggatttcattgtctatatcattatcagcattttgggcaaagccattcaacaagtctctaggaggttccaaactttcccacattttcctgtcttcttctgagccttccaaactgttccaacctctgcctgttacccagttccaaagtcgcttccacattttggggtatctttacagcagcgccccactcccagtaccaacttactgtattcatctgttctcacattactgataaagacatacccaagactgggtaatttataaagaaaaataggtttaatggactcatagttccatgtggctggggaggcctcacaatcatggtggaagctgaaagacacctcttacaaggtggtagcaagacagaatgagagccaagtgaaaggggtttccccttataaaaccatcagatctcatcagacttattcactaccatgaaaacagtatgggggaaaccacccccatgaattaattatctcccactgggtccctgccccaatatatgggaattatgagagctacaattcaagatgagatttgggtgggggcacagccaaaccgtatcagtagctcctttctactgctggttgtcctgacgtctcttcagctctcagcagagaggagaccctggggtgaggagctcctctctacgactagtcatcctgtcgtctccctgagcctggctgagtacggggtttttatggacttcagagaggagaaaatgcatgctgaatggtccataggcagccatgggaggacctggaaaaagcactataagttcccactttggtatgtgggactggcagcccaacccccaggcttcaggccttccccagcttgaaagtgaggcttcactggggacctgcccctttctgccccagatcctgtctgccttctgccactgttcatggcacccaggctgttcatgccagatgggaccctgcaagtcagtactgagctgccctcccctccccctcagcctccctcccatgctctggcccaaagtccagaggtggccaaggtggcagggagctagcatgtcagcacagccccaagcatgcacatacccaggtgggttatgacagcccctgggctcagtcttgtctttgttccaagatttgagcaggcaccaggagcagggagaggccaggcagcaggagcaggcatttctgagtttgcaggagcagggggactttcctgggccccaagagcacagggatgtccaggtccacagctgcagtttgggtggctgcagctgcacctgggagggcagggttcctgcctgctcccagcccccaaaagcacagggatgcctgggtacataactacggctgggcaactgcagctgcaccctgggagcacgaagctcctgccctgtcaactcacaagggagtgaggcttctgcctgttcccagctcctgcagctccatggagcatgcagtcccagccgtagactgatagaacagaatagagaacccagatataaatctatgcatttacagtagctcattttccacaaagacaccaagaacatacaattggaaaagggcagtctcatcaatatatggtgctgggaaaactggataacagatgcagaacaatgaaactagacacctaatttctcaccataccaccaaaaaaaatggattaaagacgtaaacttaagaccacaaactatgaaaatagtagaagaaaacattggagaaatgctccagaagattggtcttggcaaagatttttggggtaagacctcaaaatcaccggcaaccaaagcaaaaatagataaatgggattacatcaagctgaaaagcttccatagagaaaaacaaaaacaaaaaacaattaacaaagtgaagagacaatccacagaataggaaaaaatttttgcaaactacccatctggacaagggattaataatcagattatataaggagctcaaacatctcagcaaaaaaataaaaggcaaaagatctgagtagactgctcaaaagaagacctataaatggctaacaggtatatgaaaacatgctcaacatcactaatcttagagaaatgcaaattaaaactataaggagatagctcaccccagttaaaatggcttttatctaaaagacaggcaataacagacgccagcaaggatctggagaaaggggaaccctcatacactgttggtgggaggtacctcaaaaaactgaaaatacaactaccatatgatccagcaattccactacttggtatatagccaaaaaaaaaaaaaaaaaaaaaagaaatcaatgtgtccaaaagacatctgcactcccatgtttattgcagcactattcacaatagccaaaatatggaatcaacctaagggcccagcaatggatgaatggataaagaaaatgtggtacatatacataatggactactattcagctataaaaaaaagaatgaaatgatgtcatttgcagcaacatggatggaattgaaggccattatgttcagtaaaataacccaagcacagaaaggcaaatatctcatccatatgtaatagcttaaaaagtggatctcatgaaaatggagaatagattggtggttaccagaggctgagaggggaaagggggaaggaggatgaacagaagttggttaatgggtgcaaatatacagcttgatagaagaaataagacctagtgttagacagatcagcagagtgactatagtttatagtaatccattgtatatttcaaaacagctagaagagaattgaaattgttctagcataaagaaaagacaaatatttaaggtgacggatatcccaattatattgatttgatctttacaaaatatgtgaatgtattaaattgccacatgttgcccaaaaaaagtacatctattatgcatcaattttaaagaaagaagtaaaagattttaatgttctagaattggcctttttctacatgtactcgctggttgaattcatctgcttatctacagttaccacttataggctgtttaatccaaagtctatcttctgtctaaatttcttcctgagaccaaacttgtatgttaatgtttattttcattcagttcaaaatgttttataattttcaggtggtttctttgatgcatgaattattttaaaatgtgtttcttaatttctaaacagaaagggtttttttctagttatgtctttgggaatgctttgtacctaaattacattatggtcagagtattttttgtgcatatgttagatatattaattatactgtttgaatcatctatatctgtactgatttttccccttattctatcaattactgaaagagagatgttaaaatctccatctctaggcaacaattgttctgcaaacacacacacacacatcaaataaactctccctctatgactgtcaatgtgtttatttctccttttagttctgtccattttaatttattttgaggttatgttattaggcacaaattcaatcttacgtcttcctgatttcatcataaaagttcctttacatcactactaatgctttttgtcctaaaatctaattattatgactatactacattagctttattttagttagtgtttgtgagaggtcccactattcttttttcaatctttctatatctttgtcttcgatgtttattttgtaaacctgtagttgggctttgttttattgtccagtatgacaatctttgtcctctaactggaacatttagtccattaataatgtaataattaaaatatatttatgtttattatcttatttcatattttctatttgtcctgcctattcaatgtttcttctccttcttttctttttctgttacttttattatttgttgttggtttttctcctaggtttgaaagtcaaatgctatttcttttgtttttaccttaggaattacaacatgcaaacttagcttatcaaagtataaagctaatcaatacttacagtcttttcccaaagaccttaaattattttattccatttactcttctcttgaattatgtttgtcatgtaattctacattttttaactccaaagaataccaatttctaccatttttctttttctttctttcagatttactcacatatttactattttctttactctttgatgtatctttcatctcagactttatatcattttcctttggcctgaaatatatcttttagaatttcttttgttgaagttctcttagtgacaaactcaattttttatagtgattactgagttatattagcttatttaagatagtatcttttttttgctatatatatatatattttttttttttactttaagttctagggtacatgtgcacaacgtgcaggtttgttacatatgtatacatgtgccatgttgtgcaaactcaatttttgtttctttgcttgcttacttattcatttgtctgaaaatgtttttatttgggcttcaatcttaaaagatattttatctcgatgcagaagtctaggttgggagttattttctttccaaccacaatgccaatcccctgtcctctgactctcattgctgttaggaagccagctttctatctaactgccttttgcttttgaaagtgagctgaattttttttagtgttacttagttctactaatcatgtgttgtgatatggatttctttttattcatctttcttgaaattcattgtttattgaatttgtagattagtgcctttcatcaattctgaaaaattcttagccataatcttgtaaaatattgcatctaccccattctctcttttctctcattctagaattacaagtaaatattatatgttttcactctatcttccatgtctctttagcatttccttgatatttttcatctttatatctgtttatgcttcattctatgtgatttcttttcatctcttcatgtatgtctaatttacttttctacctatccattgagtttttgttttaaatattttcttgtattttttattttatatataaaattacatatcttaggtcaggtgcgttggttcatcctgtaatctcagcactttgggaggctgaggcaggtggattgcttgagcccaggagcttcagaccagcctgggcaaaatggtgaaacccagtctctacaaaaagtacaaaaattagctgggcatggtgacgcatgcctgtgatcccaactacatgagaggctgaggtgggaggatggcttgagcccagtaggtggaagttgcagtgagttaagattgtgccactgtcctccagcctaggcgacagagcaaaactctttttcaaaagaaattatatatatttaatttctatatatttgattgttcattgtgtacatttaaaaattatatattttatttctaaaagttggatatagtctttttcaaatctgctctgtcttaaggttttctatttcctgcagacattttcaagtttatctgttactgctttaagcaaagtaaacatagctgttttatacttgtgtatgacaattctagtaactaaagtcttgataggtttcttttttctttttttaatttttatactttaagttctaaggtacatgtgcacaatgtgcaggtttgttacatagatatacatgagccatgttggtttgctgcacccatcaactcgtcatttacattaggtatttctcctaatgctattcctcccccagacccccacccccaacaggccttggtgtgtgatgttccactctgtgtgtccatgtgttctcattgttgaactccaacttatgagtgagaacatgtggtgtttggttttctgtttttgtggtattttgctgagaatgatggtttccagcttcatccatgtccctacaaaggacatgacctcatccttttttatggctgcataatattccatgggtgtatatgtgccacattttctttatccagtctattattgatggacatttgagttggttccaagtctttgctattgtgagtagtgccgcaataaacatacgtgtgcatgtgtctttatagtagaatgatttataattcttcaggtatatacccagtaatgggattgctgggtcaaatggtatttctagttctagatccttgaggaatcaccacactgacttccacagtggttgaactaatgtacactcccaccaacagtgtaaaagcattcctatttctccatatcctctccagcatctgttgtttcctgactttttagtgatcaccattctaactggtgtgagatggtatctcattgtggttttgatttgcatttctctgataaccagtgatgatgaccattttttcatatgtctgttggctgaataaatgtcttcttttgagaagtgtctattcatatccttcacgcactttttgatggggttgtttgttttttttcttgtaaatttgtttaagttccttgtagattctggatattagccctttgtcagatggatagattgcacaaattttatcccattctgtaggttgcctgttcactctgatgataatttcttttgctgtgcagaagctctttagtttaattagatcccatttgtcaattttggcttttgttgccattgcttttggtgttttagtcatgaagtgtttccccatgcctatgtcctgaatggtattgcctaggttttcttctaggctttttatggttttaggtctaacgtttaagtctttaacccatcttgagttaatttttgtataaggtgtaaggaagggatccagtttcagctttctacatatggctagccagttttcccagcaccatttattaaatagggaatcctttccccatttcttgtttttgtcagctttgtcaaagagcagatggttgtagaggtgtggtgttatttctgaggcctctgttctgttccattggtctatatctctgtttttggtaccagtaccatgctgctttggttactgtagccttgtagtctagtttgaaatcgagtagtgtgatgcctccagctttgttcttcttgcttaggattgtcttggctatgcaggctcttttttggttccatatgaaatttaaagtagttttttccaattctgtgaagaaagtcagtggtatttaaagggaatagcattgaatctataaattaccttgggcagcatggccatttttacgatattgattcttcctaaccatgagcatggaatgttcttccagttgtttgtgtcctcttttatttcactgagcagtggtctgtagttctccttgaagaggtccttcacatgccttgtcagttggattcctaggtattttattctctttgaagcaattgtgatgggagttcactcatgatttggctctgcgttattggtgtataggaatgcttgtgatttttgcacattgattttgtatcctgagactttgctgaagttacttatcagcttaagaagattttgggctgagacgatggggttttctaaatatacaatcatgtcatttgcaaacagagacaatttgacttcctcttttcctaattggatatgcttatttctttctcctgcctgattgtcctggccagaacttccaacactatgttgaataggagtggtgagagagggcatccctgtcttgtgctggttttcaaagggaatacttccagtgtttgcacattcagtatgatattggctgtgggtttgtcataaatagctcttattattatgagacacgttccatcaatacctagtttattgagagttttttgcatgaagggctgttgaattttgtcaaaggtcttttctgcatctgttgagataatcatgtggttttgtcattggttctgtttatgtgatgcattatgtttattgatttgcatatgttgaaccagccttgcatcccagggatgaaaacaacttgattgtagtggataagctttttgatgtgctgctggattcagttcaccagtattttattcaggattttctaatccatgttcattcatggatattggcctaaaattctctttttttgttgtgtctctgccaggctttgatatcaggatgatgctggcctcataaaatgagttagggaggattccctttttttctattgattggaatagtttcagaaggaatagtaccagctcctctttgtacctctggtgggattcagctgtgaattcgtctggtcctggaccttttttgactggtaagctattaattactgcctcaatttcagaacctgttattggtctattcagagattcaacttcttcctggtttagtcttgggaggatgtatgtgtccaggaatgtatccgtttcttctagattttctagtttatttgcatagaggtgtttatagtattccctgatggtagctgtatttctgtgggatcagtggtgagatcccctttatcattttttattgcatctatttgattcttctctcttttcttctttattagttttgctaatagtctgttttcttgattttttcaaaaaaccagcgcctggattcactgatttttttgaagggttttttgtttctctgtctccttcagttctgctctgatcttagttatttcttgtcttctgctagcttttgaatttgtttgctgttgcttctctagttcttttaattgtgatgttagggtgttgattttagatctttcctgctttctcttgtggccatttagttctataaatttccctctacacactgctttaaatgcatcccagagattctggtacgttgtgtatttgttctcattggtttcaaagaacatctttatttctgccttcatttctttatttacccagtagtcattcaggagcaggttgttcagtttccatgtagttgtgcaattttgagtgagtttctcaatcttgagttctagtttgattgcactgtggtctgagagacagtttgttgtgatttctgttcttttatatttgctgaggagtgttttatttccaattatgtagtcaattttagaataagtgtgatgtgctgagaagaatggatattcttttgatatggggtggagagttctgtagatgtctattatgtctgcttggtccagagctgagttcaagtcctagatatctttgttaagtttctgtcttattgatctgtctaatattgacagtggagtgttaaagtctgccattattattcttgtgtgggagtctaagtctctttgtatgtctctaagaacttgctttatgaatctaggtgctcatgtattgggtgcatatatatttaggagttagctcttcttgttgaattgatccctataccattatgtaatggccttctttctctcttttgatctttgttggtttaaagtctgttttataagagaccaggatttcaacccctgcttttttttgctttccatttgcttggtagatcttcctccatccctttattttgagtctatgtgtgttttgcatgtgagatgggtctcctgaatgcagcataccaatgggtcttgactctttatccaatttgccagtctgtgtcctttaattggggcatttagcccatttacatttaaggttaatattgtaatatgtgaatttgatcctgtcattctgattctagatgattattttgcccattagttgatgcagtttcttcatagtgtcgatggtctttacaatttggtatgtttttgcagtggctggtactggtttttccttttcatatttagtgcttccttcaggagctcttgtaaggtaggcctggtggtgataaaatctctcagcatttgtttgtctgtaaaggattttatttctctttcacttataaagtttagtttggctggatatgaaattctgggttagaaattcttttctttaagaatgttgaatattggcccccactctcttctggcttgtagggtttctgctgagagatccactgttagtctgatgggcttccctttgtgggttacccaacctttctctctggcttcccttaacaattttttccttcatttcaaccttggtgaatctgatgattatgtgtcttggggttgctcttcttgaggagtatctttgtggtgttctctgtatttcctgaatttgaacgttggcctgccttgctaggtttgggaagttctcctggataatatcctgaagagtgttttccaacttggttccattctccctgttactttcagatataacaatcaaacgtagatttggtcttttcacatagtcccatatttcctagaggctttgttgatctcttttcacccttttttctctaatcttatcttcttgctttatttcatcgaattgatcttcattctctgatatcctttcttccacttgattgattcagctattgatactttcatatgcttcacaaagttctcgtgctgtgtttttcagctccatcagatcatttatgttcttctctaaactggttattctagttagcaatttttctaaccttttttcaaggttcttagcttccttgcattgagttagaacatgctccttcagcttggaggagtttgttattacccaccttctgaagcctacttctgtcaattcttcaaactcattctccgtccagttttgttctggatggttttgttctctttgctggcaaggagttgtgatcctttggagaagaggcactctgatttttgtaattttcagtctttttatgctgttttttccccatcttcattgatttatctaactttggtctttgatgttggtgacctttgcatgggttctctgagtggacatccttttttctgatgttgatactattcctttctgtttgttagttctccttctaacagtcaggaccctctgctgcaggtctgctggagtttgctggaggtccactctagaccctatttgtctgggtattaccagtggaggctgcagaacaacaaagattgctgcctgttccttcctctggaagctttgtcccagagagacacccgccagatgccagcaagagctctcccgtatgaggtgtctgtcagcccctactgggaggtgtctcccaaacaggatacacagagctcaaggacccacttgaggaggcagtctgtcccttttcaaagcttgaacgctgtgctgggagatctgctgctctctttagagctgccaggcagggacgtttaagtctgctgaagctgtgcccacagccatcctttcccccaggtgctctttcccagggagatgggggttttatctataagtccctgagtgggtctgctgcctttttttcagagatgccctgcccagagaggaggaatctagagaggcagtttggccccagcagccttgctgagctgtggtgggctccgcccagtttgaacttcctggaggctttgtttacactgtgagggtaaaaccacctactcaagcctcagcaatggtgggcgcccctcccccaaccaagctcaagcatctctgggcgacctcagactgctgtgctagcagcgagaatttcaagccagtggatcttagcttgctgggctccatgggcatgcgacctgccaagccagactacttggatccctggcttcagccccctttccagggaagtgaatggttccatctcactggtgttccaggtgccactggtgtatgaaaaaaagaaactcctgcagctagttcagtgtctgcccaaacagctgtccagttttgtgtttgaaatctagggccctggtggcgtaggcacctgagggaatctctggtctgctggttgtgaaggccatgggaaaagtgcagtatctgggccagagtgcaccgttcctcctggtacagtctctcacggcttcccttgactgggggagagaaatcccctgaccccttttgcttcctgggtgaggcaatgccccacgctgcttcagctcaccctccatgggctgcacccactgtccaaccagtcccaatgagatgaacatggtacctcagttggaaatgcagaaatcacccaccttctgtgttgatctccctgggagctgcagaccagagctgttcctatttggccatcttgccagccaccccactttctgctaatctttagagtcaataaccattcattgttgagcacatacttatgtggtaggccctgtgccaggttctttcatttattaaaaatattcagcaaattgcagttccagattgtacctggcactgtactaggttgaagataattatgccttcaagaatctcatatgctattaggtggtatcacatacattacatcatttaactcacataaaatcccgtgaagtagatattgtatctccatggcctctactttcttatctgcaaaaaaaagaaacaatatctcttaaggctactatgagaattaaataagataatgactgtgaacatggtacttgctctcaagttcagtgctcctcccacagtaccacacctgccagtaccagcattttctgtttgcttccttctgccccttcattattcatataccattttgaatttccacctgctttatagttgtaatatctttactcaatttcaattcctcactttcaccatgacctttcccctgtctttctccctctgttaaaatttgagctttctgttgtctcttctctagccacccaagatgctaaaacaaaataagaccaaggggaagaagatggctggggcccctgctgtcatgaagaagcaagaagccaagaaagtggtgaatctcccctgtttgagaaaaggcctaagaattttagcactggacaggacatccaccccaaagggatctcactcactttgtcaaatggcctcattatattaggttgcagcagcaaagaactatcctctgtaggtcactggaagtgcctcttgtgattaaccagtttacccaggccttggacctcctaacagctgctcagcttcttaagctggcccacgagtacagaccagtgacaaagcaagagaagaagcaggaattgttggcccatgctgacaggaatgctgccagcaatggagacatccccactaagagttcacctgtccttcaagcaggggttaatactgtcaccaactcaatggtgaacaagaagtctcagctggtgctgactgcacaagatatggatcccatcaagctggttgtcttcctgccagccctgtgttgtaaaatgggggtcccttactgtgttatcaaagagaaggcaaggccgggaagtttagtccacaggaggacctgcatcattgtcaccttcacacaggttaaatggaaaaaacaaggagctttagctaaactttgggagcttcaggatcaattacaatgacagatataatgagatccaccatcaatggggaggcaacatcctgggtccaaaatctgtggcttacaatgccaagccagaaaagacaaaggctaaaaaacatgccactaagcttagttaaatgcacactgttgagttttctgtacagaaagataataaaaaattctccttcagccaaaaagaattcaagctttcttttctgacctcttatgccctacatccccacccaattgaaagtatttttttgaaagaatgccttactactgatacagtgtcaattggtgctatgatttgaatgtgtttcctccaaaattcaggtgttgccaatgtgatagtattaagaggtgggatctgtaggaggtgattaggccatggggttcctccctcatcaatagaattaaggcacatataaaagaggcttcacgtagcatttagctagctttccaacttgtcctttcatcatgtgaggatgcagcaaaaaggccctcaccagaaaccagatgtgagcaccttgatcttggacttaccagcctccagaagtatgagaaatgtattttattttatttatcatagatataaattacctagtctcagattttttttgttacggcagcccaaaatggattaagacaatgagaatgtaattggtattaattatgtggaaaataaattggcattatttatgaaaattttaaattgatgtgctcttttaaaagcagcaatcccacttccaggaatttatctcacaaatacactcatatatgagaaagtataaaagaaaaatattccataaagcattgtttgcaatagcaaaatagtaaaacaaatatctgtcaagatacacaaataatttagtatgcatagaatattactggaagaatataaaaaatgatttaaaaattagagatagtgtatatagtatttttataaatacataagtatatttcataagtttataatattttaaaaactagtcaccttcaaagccaaatgtggtggaatgcacccataatcccagctacctgggaggctgaggcaagaggatcacttgagctcaggagtttggaggcttgggcacatagcaagaccctgtctccaaaaaaaaagaaaaaaaaaaactgagcccaggagttcaagactggcctggacaagatggcaagaccccatctctacaaaaaatgaaaatgaaaatgttagccaggcacaattgcacaagtctttaatctcagctacttgagaggctgaggcaggaggatcccttgagcccaagagttcgatatggcagtgagctatgatcatgccactgcacttctgcctgggtgacaaaataagacctcatctcttaaaaaaaacaaggcaaaacaaaaacctgacatttaatatttttcacggttttgaacaattaaaaaaacactaatcaccttcagataatgatagagaaccaatttattatgttgataactggtaaaaagggaaaaaaattaaaaatttatcttgcttttctctcatgaattgtaccattggataaccaaataggtgaagggaagctctctttataaaaatattttaattaatgcatttattaaatggtagaaatggaatattaccattttgtaacccccaacaaataatggatgcactcaatgagcgtcgatggttgctaacattccaaagagagacaagaagatatctgctttctgatggaagaagataccacttcctataatcttcccaaagggattaaacatgagtatactccctctgcatccagctgtcaatatgaaaaatatacaactgacagaacatgcagacctccaccataaatataaaatcagcaaaatccagactgtgagaaactgcaggtcaaacagttcacattcttccacagattactgtaagggagagaaagagatatatactaaaattatttaaaatgtatattagttgttttttttttttgaatgggcaagattaaacttaagtgccttgagatacacatttgggtgcatcacttccttgatgactacgaaagtgaaaatagcggttactttgaggtggaaagaagagattctggggtggctggcaaagttctatttcctgacacaaatacaagggtgtttataatagttccattacataatacactttttccgtattcatgttttagttcatattaaagatgtttaaagatcaattttttgaaaaaaaggaatatgtgcattatacagagggaagcaaaagactctaatatgtggagcctctccctctgagccatctcttagatattttacatacttgctcatttattccttataagtaacctatgaggattgaggaaaatatttttgtaaactttgtaaactgagtttacagaggtcgagtaactttctcaaggctaagaccatgtcactaataagtggcagaaccagagctctaatttttccagtactctgcactgccactcatgaggctaaaggagaatgctgcatgaaccctcatctctcaagctagacatttctcggtgaaacaccttccttcctgttgatcaatgtctgccactacttgaataacttaaggtcaagcataggttaggtatcctgcagtggttttctctgatctatcacttgtttttcagcctaatttgtgatgtgattagagaaagttgcctccaagggagaaacataaattcacctgtaaaaaaaaaaaatcacacctttcctctaataagatccctttatgtgccaagccaaagtgcatgaccacttggcccttccgtacagctccttcacagtctgaagcattttctgctaactagaggcaccagctgtgccaagacaagctgtttgtccaccccttgcctgccttgagtgggaaataataacatgacattgtaaaacacaggggtgcccagcagcctttcatttggtgaaagtaactgcaagggctcagagctgggttaatggatacaacagtgcctgtaatcagatccaggtgctgtatatacttgttattgattacgacttcaataattgcaaaatcaaccaaccaaaagaatcatgaaaaaaatattatgcaagatgtctaaacagaggccccaaaaccagcagttgctggagaagtatttatcacctttttcaagatccaagcttagggtattgtatgtttggcaaaatagctatatttcagcagggcttaaagagattacttgtctcagggctttcagtttggccggtaacagatgaagacagattgattgaaagcatttgaacaaatataaacttgaacaagctgaatggacgtgattaagttaattagggtcgataaatgccattgacaatatcttacaactcttcctttatcttggagtatttctttcttatataacacaggcaagtggatatggtgactctaatattaaacctgtaactgagtagccattcagcctaattaactagacaccatctctcaatggcctgctagataattaacgttttattttatacatgtaatattactcatcatttactgtatgcctattatgtaccagacactatggcatttaccctgtattttttgtttttttaatttatttaacttttattttaagttcaggggtacttgtgcaggttctttacataggtaaacttgtgtcatggggggtttttgtacagattattttgtcacccaggtattaagcatagtacccattagttatttttcctgatcctctccctcctcccaccttccaccccccaataggccacagtgtgtgttgttcccctctgtgtgtccatgtgttcttatcacttagctcccacttataagtgggaacatgccatatttggttttctgttcctgcattagtttgttaaggataatggcctccagctccatccatgttcctgcaaaggacatgacacaatctcattcttttttattttaagacagggtctggctctgtcacccaggatggagtatagtggtgcaatctcagctcactgcaacctctgtctcctggattcaagtcatcctcccacctcagcctcccaaatagctgaaactacaggcacataccaccatgcccagctagttgagctcattcttttttatggctgcatagtattccttggtatacatataccacattttctttatgcagtctatcattgatgggcatttaggttgattccatgtctttggtattgtgaatagtgttgcaatgaacatatgcctgtgtcttcataatagaatgatttatattcctttgggtgtatacccactaatgggattgctgagttgaatagtatttctgtcttcagatatttgaggacttgccacactattttccacaatcattgaactaatttacactcccaacagtgtataagtgttccttttctctgcaccctcaccagcatctgttattttttgactttttaattgccattctgactggtgtaagatggtatctcattgtggttttgatttgcatttctctaatgatcagtggtgatgagcttttttcatatgatcgttggccacatgtatgtcttcttttggaatatgtctggtcatgtcctttgcccactttttcatggggttgtctttttcttgtgaatttgcttaagttcctcatagatgctgaatattaggcctttgtcggatacatagtttgcaaaaattttctcccactcagtaggttgtctgtgcactgttgatagtttcctttgctgtgcagaagctctttagtttaattagatcccatttgtcaattttgcttttgttgcaattgtttttggtgttttcaccatgagatctttgctcattcctacgttcagaaaggtattgcttacattgtcttccagggtttttatagtttttggttttacatttaattctttaatccatcttgagttaatttttgtacatggtataaggaaggggtccagtttcaatcatctgcatatagctggccagttatccagcaccacttattcaatagggaatcctttccccagtgcttgtttttgttagctttgtcaaagatcagatatttgtaggtgagcagccttacttctgggttttctattctgtttcattggtttatgtgtctgtttcttgtaccagcaccatgctgttttgattactgtagccctatagtttagtttgaagtcagttattaatagcatgatgcttccagctttgttctttttgcttagtattgccttggctattcaagctctctctctctctttttttttttttcttgagacagtctcactctgtcacccagactggaatgcagtggcgtgatcttagctcactacaacctctgcctcctgggttcaagtgattctcctgcctcagcctcccaagtagctggaattacaggtgcacaccaccatgcccggctattttgtatttttagtagagatggagtttcacaatgttggccaggctggtctcaaactcctgacctcaagagatccacccaccttggcctcctaaagtactgggattacaggcatgagccactgcacccggcctttttttttttttccagctttgtcaccaggctggcgtgcaatggcatgatctcagctctctgcaacctctgcctcctgggttcaagtgattctcctgcctccgcctcccaagtagctgggattacaggcatcagagcttttttaaattccatatgaattttgaaatagtttttcctagttcgtgaagaatgttagtggtagtttaataggaatagccttgagtctataaattgctttgggtagtatggccattttaacaatattgattcttcctatccatgaacatggaatgtttttccatttgtttgtgccatctctgatttctttgagcagtgttttgtagttctccttgtagagatctttcacctccctgtttagctgtattcctaggtatttattttattttatttttgtggcagttgtgaatgggattgcattcctgatttggatctcggcttgactgtttttggtatgtaagaatgtaagtggtttttgcaccatcattttgtatcctgagactttgttgaagttaatgagcttttgggtggagactatggggttttctagattagaatcatgtcatctgcaaacagggatagtttgacttcctctcttcctatttggatgccctttctttctttctcttgcctgattgccgtggccaggacttccaatactgtgttgaataagagtggtgagagagggcatccttgtcttctgccagttttcaaggggaatgcttccagtttttgcccattcagtatgatattggctgtgggtttttcatagatggcatttattattttgaggaatgttccttggatacctagtttattgagataatcatgcagcttttgtcttctgtttatatgatgaatcatatttattaatttgtgtatgttaaactaaacttgcatccagggataaagcctactggatcgttgtggataagctttttggtgtgctgctggattcaatttaccagtattttgttgaggatttttgcatcgatgttcatcaaggatgttggcctgaagctttcctttttgttgttgtgtctctgccaggttttggtgtcaggatgatgctggccttgtagaatgagttaaagaggagtcccttctcctcaatttttggagtagtttcagcaggaatggtactagctcttctttgtatatctggtagatttcagctgtgaatccatctgatcctggggtttttttgttggtaggctatttattactgaatcaatttcagagctcattattggtctgttcaggaattcaatttcttcctggttcagtcttgggagggtgtatgtattcaggagtttactcatttcttctagattttctagtttatgtacataaaggtgttcataatattctctgatgattgtatttctgtggggtcagtggtaatatcccccttgttatttccaattgtgtttagttgaatcttctctcttttattctttattagtctagttagtggtatatatattttttttttttcaaaaaaaaatctactggattcattgatcttttgaatgtttttttatgtctcaatccccttcaattcagctctgattttggttatttcttttcttctgctagctttgttcttggttctctaattcttttagttgtgatgttaggttgttaacttaagatctttctaagtttttgatgtgggcatttagtgctataaatttcccttttaacactgcgtgtcccagtgtcccagggattctggtatgttgtatctttgttctcattagcttcaaagaacttcctgatttctgccttaattttgttatttacccaaaagtcattcaggagcaggtattcaatttccatgtaattggatggttttgagtaaatttcttagtctttgtttctaatttgattgtgctgtggtctgagagattgtttgttatgatttcaattcttttgcatttgccaactcaagtgtccatggtggttgaggggtctcctgccagggttccagaggcctgtggtttctccttgtcaattcaactcacccattcctctggagccattgtgggccaggaacaaggtccagtgcacagtagaccatgcagggttcccagctttctcctccttcagctcagcttctgggtcttccctctgttcactcttggtgccttccctctgaagatctattaggagcatgccagtcatctcagtccctcggtgggagctgttccacttagctgtgtctagtcagccttcttgcccacccctaaagatgattttgcacgtacaaatattgacactcagtggctgggcagaagttctctcattttaaatatcaatttgaattggtagccgaagtttaagaatttacttcagaactgttccctggtcctgcttgcctctgtgcagcacagctggaccataccctacaggtttcccacttccactgcaaacacctgggaatgccctgtatcatttcatttaatcctctgaacactgcatggtcagtggtattagctcaatcttacacaagaaaaaactgaggttggccaggcgcggtggctcacgcctgtaattccagcactttgggaggccgaggcaggcggatcacaaggtcaggagattgagaccatcttggctaacacggtgaaacgccgtctctactaaaaatacaaaaaattagccgggcgcggtggcgggcgcctgtagtcccagctactcgggaggctgaggcaggagaatggtgtgaacctgggaggcggagcttgcagtgagccgagattgtgccactgcagtccggcctgggctaaagagcgggactccgtctcaagaaaaaaaaaaaaagaaaaaactgaggcacagaggcaaaataacttgttcaaggtcacaatcagtatatggtagaattagaattcagttttttgtctataaaaccatgttcttcccacaaatgttaaggcaaaaattgttaactgcctactcaaatagtcattctctgcttccttctctgtaacaaaacacctattttactcagggtagcattattccctattgaaagaatatattttccatgctcccttgcaggccaagtcctggccagagagataaaaatggaaatgttgcgtggaaaatattatgaaaccacaatactagtcccaggctaccaacctctagactttcacatgatgacaaaaaacaagcaaacagacaaaaatcttattttgttgtctcagatttcaaaaattatatatagccaaataatcctaaccagcatgccacatatgtcagtattttaccacattttgttcttgagataggatcttgctctgttgcccaggctgaggtacagtagcacaatcatagcttactacaggtacaaacttctgggctcaagtgatcctcctacctcagcctcccaagtagctgggactacaggcacatgctgccacgcctggttaattaaaaagttgtgggggtttttttgtagagatggggccccactatgtagcccagtctggtcttctggtcttgaactcttggtcttaagtgaccctcccgcctcagcctcccaaagtactgggattataggctcaagccaccatgcccagccctcaccatgtgtttttgttgttgttgttgtttttgagacagtctcacttattgcccaggatggagtgcagtagtgcgatcacaggctcactgcagcctcgacttcctgggctcaagtgatcctcccaccacagcctcttgagtagctggggcaacaggcacacaccaccatgccaggctttttttttttttttttttttttttttttttagaaatggagttccaccatgttatgcagactggttttgaactcctgggctcaagcgatctgcctgccttgtcctcccaaaatgctgagattacaggcatgtgccactgtgcccaaccaccacatggttgggtgtttgtttttgtgtttgcgttgcacaattttctaaagccaaataattctgctcataatggcccatcgattagtaaaacagctgtcagtgtccaaattattagcattatcttacaaaaaaaaaataaacccagacctggcacggtggctcaggtctgtaattccagcactttgggagactgaggtagcagaattgcttgagcataagagttcagggctgcagtgagctgtgattgtgccactgcactccagcctgggcaacagaaagacatcctgtctctaaaaaaaataaataaatagacctataggttctatattttttaaaaaaatacagaatccatgcttgaggatatcaaagatatatttaaaacttttcagatacaataacgatattatggttgtttttaaaactcttgtcctttaatgatacatactggaatatttctggatgaagttgtatgatgagccaggtgcaggcgctcatatttgtaatcccagcacttttggaggccaaggtgggaggactgcttgaggccaggagttcaagaccagcctgggcaataaagcaagacccccatctctaaaaaaaagttattaaattaaattgaaatttaaaaattaagaaaaaaattgtatgatgtatgggccttgcttcaaaataatacagaatggagaaaatggggggaatatagataaaataaaattgaccatgagttgataattattgcaattattgaccgtgagttgataattgttgcaattattgaccatgaattgataattatgtgtacataaagtatcattacactattttgcttttatctatgttgacattttctataatataatacaaagttaaataagatatagccagaatcaagagcacttcccacaatctccaaacttactcctatggtacaagtcaccttttctcacctgcagtttaccagtagtctccctagatggtttcatttcttctgcctttgcccctttataatctattctacagggcagcagagtgaccatgttaaaatataaatccaaattgctcctctactcaaaaccctccaagggctgccattttactctaggtgaaaaccaaagtccttgcaatggcctccaaggtgctgtgatctatgccagtatccccctcaaatctcatctatccttgccccattcattgattttgtttcacccataccagaatccctgatgctcctagagaaccaggaattcttttgccttaatgtctgtgcacattctgttccctctgcctagaacatgtttcatcaagatttgtatactgttcccttcctcacttctttcaggtctattttcaaatgacacattatcaatgaagccttcccttgaccaccatacataaattagcaacactccaccatcatgacctttccctggtttgttttttctttctcaccctcactcaggctggagtgccatggcacaatcactgctcactgcagccttgacctcctcctcaagtgatccttccacctcagcctcctgagtagctgggactacaggcatgcaccagcatgccagctaattttttgtattttgtagagaagggatttcgccatattgaccaggctggtcttgaactcctgggcccaagcaatctgcccaccttggcctccaaaagtgctgggattacaggtgtgagccaccatgcctggccttattttcttcatagtcattatcaccacttgatgtactatacatttctttattttctaccccttccatgctatgatgcaaattccacaaaagtaccttttttttattttgttcactgctatagttccagtcactagaacactacctggcgcataataataggtaactggcaaataaatgaagacaagcattgagatcctcatttaacaaatgagaaaaccgaggtgaaaacaggttaagtaacttgtccaaaataatataggtactttggcctaaagcctttgtactcttcattccctttgctcagaatatttccatgttcaaagcagtgtcttaatctttgccttgcctcaaaatctgtatgcattgtacttcaggagctgaaagtacttcacagggttacgatgaagattaaatataaatatgagcatcagtaaactttgtagaatgtcaggcctcatacagtttttaattcttgtgggttcatctctaagatcaaagtcagaaacactgtttctccaagcttattttgatctagatgtgaaaatgtaaccattctatggcccgaataaattccaggcatgaaaatacagataagatgtcttatattattaacatgtgtttcttgcaagtaatggaaataagatatttcagttcctgaaatgtactacaggtcttgaactattcagatgtgagcacctggccgaaagtacacccatgtgattatggtttaactatagctcgaggtttcatctctcagttgcagatgcgttttgaggtatatagatagcatatatcaattatagtctgccaggtagcagacatggaataactgagtcaattagtaatagtgatcctcaatgtttttcaaaatactgatttccagtttgccaaagaattgtgtatctgtagtattacactgcccatgtgagaagcacaatgatctaaacattttgatattttaggaataaactgtatttatgctttttttcagtgatctgtaatgatttttatatgaatgagcattttaaaattatatgcaagtttgcaatttgtcccatttaactagtggaaaaaccaatgtgcaaggcaaactaacttgtccaaattcccttagtggttaaaacaaagcagaatgaaaaaacttaaagtggcatttgcctgccagtctttgctgctatgacttacaagatcatattgagaggtgacagcatgctggcagcccgcgcagcgtcgctcgctctcggtgcctcctcggcctcgccgtccattctggccgcgcttgaggagcccttcagcccgccgctgcaccatgggagcccttctctgggctggccgaggccggagccggctccctgggcttgcggggaggtgtggagggagagggacaggcgggaaccggggctgcacgcggcgcttgcgtgccagctagagttccgggtgggcgtggacttggcgggccccgcactgggagcggcccgccggccctgccggcccgtgcagtaaggggtttagcacccgggccagcagctgcggagggtgcgccgggtcccccagcagtgctggcccaccggcgctgcgctcgatttttcgccgggccttagctgcctccccgcggggtagggctcgggagcggcagcccgccatgcctgagtctccccctcaccaccgtgggctcctgcgcggcctgagcctcccttaccagcgccgccccatgctccaaggcgcccggtcccatcgaccgcccaagggctgaggagtccgggcaggctcacggcgcgggactgtaaggcagctccacctgcgccccggtggcagatccactgggtgaagccagctgggctcctgagtctagtggggacctgagtctagaacctttatgcctagctgggggatagtaaacacaccaatcagcaccgtgtgtctagctcaggtttgtggatgcaccaaacagcactctgtatctagctaatctggtggggacttggagaacctttatgtctagctaagggattgtaaatgcacccatcagcactgtgtctagctcaaggtttgtaaatgcaccaatcagtgctctgtgtctagctgatctggtggggacttggagaacctttaagtctagataagggattgtgaatataccaattggcactctgcatctagctaatctagtggggacctggagaacttttgtgtccagctcagggattgtaaacgcaccaatcagcaccctgtcaaaatggaccaatcagctctctgtaaaacagaccagtcggctctctgtaaaatggaccaatcagcaggatgtgggtggggccagatgagagaataaaagcaggctgccggagccagcagtggcaagctgctgaggttaccttccacactgtgtaggttttattctttggctctttgcaataaatcttgctgctgctcgctttttttggtccacactgcttttatgagctgtaacactcacctcaaaggtctgcagcttcactcctgagccagctagaccacaaacccaccagaaggaacaaactccggacacggcgcctttaagaactgtagcactcaccgcaagcctccgtggtttcattcttgaagtcagtaagaccaagaacccaccaattctggacacaatatgagaatgatataaaattgcaagtatctggctgtttttgacttataagaatgccaattccatgtggttcaaactaatattaataatggaacaggtaaaaaccatgacacgtgtgaatttagaaaagaaatttctgcaaacacattcttttagtgaaggtgctaaaatagcaaaattaagagcctcctaccaactgcagataagctgacataggacaataacaaaattatagcagatgattttcaaagcccaatactttataaataccaaataatagtggcagaaagggttacagtttgcctatgttcaattaactaaagaacactatgccagagagcccaaggtcaaaggtttgacccctttgtcatcctgttaactctatcatgtttcatgacctactgtactcttagtccaggacattcatctctgaaatgcacgcccaaggcagagggtgagaggtaaggattggagtggaaatgaatttcaagaaaaggtacaaatctatgacttttgcagtggagatgggggcatctaaaaggcagactcttgtgcctgccctatggtacatgttcaataagtggtgaataaatggatgggtgaaggagtgaatgtcctgctagtgatgagtaatctcattactaattttgtagaaaatctctagtaatatcacgtaatgtgttttagctggaagggaccttgaagctatctaatctggtgtccacattttgatagttgggaaaaataaagtttaaaatgaaatgactaacctaaagtcacactgactgggactagaatttatggcttctcaatgtcagaactgggactagaatttgtggttcctagttctcagtgtaatactccttccaatatatatgataggataaaggatctttctcaccaatagaaataattagcatgtaattttcacatcctgaaatagcagagtagtctcgtttagtgtttataatcggaggaggccttaaagattatctaatctagccccttgttttataaagtagaaaaccatagtgcaaatgttaaatgacttgtccaaagttagccagttagaaaatcaacatttaactcaggtctccagatcccccagatccagggcacattttgcaccgtgctgaaagacattagtacacttaaagtttgtttgctttttacatattttgatggcatatgattctccaaatgtgggcaacaggaaatgtttatttatatacaagtacatgggaaagcaatttccatttagtttttttaaaaaattgttacaaataaaaagtttttaatacattcatcctttgcacacaaaatacattctttttcttttactctcagtatgaattatttcttaataatagaaaacataggctacaatgaatggacagtcatatggtttggtgatttgacaaacttttttcaagaagcaaagtccaattttaaaagacagacaatatataaaataacttacatatttaaaatgctacttcattgaatcctaaaagattgaatgagtactcttatccagcatgatttgtagttgtcctttaaacaatgcagaggacaagaaatcctctatgtgatggcaactcaatttctacaagactgaaacagtcttcatgaaattgattgcttatcacatctaaatgacaggctcatagaaaaattcttatggatgtattggggagttagtctttattcagaggtctcctaattgatcaattaaactaagatcgtaagttgcactctccaaacaggattgcaagaggttctacgtaaataaacataaatgatttgatttgatttgtcagactaattgtttttaagagagatgtgaaaacatacacccatacaaaaaacttttacataaatgttcacagcagcattattataatcaaaaggtggaaaaaacccaaatgtccatcaaatgataaatggacaaataaaatgtggcatatacatgcaatggaatattatttaaacatgaaaacaatgtactgatttatgctacaacatggatgagctttaaaaacattatgcttacttagagaagccagacacaaaaggccacatgttgtttgactatatgaaatgtccaggataggcaaattcatagggacagaaagtagattagtggttgccggatgctgggggaaggaggaggaggagtgattgcaaatggtatggggtttcttttggaggtgatgaaagtgttctgaagttagggagtggtgatgttgcacaacttagtgaatatgattaaaaacattgaagtttacaccttaataggataaaccgtatggtgcatgaatgatatcttaattttaaaaagagatgcaacttcatttaagaatattttgttcaagtttgtattccctccccacttcccttttttaatgttgattgaatttttcatacaatcacctttctacagaaggttttcagctaattggactcgggtcatcagtgggttatatttctaacaggctttttgttaagtaaaaagatcaatatatgaacacataaaatatgatgtagtatactgttaatatttgcatattaacatttaaaatcaagtactattcttatattgaagttggttagattttatataacgctgtatacaaataatactgatatcctatgcttaaaaccaatagccaaatatcaagaatcgagttcataaaactcagtgattaacctgtttattagttaaaactatgtatgtattaatattaaagatccatgtttcaatggagtgataggaaatgtgggggagatcaaggattctctaagtcttcataaagcagcttctctaaatattttaactagctgctgagatctccagaattatatattttgcattttatttcatctctatactaaaagtcatgcattaaaagtgtgtacaagatatatggggcacacttttcccttcagattatcaaaaacctctttttactcctgtattatctgaaattttgagcagagtttgttgttttttctttttttttttttttttgctgaaaacagaaattttgctcacgagttagttcaaatacatttatgtagctcccttatatactatcaaaggagctccaaccatctggtatgtctggaagacacttcagtgagtagaaattagaagccagcatttgaaattttctatcacagggacatgaaagcctaaaccggccttaaagggataagaggattttacatttttaaaaaataaatcaattaacattcattgtcaaataacctacaagaaagttccactagcattctgcaattgtatagaataagagaatatttgttgctaatgattacattccagaaagcaatatgtttagcagctgtttttcaaaagacttgtcaagttttactattgttatttaatccaggcataaatgtgtaaccttaaacaaaaactgtgcattattcaaccagctagtgacaaattatcttaacaaagtagattatcttttgcttttctgtacatgaattttttctttattaggcattttgtattccaatttttgttttagaatttagtgcacacgtagaaaggggaagaaacgcttttggatgttggtaattatgtacatcaaataatgtcatatatgaaattaaaagcagatcacaaaaccgagattcatgcctccatttttaccaaggggaggaaacaagagccatacagccagaataattcttcagaagcacactttgttatcaattatgtaactaaagaatcaaagtatgtatatataactgaagagttaatcaacagtaagaccgtgatctacatctgataccaataagaagctaagagtaataaatacctatcctgacattcactaagtaaataatgactatcattttaataatcattattttttctgactgttattttttttaaataggcaaaagagcaataataaatggcaaatgtggctccttaaaaagaagatagggatcaacccagttttcttcccatgaagaataggaacaagaagaaagaggtttaaattgctctgtgaggtatttcagttctaagattaagcttcctgataatgagtttacaaccctggaattgcctattgggagagagagagagaccaccttgcctgaagtttgtaaagaaatggagggtgacagtagtaatgcccaaaggcaaaaggatggatcagacaaatgaattccttttaaggcaccctttcagaaatggagttcttttctttgaagccaggaaagtttctttgttttgtctcttaaggatctacacttggcatcagaccattcaaagtctgctcttaattaaagtgaaaaagaactaatatttgagtgctaactgtttaccaagcactgtactttcaacttatctcatctaattttcacaataatcctgacaggtctatctcatagatgagaagattgatgctcaaatattgtgcttcgtctaaagtctcagctaatttgtggcatactagaactcctcacacctaaactagtgtttccccttctatataactccccacatcactctccaaagtgtcaaagtcagcaaccaccaccgattccgtcaggaactagaacacagcatctccaaaaattctgctttaaatcaatggaaaagtaaaattttggctcatacctcaagaagtcaaagaagtggtgactagcctttgtgctctgacctcttgtccaaaggagtccaagaaagtctcaatcaaactcaaatagatttgtcaccatacagatttaagaccaatgacttaaaaaaacaaaacaaaaccataaaaaaagaccaatgaagagccgtctatcagccttgcaagggtgaaagttattttgcaggtggaataatttgggccataggcttcaatagcaaaaattgcttacagttacctctaatttgcaagtcaaaaatacttgtttttattgctttccacataaagcaatttgacctcagttcttttaaactcatgtattctcaagagaatcaaaccaactaaggaaatgtcattgatacttttctaaaatagatcttgtggactgctttatgtcagtgacccaccagcccatctctcttgggagttggtctgtttgtgagaactttaacagaagattctgctctgttaaaaaggcctatcctaaaatcttgaaagagacacccattatttattaaacagagcaaggcctatgtttagcaagtgataaatgaatatacttcatgtaacttctactaaaacaataccttttgattcaacaggacatcaatgaatggaccgacaaagcaagtccagcatagggcataatggagggccagtctcttggcctaacaacgtgcaaccaacctcttccctgaaagataaaggtgggatgcacttgtggcagaagaacgaggccccattaaaaaaatcattagctatgaattaacagatatttaattgaacatgttatgagaggcaaagtactacatacaacatggaatttaggttaataggtcacctgctccaatctccaaccaattggatcctctccacatctttgcctcttgacagaggctattacctgaggcagactgtcccatagtgaaccaactttttgagaatggtcgccctgacatggaacccaaatctgtgtccctacggcctcattcagtaggcctcattccacccctctgaaccacagagcatcttgttctaatgcactaattgtattcccctctttttcctaacctaagtctccccaaatccttcaagtattctttaaatggcttgcatttaaaattccttcatcagactggtaatgcctcaatttgtttttaatttcaaagtatggctcctggaaatgataataacattccaacatcaagggactgaggagaggagatgaaatgccatctcccttactctaatgttgctatattaatatgtgttttgaagggatgataatttcttaattcagtatgaaaaaattaccagtgtgaagaatgtaaaggaaggcatctttccttccaaacgcaaataggctcatgccacagaaatgaaatccaaaaagaaagtaaagaaaacatatccctcccttatcccaaaattagtgtttaaccatgctgcttaaatggaacacattttgtctgaaggatgagaagcaaatgttgtttcacagcttttaattctttagcgaagtctcaaaagtatcatagtataaacatgtcaggaccatggttgagaaaagtaaccagttgcagttaaaacaacaacaacaacaacaaaaaattttggaaaaaaaggaatggcaaactctagaagatctctcccagaggctaatagagcaatgatccctaagtactcattactatgaaatacagagttctacaagattaagaaataaaaaagacattagatttttgccctaaatgacaggtaataaatctaaacttaggaacatttcctcacagttcaaaaagttctgcccaccttgattaacttgttttctgaatacctttagttgctggcttagtggagaaggccattggtttgatatgcaaaaaaaaaaaaaaagatttttttctgattgtgctatttcattcatgtggcttggcttaaaagaagatgtttcactttagtaggaagaccaattcaaacatcatttacaactgacgtttattcagtatgagtcatgaactgaaacttggtgtgggatctggtggaattatgggctagcttaaagggtaatgtggcaaatcattggcctaattctgtgggaatcaccagtgtcctcccaaggcatatattcatgaatgaaagaagataagaacccagtcctttgctaaatctggcgtctctggccaaatctaaacggcttaaataatcctcatccaaatatcttattttggccaatcgtttctaccttccttataaactctaaatcagaacttgacacattgtcaaatcaacccatttaactttcatttttagttttcttgccactttactcagggagagataaaaacgtgaaatgattaaaagaccgagaaaaagaaaggccaggaagaacccatggcctaatctaagtaatccatcaaaaaagataattggccctgtaaattcaaaaaatattaatataattcaacagatttaataaaagcacacaaagggagaaaaagccttctatgggcaaagaagcacaaaatcctttgaggatgtagtctatacaaagccataagaaaatatcattatcagcaaactattatttcatagattttcccaagcctgactccatgacatgagtatcatgcattttcactggaaactgaaaaaagttttgccatatatttaataactttattgaatgaagaaaaagatcacaccaaaaatggaggaatacatcaaccctggtggtcttagtagaccgagccaaattaaactatatgataaagcaatttctcttttttcatccaccactaaatgagagttcatttttatctaaagaaggctcatcttagcaaatattgccatgacaataagactgttaggcaaaccaataaatttaggttctggcctgggttaagatgactgtatttagtgtcctttctcaagttctacttgaaggaatttctgtttaatcaaaaaaagctcccccaaccactaccaccccaccttggcacttaaatgtttatttgactaatatttattgcacctacaatattgtcagggattgttttcaaacttcagatatattagtagacaagtatccataaggcctaatctggaattcatacaactaagaaaaaaagaaacaaagtcccacattctcatgtgttcctgctgatgggctgtggatgggtaagttatggaaaggctgggaggagcaacaaggaagatagaggccaagaccagagctttttaatccccttctgagtctggccaagggtatatagagaaggctaaaccctagggaataatacaagtgtgaccctaaaaggtattattttgcaactaaatcagtccaatctaacacagccatttcctctaagttcacaaagcaactttattttcaacacacttgcaactgtgagacaaagttgggtcatcatgtgctggggacactggatttttgccctaaatgacaggtaataaatctaaacttaggaacattttcttacagtttaaaaaaaattcttctgccctccttgattaacttgttttctgaatacatttagttgctggcttagtggagaggatggggagggaaaggcaacaattattataaattattttggtttttattaaaatgacttttctttcctgcagagacagattctaaaagaaaaacaagtcaaacttctgggatgcctttctctttcccacaggatcaggaaaaacacagtgaggccaaccaaaagtatcagccccttaaaaaatatgcataatctcatgtgcaagacactggtcaatctagaacctgctagagaaatgccagaaatgctttatccacatcatgtctctacatgactaatttctttacaattaaatagctttcaaacatcaacatatcagaactgagattgtcaccatctacagcaacagtggaattacacatcatatccttattccattactcatccctcagttatgctaagcagcaagctacagaaacatctgacagcatcaacagcatacaggtttaattattttcccaatttgcatttatatcagtgaacaaattggaagctatcaaagtatggcactgaagaaaaagaaacacatattcagcagcacatctcccattttgagtcctgtttttaaattggctaagtaaaggcatatacacctccatttgaattggagatttgcagtaacacaggcatataaggatgggagggaaggagggagggagggagggaagaagaaaaggagagaccagaaaaatagagaggaaaagagaaagaaaaaagaaagaacatatggttaagcgtctgaaggtaacattattacaagaaggaggggataaatgacagttcaatctgcttccacgagcagaatttttctaaggttatcatcgaagatataaaaatgggtcgtgagacttttcatctgttgctattctcacttatcatactaaaaaatctacaaaatcctaagccttggtctgtccaagatggagagtaccaggaagtaaaagatgtgacctactatcaaggactgtgctctgctaggagccctgcactacagtccattaatccacagtattttggtcatatctggtctgtttcctcatactactcaaaatgtgttagagctaagtttttatattagaatgtcatcaaccatttgtttatttttttcattttgcaaacgttttcatttacataaagggctggagagacaagaaagtggtagagattcagaggggaacataaaaggaaaagtattctcttttcccaaaaatccacctttaaaaaggtagtaatgagactttgagaaagagtgctgattcatggacttcccccatttttttatttctatataacacatttaaggacattaatgtactaaaacgtttggtctgtgaaatagcggaatcattagcaccaaaaggagttatggagcttgtatatattattaaaacaatgattgttactgttggtcatgggtaaaggtttcatttcatttttacatcccaaagttcttgaaagtgcctgtggacaagagaaataacacttttcaaaatctccatggggtcgtcaatacgcaccacagagactgtacttggccttcccagttttggtttatctggtagacaagaaaaccagggcccccagatgattaccaccgaagccctaaagaagagttcccacatgcacccactgatgtgcaggagggatccctacagtacatttccccccggactctgtttaggaatgcgcttttacttgctttttaaaaaaacaaaagcaacatgctctgcagatcatggagtgcctagtgcaattttctccttgctccaactccagactggaaaagggtgaaaccattatatgttctgctaatgctggcctgtggtcgaggcccttggcctgccatgctttgtaagctcaggagcccacaggagtcagaaggtcagagagcgggagccacagtcatcgccagatctccccagcatctcatggcccatcagggcagttgctgattccttttcttctccgtgcctcagcctttagttgaaattacaacaagtcaaatagctgatgcttttcccttctccaggtaagggtgaggatacattgttcacaagtgtgttctgtctggcttcactgatgagtcggcatgctaagtcaaggaagagtttctccacattatcagattccttggctgaggtctccagataatacatgtcctgagcttctgagaattcttcagctcgctgctgggaaacctctctcctttcagccaggtcaatcttgttgcctataacagtagtaaaatcaaataaagaatcagcatttgactttttgcaggctgagaagcatcaaaattcaactccatatctgaagtcaagccagacagatgggcgagtaaaacaaaacaaatgtgactgtgattactgaaatgtttactttaaaatatgagtgccagctgggcgcagtggctcacacctgtaatcccagcactttaggaggccaaggcgggtggatcaccaggtcaggagttcgagactagcctggccaatatggtgaaaccccgtctctactaaaaatacaaaaattagccaggtgtggtggcacgcacctgtagtcccagctacttgggaggctgaggcagaagaatcgcttgaaccccagaggcagaggttgcagtgagtcgagatcatgccactgcactctagcttgggtgacagagtgagactctgtctcaaaaaaaataaataaataaaaaatgagtgccattcataatggcaagaactggagacaacccaaatgtccatcggtagggcactgactgaataaagtatggcacatccacccaatggagtatttgctgccataaaaatcaattaggagtatttctatatactgccatgtaatggaaacactgggatatactgttaaccaaaaaaaaagcgaagcagaaaaaaaaagcatatacaatacgcaactgtctatccaagaaaaagggaaggatatgaatacatatattatacacacattttatttatttttttaatagaagactagaccaaaatcttaatttaaaagaaaatggttacctatgaaaggaacagggttgaggtgaaaggaatagaaaccagacctctctgaatatactttgttttgtagattttactttaggaacttaaaaatgctttatataattatacaattaatttcaaaattaaatttaaaaagcaatccctaaaaactgagagcaaaattaaacaaatgaacatgttcatcatgtgtggaataaccacacagaccgtaaccctttttttcttttaactgagacaaggtctggctctattgcccaggctggagggcagtggcgcgatcctgacttgctgcaactccacctcctgggctcaagccatcttctcccacctcagcctcccaagtagctgggactacaggcaggcactaccatgcccagctaattttttttttttattttttgcagagacagagtttcgccacgtccaggctggtcttgaacttgtgagcttaagcgatccacctgcctcggcctccagaagtgctgggattacacgcaattgagccaccgagccgggccaacagagtaactatttcaaggtgcttaagatacagtaatttaacagtgcaaccccagtggtatatagcctaaggacaaaaagaattgaaggaaacaatcttgaactgtttcagtaatcatctttttggtggtactgttggtattattattctgaggttgctatctgtgtattatgggataaagcaaatgagtaattatgctggtaccattgggaactgggacttttggcataggaaaaaggaaatataaatataaaattaatgtggttaagtaaaatttctgcagtcctgaattataaatagaagtatcagtatgaataattcatgatgtattttatctttaaaaagttttccacctacctcaaattctccaggaaacctgacaaaggtgtgtcaattgtattatctggcaacaccgcttatggtaaaaatgacccctgattgataaatgacttctggcctgggaattctatctaagaattataaatacctaatggaaagccataactttgagcttccctgaatgtggtgacttcatttgaagagaccctggaagttatgattgtggagttgttataatagatttagtctcctatggggtattgaggctgctaggccaaggcagatcctccatctgtttgacatgagccttgttccctcatactagaatcgtctgggggttgcggactgggtaggaggtcctggaaaattacgtggactgctactgggattacttccactgaagagggttgccggatgctgatctgctgtcaagctgtatttcctgtcctgtgtccttctaagtgaacacgatgccacgcgtggtctacggtagtcttgtgagtcggaacgctagcagaacctaataggaaaactctcttgaggatactacagaatccaccacacacatgcacacatacacacaagctctgtccactgaaaggcctaaaaacaatggcccatcaggagggctcctaacacctcggttgtggcctctaaatacgacttcccattgaaaagaaagcacttcttgaagaaatggctaattccaggtctggggcaggaaatgcacaagttgtggctggaacacttgtcataccagaaagcaaaaaaattatccaacattcctggggtcatgtcaaaaggactcaggagcccatttgaagaagctcccactggcaaagtcggaacaatgggagcatcaataataataattgcaagggactgaaatacatcaaatttacttatttagttagtttttgagacagagtctcgctctgttgcccaggctggagtgcagtggtgcaatctcggctcactgtatcctgtgtctcccaggttcaagagattctcctgccttggcctcccgctgggattacaggcatgcttggctaattttttgtatattttagtagagatggggtttcaccatgttgcccaggctggtctcaaactcccgacctcaagtgatccacccgcctcagcctcccaaagtgttgggattacaggcatgagtcaccatgcccagcccatcaaatctatttaaatctataaatttataataatattacaaatataaacagatgtcaatagttaacttttagaagatactggagaaccagcttattaccttgaaaagtggtgaacaaaaaagaatcaagcattcttcctgcctgttctatgagaactacccctcagagtatgatatatgtagtgttttgtctaaaaagaaaaccaaaaaaatcctgactctcatcaggcctctagacttatctataaatctgcaagaaatataggtgatggaggtgatatcaaatgacaccttggggcgataaaacaaaatttagacttgtaaagcctataggtcaaacaaatgcattagcaaaaaattctaagagagaaaaaaaatgagagtggaaacttcataaaaaaggatgaaaagatgtagctgtcaattacaacatatggaccttacttggctttttttttttttttttttaaagagtctggctctgtcacccaggctgaatgcagtggtgtgatcatagctccctgcagccttcaacttctgggctcaggtgatcctcctgcttcagcttcctgagtagctgggaccacaggtagatgccatcatgcctggctaatctcgctacattgcccaggctggtcagaactgctgggctcaagcaatcctcctgcctcagcttcccagaacactgagattacaggtgtgagccaccatgcccggcttctggaccttatttggatcttaatttgaacaaacaaacgaaaaaaaatcatgagtcgatcagggaaatttgaacactgtctaagtttttaaggatactaaggaattgttaacatattttaggtgtaaaaatgccactgaggttaggttttctttttaaaaatctattagagatatacacagatattgaaacatgaattaatacaacctctgagatttgcttcaaaataatctgagggagaaggtggacagcattgctagggaagagaaaataagattggtcatgagttggtaactgtgaaagctgggagatgtgtagaaggggattcactatactgtttctctactcttgtttatgtctgaaattttccatagtaaaattgtgttttaagccaattcctctttcatattgaactaactgtctcccctcaaatcttcatttaccttccttagataaaatcccaagtagtaatgctttgactcaagttcccaaaggctttctgtaaaacagaaggtacaaatgcagacctctcaaatgctttatggcaaaggttcaacattgtccaaaagggttttacagggagcactagctcatagaaacacagatgcttcatccagcagcctgaaggaaaagtccagcaatttgttacaacgtaacatattacagctggacaactacagggcttggagttgatcttacatgctatgtgaccttgggaaaagaacttcacctctttgagccgtggtttcctgatctgtaaatcagggatcatgacacataaagttcctcgtatcattcctggcacatatataccaattataacactattctaaagtgtttactgagcttattattaaccataatttgtaacttaacaatgcttctaaggatctctactcaaatttccctaattcaggtattgctagactatataggaacgttcctttctaggaagaaaatatgttaatgatcaaatggttactaacacttttccactacaaacagagaagtttttaatgacctggtccatttcaatgcatatatcagtcatgatagaaaatcaagggttgttttgtgctttccccccatactaaatagaggttttattctcctacaagatgaaacaaactacagcattgcccttagcagattctttctgaaacacagaatttctcaaatcagcctaaatgttaggaagggaaaaaaaattaccaaaatccaccttttaggcaataaacaattgcttcaataatgaattccatatcaacttaaaagatacatttttcttctagaacagccattcctttcatcttgtaattagactttttaaatttttagcagctcacataactttcatggccatccaacttcttccctagagcctacattgatagaaaatgttttctactttatttttctaaactgtcaccatgggataggacctatttcattttctcttcaattgcagaagaactgaaggttgactgcatgaattattagctaaagactatattcttggaaggcaccaatgtataagctttatgtgattataaatcctctaatgcccacaaatcaatttccctcctcgttagcccttacttacccactaacacagtgatgaccttgttgctggcatattgttctatctcccgcagccactcaggaaggcaacggaaggattcctcacaggtaatgtcataggtgaggatcaaggcattggcgcttcggtagtaactctgggtaatggaccgaaatctctcttgacctgctgtgtcccagatctgtagctgtaaaggcataagataagaatcaggtgaagaaggatcaggttggagaaaaaaagaaaaaaaaagctttgccttgctttggtttgaaaatgggtacacctttacccaaacaatttcatggttattttctgccctaaaaaaaaaaaaaaaaaaaaaaaaaaaagcactgaaaattaaaaaaaaaaaaatctgttgggtgtgtttctggttagggagaggggcttattttgttttgttttgttttttctttgttaagagtttccttttcattcttaaaaaaatacatataggaaattcgtcaagcatttattatgtgccaagctctattctaagcattttacctgtggcaactcacttattcctcacagtaaccctatgaggtagatactatcataatacccatttcttgcatgaataaactgaggcacagtaagattaattaacttgttcagcatctcatagccaatatgtcccagaaccaattcaaccaggcattgtggtcccagagtccccgttcttactcacaatgccatattacaaaaggcatgatacagggcaagctgtgactgttggcatttaatcagcaactggagggagagccaacctcaccacttttccagttcaaaattcaaatggatgtattaaggtattatctttgttaaagaaaacaggaatcatgccatggcagacaacaatataattttccttcaggtctcttaagttctatgaccttggccaagtcacttaatctctttgggctttgattatttctttataaaaagtggttaataacacacaacctgctgaaggttcactttttctgcagttatctaccagttctaagtcctaataactaataattctaataacaaagaagaagacaatacttgtcaatttccctgcacagagtagacaactactgaaaacgaattattctccagggtggctgctaagtgtagaacaaaacacaaggccttgagaaataagaacatcaacaaaaacaataatctttccttctaattgcacgaatttcacaggtcacaggtgtattcatgtccagggacataagattgcttcctcaggaaggctttccagaaccttcagattaggctaggttccccacccccccaccccacacagtctctcttgcgatacatcctgtcattctccctcatggcacctgacatgcctgaatcatttatttgtaataatttgtttaatagccatctttcccactaaactgaaagcttcatgagggagacgtcagggtccatttagagcaaatagagcacttggcaaataggaggtgctcaaatatttactgatggtctcatttaatctttacaacaatccagtgaggtaggcaagtgtacacctccccgtattaatggaaactgtcccttaactaactggttattcacaaagctaggacatggcatccaggccttctatttccagttgaggactcattccatgctcccatgctgctgttgccaccaaagactaactaaaatgtgcatctgtatccaaagaggatgaatccattgctgtcaccctctgctcatactagcttagctaaagagactgctgagtgacccgtagtccctgccatgaatcagcagcacacaaaggctctcctttgatctgcagttgcagctgctcttcgatgatacacatgaaagcctgtgtatgctaaaggccactgtacagatgttacggtttttgctgggacaaaggctatttctcttctctgcctcaaacctagggacacggttcccctctgccaggatgtgtcttagaataatgggctattgttttaaagctgcactgagcccctaaaacacttgtgattgcgatttaggaactgttcagtattagaaatcagtgtgttcccacatcttgagaacagcttcgagggttaaagtcactgaaatattttctagaacagcgattgtatgagcatgccaagatatgttaccttctcatagggggctgcctgtttctagctgacagttgattattgaggatattcatattctactgcctttgtcactcaacttggtttcaccattctctgcaattcatttgcgcctttcggcatctataggacattaatatatgcaaggtactgtgctaggcacatggagtatataaagatgaataaaacacagggaggatataaagatgaataaaatcaacgctgatttcaaacagctcacagtctatagaaaggacacacacagttaattaactatagcagaatacaagatgttctattaaaaaggaagagagcgtctcctgctgttagtctcatgcctgtcaatatgttttcaatactgtagccacgggctttctaaccactctcaccttcagcatgtggctacattgtttgtctactctcttctctgcaccactacttaaactccattgcctcaccgtcataataatgtactgcaatcattggtttactactctactactgagttctttgagagcaaaggctgtcttttatttgaccttacacccccagtaccttcctaacacagcacacagcacgtggtagaaacatttgaatgatggctaactaaatgaacaaaggattgtggaatcacaagggaggaactggtcaattctacttaacagattagtagggtattaaagaagatttcacagatggagctagatgatagtaagttcctaaggggcagggatgctttaccaccacagtgcttggcacaaaacatttactacaacacaggatggaggaatgaatggatggacagatggttgaagaaacaaatacatataaatactttcatgactctcctatctatcaacatagatctgactggaaagagatacagcaaatcttctatttctattatgatttatctcttaaggctaaaatggtttaaattgagcttagagtttttcttattactcattaatttataatagactaaaatatatatgagaaagttctgtgttttttccattttttttattctgctaaaacatacataaaatttatcattttaaccacttttaagcatacagttcagtggtctatatatgttttaattatattttctaccagaggtcaccttcataatgcagacccttttaagagaagggcctcttcattaattttgtttttactgatttggcgcttacttggccttaatagctacaaaaatctaataccttggattccctgccttcaatcctgggagccatcctggaaaaaatgatacttgtagaggacactgatgagggtgtcaggagagtggtcctgccactcaccaagcgggtgatgccatacgaatcactggtggattctcttatccactgactttatgaggctctgggaaagcccgcaaactactagcaaaaagacactttaacatcactgagaaaagatactcagtaaatgttaaagaagaaggatgacaggctggatgtggtatctcatgcctgtaatcccagcactgtgggaggctgaggcagaaggattacttcagcccaggagtgatcaacatggcaacatagtgagaccccatctctacaaaaaataaaaataaaaatgaatagctgggcatggtggcacacacctgtagtcccagctacttgggaggctgaggtgagaggatcacttgagcctaggaggtcgaggctgcagtgagctgtgattgcaccactgcactccagcctaggcaacagagcaagaccctttctcaaaaaaaaaaaaaaaaaaaaaaaagatgacaataagacaactatgcagttctgccctcttctaagaaaggattaaagaagttgttcctcatatgcctacatgttaatgaggcccttaaattcatgtggttgaagagggccaccctgtatctttattttatatattgggcttgaaagaatcacaggcaagttgatttggactggatttgggagatgagccaactgtcactttttatagataaagttctagaagcctgaagaagtactggggatagaaagtgtgctgtgaatacaaatatgagtaagacacaaaccttgctcttggggagcctgtggccttatggtggagtcagatgttataaaaatatcaatttttgcagtgtaataagcactttttaaaataaggtttgcagaaagtagaataaatggaatatttatgcctgggaattcaggaaagaaaaataagcctgttctttaacagcagggaccattccttattcacccttatttatggccagtgcctggaaggtagtaggcactaaatcaaataaatgaactcatatatatatgaatggaaaacccaaatatctggaagtaaaatgcatgaaatagtagttatctttacccaactccttgggtaactacctcccctccactaggacaacagaaagctacaaaaggctcctcccatcaatgcctcctgagcacactcctgtctctctttcctgtccccacagcctagctccttcttcccaccccccacactatttttgttcactttttagttagcatttatgtggatttcataccctgcttttatcttccagtgctccagctccccattcactgctgtatttggtgtggatgtctctgcagtatgagctattttaaggagtcagggctggaagagacactgagagagcttctggcccccattcaaggacctcctcctaaacacttctctgtgatggcaagtatctagaaaatgctgaagagcattatggagcttctctgctcttcccaaggcactcaaaggaaggagagcatgtacgtatgggagaaggatgcaaataaatggacccaaacataggatgcttaggttgggaatcaaggtagaactctaaaatgccagttttcattgtgctgctgatagctgggctatccttcctttccttccttctttccatccctcccccagccttctctctctctttctctctctctgtcaccaacacacacacacacacacacacacacacacacacacggtctcgttctgtcacccaggctggagtgcaatggcacaatcatggctcactgcagactcaacttcccaggctcaaacaatgctctcactcagcttcccgagtagctgggactacaggcgcatgccaccatgaccagacaattttttatcttttgaagacatggagtctcgctatgtcttcaactcctggcctcccaaagtattgggattataggcgtgagccactgtaccaggccttggctatcacttctttccataaaacccagctctgaagagccaactgtggaacttcagtaactctgacggcaggtagagcacagtgccaaacatcagtatatttatcctccttccaggtgatttagtctcccttcacatttctttccatcaccttcctcctttccttgctccaggtgataggcctagtgtgcctttcttcccttcttctttcatggcagaggagaccccagaaaggcagtggggtgtactggttggtgaaatgggttcaaatcctgcctgtcccccttcctatacttatctatgtgtagccatggataagtaagttatttaacctctctgaagccagtaaaacgaggataataccacttaccccacaggtttacagtaaggactaaactaaatataacatatgtaaaagcacccagcagaggcactgacagattgtaggtactcaataaacattctctcctttgtcctgttcctggacacaccatacttcttccaagtaccaaatcatccagaagccacaaaggctggaggggcaggaagcaggggctagagagcatgtatcctttcccatactcctcatttagtgtctttcctttttagagacaaggatatgagaggagacaggataatttaaataagtgattcataatgaaatgtagaaatcgggaggctctttcatggggctgctgtttagaggaggtagcacctgcttattggcccagctcaagagatccaaaaagaaatttcttccttatctttatgtcacttgtgacatgacaggagacaggacaaacttgccttagccattttctgtcttctaatctgtaaacacatcatccaaaattccttccttcccccataaaaaagactagaagaactctggaaataagccattatggctgagtgcattgtttccatgtgggtttcaattaggagatttaataaatggttatgaaagcagtacttcccctaacctctcacatagcacctgacaaccttagtgaatatttagcaccttacctttactttttcaccattaatctccactgtcttaatcataaaatcaactccaattgtggctccttgacctggggggaaaagaccctgaagaagaaataatagaaaagaacagctaagcaaatatttccattaaatgaaattttctcctctcccccagcaacacccatcaccggagtccttccttcagctgaggtgactggtagaaaagagaactctggttactctcaagggagccctgtgcaactctgtatgtatgtcttgagggaaagagaaaggagggagaaagtgggagagagaaatgctgaaagaagaggaaagagacaggaggacagagaaaaggagataaagacaggtgaaggagaaaattgagaaagggcaggggaacctgattttaagaatgaaaaagaaaaatcagacacgaagataagattgaagggcatgcgaccacagggatgagatcagaattggaagggtcagggcaaaatggataggttctttctaaaagataaaatcaaggatacttaaaactagttatcagtcttgagcatggacagccacgggaatgggcaacaatatgaaaaaacaaataagaactcagcatgagaagcgggaataagacagttttgggatctgtctttttggatctcctgaagcttctgaattttcctttgccccagggtgatcactgttttcctcagtacaatgtaccatgcatgtgtaattacatgggatcaaagccaaagacactgggaagataatctaagaaaattaagtcatcaaggagacagtagggtagaaacagcactaaaccaggaggcagcagccttaggatctctgtgtaacctcaaacaaaccactcaccctctctgggcctcaaattcaatgagtttgaggctgatgtaagccattttaaaacaaataaacaaaatgctttacttcaaactggaaacttaaccagaaagatgagattttaacaaaggtacaagtataatttatgcaatttactattacataatgtttcctatacgcttagggagggagttgggagtagcaagaaattctgtcaagaaagaactcttcacccagtttctcttccctcttcacttatattccagaatttccagaaattaaagtaaaatggacgttattagttctggcaactatgactcagatatctttaattaagaattatttaaagttttagcttaaaagactgaacttcaaaccaaaagaaaatgttctactgcatgtttgcaaaagatgtaaatataaacattcataactttactttcaaatattgaatcaattttcttctattttggcttggctcagatacaaaagctgtcaagcttcaagtttatagctccagatgttttgcacc

SEQ ID NO: 184 - DNA, 78340 bp, Homo sapiens
ccagtgcaacctcatttagaaaactcattttccttatccacatttcaatactcagagttgtgtaatgggttatggtttagacctctcacctttcttccctgctgctgtgggagcctactatgtactaacatatactgttcacaaaatagctgtgtgctgcagacaccagccactactcagatgttccatatatatatatatatatatatatatatatggagaaagagacacacagagagatatttattatgaggaattggctcatatgattatggagactgatagatctcagcacctgcaggctgagtcaacaggcagaagacccaggagagccaatggggtggctccagttagaaagctgacaggctcgagaaccaggaagagccaacattttagtttaagcatgaaggcaaaaagaagccaatgtcctagttcaaggacagtcaggtgggagaaattccctcttatttagaggaaggtgagccttttggttctttctattcaggccttcaaccaattggatggggtacactcatgtcgggaagtacaatcagttttattcagtctactgattcaattgttaatctcatccaaaaacatcctttcagaaacatccaggataatgtgtgagcaaaaatctgggcacactgtggcccagttaagttattcataaattcaccatcactcagggttctgtcaccttccttctaatgttttcttgggctaacttcccaccctcattaaacccagttaccctccaaatacctgtcaagcaatgaggttcttcaatgcaactcctttcaattgttcattcttctactatggatgattgcagtctcacctaataataacagcactgagtgcttaatatttgtcagttgttgcgttgagtgctttagctaagtcatctcatttaatcttcacaaaaaacatgatgtggggactcctattaccctcacgttgcaagtgagggaattagggcttagagaggataaatcacttgctccaggcttcacagtgggtgaacagaagaatagcattagaacctaggtttttctgttcacatagcccatgatcttttaaaatatattttgatcctttatgttcttccaatttttaatattttattctgaaaaatttcaagtcttcattgttttcttctgtagctcaagcttttataccactgccttctaaagcatcatgtaattaaggaaataactatatataaggaatagtaggcgcaaggagtactcacctcgttgatgaggagttaggaaagcatcacagaagtgggcagctaagcagaaccatgaggttgcttagtggtttgcaagagaaaagagtggcagactatcaaagctgagggaatacatgcatgaaggacagagggatgcagaacacagcaagtgcagagggtgacaaggagcttggccttgcttcaaagtgccaggaggaaagagtcaagagatgaggctgaacaggtaggcaggaaccggaataccattagatgagactgtattgtccaacataaggagagagatatggtcagatgacattgctgagggtccctccagagcatgcagcaggatgaaggtggcttgggtggggagcatgttagagacaggaaagcattgagggatagaaaggatggtcacctccattcttcacagaattagaaacaacaactttaaaattcatatggaaccaaaaaggagcccatatagccaaggcaatcctaagcaaaaggaacaaagctagaagcatcatactacccgacttcaaactatacaacaaggctacagtaaccaaaacagcattgtactgatacaaagtcagacacatagagcaattgagcaaaatagagaactcagaaataagacagcacatctacaaccatctgatctttgacaaacctgacaaaaacaaacagtggggaaaggattccctatttaataagtgatgctgggagaactggctagccatatgcagaaaattgaaactggacccccttccttacaccttatacaaaaattaactcaagatggattaaagacttatgtgtaaaacccaaaactataaaaaccctagaagaaaatctaggcaataccattcaggccataggcacaggcaaagatttcatgatgaaaatgtcaaaagcaattgcaacaaaagcaaagtgtgacaaatgggttctaattaaactaaagagcttctgcacagcaaaataaaccatcatcagagtgaacagacaacctggagagttggaggacatctttgcaatctatccatctgatgaaggtctaatatccagaatctacaaggaacttaaacaaatttaaaagaagaaaaactcattaaaaagtgggcaaaagacgtgaacagacacttctcaaaagaagacatctatgcagccaataaacctatgaaaagaagctcaacttaactgatcattagagaaatgcaaatgaaaaccacaatgagataccatctcacgctattcagaatggcaattattaaaaagtcgagaaatggcagatgctggcaaggctgtggagaaataggaacacttttacactgttggtgggaatgtaaattagttcaaccattgtggaagacagtatggtgattcctcaaagacctagaaccagaaataccatttgacccagcagttccattactgggcatataccaaaaggaatataaatcattctatcacaaagatacatgcatgtatgtgttcattgcagcactactcacaacagcaaagacatggaatcaactgaaaagcccatgtcttttgacaggctggataaacaaattgtggtacacgtacaccatggaatatcatgcagccataaaaacgaatgagatcatgtcctttgcagggacatggatggcacttgaagccattatcttcggcaaactaaagcaggaacaggaaaccaaacaatgcatgttctcacttataagtgggagctgaacaatgagaacacatggacacagggaggggaacaacacacactgcggcttgtggtggtaggggtggagggaggaagagcatcaagataaatagctaatgcatgctgtgcttaatacctaggtgacaggttgataggtgtagcaaaccaccatggcacatgtttacctatgtaacaaatctgcgcagactgcacctgtatcccaaaattttaaattaaattgaaaagaaaacatagtcatctctctggtcagttctaaaggaaagcatactgcagcgatctgtgatgctgtgtgatcagataggctcaaatagactgattaggaatacatgctgtgggaagtcatatccattgtcccctcactatccactcaagttaacataatttagctaagtctcgtcagttatatgaattcattatttcactcaaaaatgtatacttgatgcctgcttttccaggcatttttcttggtgatgcaggtacagagaggaatccaaagtgttcctatcctcatgaaactcacattgcagtaggaaaaagttaaaaaaaataacttcataaataaaatagtttcaggtggagataagtgctgtgaagaataaaatagggtaaagtgagtgagtttctgggcagaagatggagataagtttagaaggatggttagggaagaccactctgaggaaatgacatgcagaaaagtgaattgaggaagggagttcttcaattcatgttccacaacacatggaaagaccctgaggcaggaatgaggttggtgtgttcgtggaagggcaaaaggccagggtgtctggagcaagctaggaggtgagtacagggaaatgaagtcagagagagaagctgggccagggctggcaggtcagggtaaggagaaaaagtccttgaggaccagcctggcaacagaggccaaaagagtagaaagccttctaagcaggggctgatttccttggaggacggatgtaacaagaaagacaaattttctgagtggggaataaattcatcagagcaacattcagtatctttatttaaaaatgacctgcgaactcttgggctgatgttgatctgccctgacttattaatattttgtgtgaactttgaaggaaagcaattctgtgaattcctccaagctgtaccttttatgtattcatttctttcttctctgtagaaaggaatagacaaggagttttacctactgttcacagtctttgatgagaatctgagcagatattttgatgaaaacattcagaagtttatctggcatcccttcagcattgacaaagaagataaagagtttgtgaaatccaaccgaatgcatggtatgacaaatgacattcccgcctgtaaatgaaaggctgacttgcattagaagtgaaaatgattggtgtgtttgaattatattaattttggtttcttggatattgttcttggtcatgagtaagttatttcatgccttcagctttagatggtatggtgaaacctccctatctctcagagatgtgaaatttaatacttctagagcactttatcagccttagatgaaggaacacaaattttaaactagcggccaggcacagtggctaacacctgtaatcccagcactttgggaggctgaggtgggcagatcacgaggtcaggagaccagcctggccaatatggtgaaaccccgtctctactaaaaatacaaaacttagctgggcatggtggtgcgtgcctatattcccagctactcaggaggctgaggcaggagaattgcttgaacccggaggtggaggttgcagtgagccaagttcgtgccactgcacagcctgggcgacagagtgagactccgtctaaaaaaaaaaaaaaaaatttaaactagccaagttcacagtatatcataaatgtagaaaattactgacaaactactctcccttgggttcacaataacattaagtctgaaaaccaaagtgacaataggagataatcattacatagcaaagtgtctataattaagtagtatgaatgatttaattaagtagtatgagtgactggtgaatgttaatttgtgaaacactagctgttcctatcccagatcttcatttgagaggaattacttaattctctctccctgtctctttgtatcaagtgttacaatagcaaaccacctgctaattgcttgtgagtaacacaggatgtcattactcttaggcatattacctaaggtagcagagtaatgagagtccaaactcaatgcctgcaagagtgtgcagtcaataaaagtgcccgaagcaagtaacgtaagacaacaggtgctaacctgcttgttttaggacccagcataaaatctatttattgccttttaaagcattatggaagaataacaaaatagcccttaacctcccttccttgcatggaagtaaaaaatagtccaaggttacaagtgccccatggcaaccaggtcacagaccctatggtcccagatgctcatttccaacagagtcccctcttgtgccaatggaaagcatggagtagtacatttcagtgtcatcttctacaaaaggttttgctgtaactgaatatgaatattgtttccaaacttcttagtagacaatataaaggggaaattaaggtggaaataaggaaatatagcagtttcttggtggagaaactaaattgtaaaagaaatttatcatcaaagaggttggtcttcatttaaaaagataataaacaactgaatgaactacatcaaatccagccccaccctattttggcaatgtgaaactactttcatatttagaaatacaatatatagtccaggcactgtggctcatgcctgtaatcccagcactttgggaggtcaaggtgggaggatcacttgcatccaggagttcaagaccagcctgggcaacttagtgagaccccatctctacagaaaatacaaaattagccaggtatggtggtgtgcacctgtagtcccagctgctactcaggaggctgaggtaggaggtaggaggatctcttcagcccgggaggttgaggctgaagtaagcataatggctccactgcactccagcctgggcaacagggtaagaccctctctctgtttaaataaataaataaataaataaataaataaataaataaatatataaatacaggatatatcattgttaaaacaaagttcaaggcaaataatgcatcttaattcaaatgtcacattaattataaactaagttctagcttcagtcttgcttgcagggagtggaaggaagacagcaacaaagccaaaaagaaagggcctgacatggtgcacaatgctttgtgttgtgtttattatatagtctgtattcaaaatatgtttattgaaagaaagaatggatgagtgactgttgtagaaagagaggctttaaacaagcattccaaggcaagagaagattctctaccagccagccaaggactgaatttattagcaccttgatttatactcagatttcattaacatttgatggacaagatttagatcatttatttgcaaagacattatcaaagatttttttttcataaaatgtggtgtccttctcagaagtgccagaatttcttggaatttctaccaataatcccagatctgagtacaattaccaagcaccactggttttgcagacacagaaatattaggatagtacaaaagtaattgcggtttttgcaattactttcaatggcaaaaactgcaatcacttttgcaccaacctaacaaaaagtaattttatttgacaatgggattataacagaaggtcactcatgtgcatgataatagttccttcctgctataggcttagtagagagcaggaggggggtagaaatatttatttctccaagaaacatcaagcatgagacacaattatgtgcatttaccagtcagacattgcgttatatcatggctttcatccccatggggtgagaatgcggtttctaaattcttgtcaaggcactttttcagatagccactatcaatggattggggttgatgtcaaagataaaaacaatttgccactctggaagcacagagggtcttcatatctaactaatcattatttattaataaagtccctccagtaattgtactggggtaaggaagtacgagttatcataaagcaaatttatttactcaaagactaacctcatataagcttaagtaccccctaaaaaacaatccttctccactaactgcatatgcacatatactgtcaattgatttaaaaatctttcaaataatgctgaatccatgtaatcagtaaaagcatgtctgataacttctagaatcaaatgcaaagcccactggcaaatgagggtcttgtagaattcaatgaattaataactgaggaagagacatttaacaagggagatcataggaaaataaccacaaaagaaaaagattttcatatcgagagccttagagaagagtatggggaaattatttcataaacaatctgatttatcccttagtcattcttagaattagtgtccttgcatatgtgttgttaaagataacatttaaataatttccttatattttcattattcattgttaattttggtctccattttaagtggattcaccatgtggcttttccctggtactgtttattctctgaaaacaaggatcttttgtaaacagtttacatatttgaagctcccctgccccatacacactgataatttttcaccgtctttcttcttccatttagctgttaacggctacatgtatggcaaccagccaggcttaaacatgtgtaaaagggatagagtttcctggcatctgattggattgggcactgacactgacatgcatggaattgtttttcaagggaacaccatccacctacgagggactcaccgagactccctggccctgtttccccacatggccacaacagcattcatgcagccagaccatgcaggtaaacttgctgggtccatctcaggtgaccagatttctaccttcaggctcatcctcttagagttctcccacagaagaaattggtagactttgtgcacttcaagtggtgtagaaatagatatagtcttgattagaatcagagaatcctgacttattagtccaaacacatagtataagggacaaaggggaaatatctaaaatagcatccacaaaacagaagtgggagccttctaaagtctttggtgcataaatcctaggagaatgtttttgattcacagtccataaaaattcagccctgataaagtggatatgttttgctctcattgagcatgaacataatttcagttgcttctctgaagcatctaccaggcatggacatcccagtggatgcttccagattacagatgtagccataactgcagcctggtctctcttctgtaggtactgataacagccttttgattgggggaattctctgttttcattctgttgggcacccttggtttcccaacagggcaagctgcattggatctggaatttatggagacccctgtataatgccagtacctggaacttcttctcttagagattccaagctaatgagataattggggcgttttcataaaagatctagagcaacacgtggtagcacatgctaatcactgcatgaaaagtgaggagaacaagccctatagacattgaacatgtttttccaaaccaattttttcatcagtcttaacaagaaaccaatatgctacctaagatgagtacttgctgtttactaatggatgttctacttctttgctttccactggaactgcagtttagatgtctctgtgtcatcaattaagaacttgaggcttgggcttcaaaatctttgcctaaggactgcctgagactaggagctccatagtcttttctatgtgaacttttcctagtgtccagtctctgtacattagtatagttgatcaattatgaattactcaaatcaagagatgccttggacacaacttttttttttaatacgctcttcaagaccaaagagaggaggggattgggaaatagccaaatcattttaattcatagaaataggcactcaaagttagagctgcccagaataattttagaaatggagctacttattctagtgctttgatcattactccatgtgtcctatacatttctaaagagcttcacaacagtgttttccagtttatgtttggtgataagcataaatctgtgactgcttaaaagcttagtcatttcaccaattcctgtcccttacctataagtcaagaaggagggtgctcaagagtgggtagagtagactatatgctgcaactcaaacatttccatgttcttctattattattatcattattattagttttgttttcttcttcatgctaccttgtctaagatcctctttgttcttagaggagacaattcctcaactattgaagtgccatgatcaatacataaaaaataggcttcctggaaaaaacaaatgtaggggacagtctttccaagtctgtcttcaaaggtatcttctctgtggtttcatataaagacccttcctcatgtgtcctcatcagtgcctgggtgtgcttggtacccattgaatcaacccattgaatttttgctcatctaaaaggagtaactaggcgatgtttagacaacagagttacatgtatagcaagatagaggatacctctgtacattgtagaaggttaatgaaaggtacactcatccctcacctctaaaaacagaggctactagagaaaggggagaaagatttattgatccaatattttcattgagagttaatatcttcaataattttatctgtcttatgtgattttatggtgagttaagaaatatctatctgatgccaatgcatctagaaaattcaatctaaaaattacataatttttgacagacaggattgtcagtattatgtagaaaaatctaattgattgtttttctgttttctgtttccttttcatttagcataatgtagacctatcattggaaatgagaaacttctttgctcaagggcttaatgaagtaatacatttggctttaataataataacacttacatatttattgcactttagaatttatgaaatcctttagggcaaaatactcatcagaaatatggcttaatttgaaccttgtctaggataatcatcttacaggtaattagttctttttaaactgggctggactaagacagtcattggtgattttccaggacagactgtcttctaataggtgtgaattatatgggagacccagaaaagtcatttcttggtagcaatattgtaagtttctttttttataacaaatgaattttggacagtatctttctctccacagaagtaaatatattcaaagtaatctataccccctggggtctgattttaaactactagacaactggtattttaaaaatccacctaactggttattttgtaataaaatatgcaggtttgctaaaaacagaccatcaccaacaaaaataccgagcaccacactcaatgccgagccatttctcttgcaggtatttttagggtgttttgtgccaccatgccccacctctcgagaggcatgggtcagatctatgaggtcagcagctgtgacaacagggacccttctgagcagcggtacgggatgataagaactttttacatcgccgctgaagaagtagaatgggattatgcccctaacaaaaactgggagttcgaaaagcagcacgtggacgcaagaggggaaaggtaccacaggcgccgccgctagggctcctcggtgggatcgcgcatgctccgtaggtctttagtaagtgtggctccctgcaaattcccaggttgtgtctccacagttccggccgacagagacttttacttatgtgcacagattagggaagctgcccacctcggcctccggaaggcagcgtgcggtgtctcgcaggccctcggcgggctctgctgggtggtcatgggatgcagggcgtgcctgggagtgcgtgtgcagggtgaaaaggctgagggaaagaggcagatcacatggttatagtggggctgggaagacaaaaagggccagagaaggcagagagggtgtatgatgtggggtgagaggatgggctgctgtggatgcaggacctcaggaaaggttgaggctgagccactggcagagcgctgctctaagtgggggaccaccaaggagggacaggaggccattgccttgtaagagactccgggatcggggtaggaagaacaggtttctctactaggccctgtgcccagaaagtctgcaagactggccctcccttaacagtgctgttggccagtgatgcatgcccaagactcagcagctctcaggccgccagcagccttgtaagcattgctcctccagggcgctaagcccagagtccaggaaccaagatccctagggtgcactgggatggagttaaacaagggagaaggcaggcgcagaccacagacctcctcccccagggctaatcccctccctccacagcaacccactgcctggtattactgttctgatatgcagatgaggaaacttggacgcaaagagttaaggcgcccaactagacattggcagagttagaactgaacatagatcttttgaaagacaaataaatccacgttctctccggcacactacattgtccctcctggcccagttcctctttgttctttattgccacctaccctcgccccctgccaccatactcccctcccctcacctcatagacatcctccgtggctgcgagacaaacacgacatgctactgttcctatcttaacacaagtatttcttttcttatttattggcctttgttttgaggggctgtacttatggaaaagagattataatggttctaccttctggatacttttttttttaagatttcccttaagaacaggagaattttaaatccattcaattactcactaacctatttgttaggccaaacacctgtattctgcaaaactagtgctgccaatacaagctgaagactggtgctggtacagtggaaaatgaaatgaattccaatctggccctttctaaaatgattatttcattaaaaggctaccataactaaagaaataattgtataataactttgtcatgtgtacaatcttagcccatgaatgtataaaaatatagcctttatgatgttcatacaactaatatgaactcctactttaagtctccatcccacggggctagcaggaaggtctagcttcagtcttctgagactccctcccaagtgacataaggagataaaatgtgctggtggggaagggggtgcaatgccataattacaccttcccctgtcactctgattcttgcccatacatagatgaaagcaaagtgagataaggacaagttcacatgttcaaagtttaacaaatgctgtagataacaattcagtatggaattgaaatggcagttctcttagggcacatctgaggcatgtctgtagataagagcccagtgacacataccccttctgcaccctagtttctatgtgtctgccctttgtcccatggccatggtaggagcccatctggtttttgaaccatttgtgggtacaggctatccctgagacatttattatcctggtcagcacaggccctctgccccaccttgggacctagaagtctttctttggggcttcctaaaacatgctgggaaggtctcagcatcccagaaagccaacaaatgggaccatcggtacaatgtccaggggaagtttatgcagtgggaggaaatttgaaaacagaaattaagttgctatgaaaaaataaagttgtattcctagtactcctgagcttgtagactgataggtgtgtgatttagtcatcctgagattctccacaataaaccactgcctattgagcagctactgtggaccaggcattctgctagggattttacaaaccttatctgacataacccttacaacacacctgacctactccaccagtttttgctcagcatctcttgcaccattctcacaagatgatgaaaaagcaagtgcttatatagtgctgaacatgggcctgacatgtgctttacagatactgactcacatgaccctcatatcaattccatgaggtagaggaattattatcagcctggtttgcagtggagaaagctgggaaacggtggaatgtggctacaggttctgcactggtcactaccacatgtaactgggtctcctgaaaaatgaaagtagaagaaaagttctcttcccttggaaatcatacagtctagggtggaagtatacatgcatttattaaatacctactatatgctagacattgtgcaatgtgctggtgaaacagtatggaggatagacaaggtcctttcccacacagaattcctggtccatggtaagactttagaacaagtatgttctatgagaggggaagggtagagtgcaacaggagatatggcagaagcacacagccctgtcttgaggaaaggtagggagaaggttggtagtcggcgggggcttctgggaggaagtagtctttgagttgggacatgaagagtagtccacttgaagaggaaggaagcatgttcgtggcagagggaacaacctgtgtaaaggcctggaggtgagggagagcacatcatgttcaagagagtgaatgtttagaatgaccagaacatagagcctaggggctagtgatgggaaatgaggctcaggaggtggcaaaagcagacagtgaggcttgagagccaaattgaggagtttggcagtgggaaatcataaaaaggcttaacatcaacgttgttaaatgtatagcttaggatccctctgcctgcagtgtgtgaatagagggcaaagaggagtacaggtggcagggaaaatgattaggaacaattccacccaacctaggtaagtattacaagtggctgagataagaatgaaagctccctcaatggaaggggtgggtctcactgtattttagagataaaattaaaagattttaaaaatctgtcttttgtgatgatctgccttggtaatagatgaaatgtactatacatgtaaggtacgtatacagtctatcctcgttatttgtagattctgcttttgcaaatttgcctacttgctaaaatttatttttaaccccaaaatcaattcctgtgacatttttgtggtcatttgcaggtacatgtagagtggcaaaaaatttacgttgcttgatgcacacattttcagctgaggtcaaacaaggagtctctctgccttcttgtttcagctctcatactgtaaacaaatgtccttgttttcagattatttagtgccatcgtttttgcacttgtgtgctttatgttggtgctttcactgtttaaaatgcccccttaaacagagttttgaagcagtgtcctcagtgtaagaagcctctgatgtgccttatacatgtgagaggggctttgttcctgcatgagttacagtgctgttggctgttgagctcagtgttaatgagctcaacagtgttaatgctgttgagctcagcaatatatattaaataaagtgtgtttaaaaagaaacagacataaaacaaggttatatattgatctgttgatgaaaatattgtgaccagaggtttgcaggaacctaaccctatattttccctaggaacaatggttcagtctttattagtccagttatcacaatgactttctagaacataactagggtgaataacaagtatcaactgtatctatctatatttgtatatggatgtatacacaatacatgactatggtccttcttgagatccttcaaagtggaaaagcattaccatgtacagaaagatgcatatgaaatctggagaaactcagggtggtagagggtggacgtgtatgtgtgtgtgtgtgtgtgtgtgtgtgtgtgatgacacacacatgaagatgcaagtgtgtaaggttagatggtcccagaagagaggcgcaacctcaaaggatacttaggagtctctgaggttggccctactcagtgcttagcagaagattacaaccgtgatttccaagggtgggccatggactggtgctgggctgcccatatcagaactgaaggagctttaaagtgcagatgcctggcctcactcccagaaagtatggtgcaaaaggcctgctccccagggagcacttgatcacagccaggtttggggagcacttctccagaatacccctgaatcacttagaagcgctcaaagcttttctgctttctgacaactttaatttctgatgcttctgatttgcagacatggagatatatttatgaaccgcactgaaaattggattggctctcagtacaagaaggtggtttacagggaatatacggatggagaatttgtggagatcaaagcccgaccaccacgagaggagcacttagaactcctgggtatggcacagatttcaggcgtgcactgtcagccccaagcatgtgcatgcacacatactcatgtgttctgttacacttgtggctaagaaaggatagaagaaacagagtagcttgactgcattcctccaagtgtaatatcttcctgctctaccattatcagggagtgtgctgagtgctcaactcatacaaaaactagtcataataggactaccagataatacacaaataggaatccatgacatcagggcagtctaactggtgtatgataccctaaagcttctttccaacccctatactgagccaggaaattttcttttaaatcctccagcagatatatatatatatatatatatatatatatatatatatatataaaactttaagttctagggtacatgtgcaccacctgcaggtttgttacatatgtatacatgtgccatgttggtgtgctgcacccattaactcatcatttacattaggtatatctcctaatgctatccctcacccctgcccctaccccacgacaggccctggtgtgtgatgttccccttcctgtgtccaaatgttctcattgttcaatttccatctatgagtgagaacatgtggtgtttggttttttgtccttgcgatagtttgctgagaatgatggtttccagcttcatctatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttataaccctttgggtatatatccagtaatgggatagctgggtcaaatggtatttctagttctagatccttgaggaattgccacactgtcttccacaatggtttaactagtttacagtcccaccaacagtgtaaaagtgttcctatttctccacatcctctccagcacctgttgtttcctgactttttaatgatcgccattgtaactggtatgagatggtatctcactgtggttttgatttgcatttctctgatggccagtgatgatgagcattttttcatgtgtctgttggctgcataaatgtcttcttttgagaagcatctgttcatatccttcacccacttgttgatagggttgtttttttcttgtaaatttgtttgagttctttgtagattctggatattagccctttgccagatgattagattgcaaaaatattctaccattctgtagattacctgttcactctgatggtagtttcttttgctgtgcaggagctctttagtttaattagatacgatttgtcaattttggcttttgttgccattgcttttggtgttttagacatgaagtccttgcccatacctatgtcctgagtagtattgcctaggttttcttctagggtttttatggttttaggtctaacatttaagtctttaatcaatcttgaattaatttttgtataaggtgtaaggaagggatccagtttcagctttctacatatggctagccagttttcccagcaccatttattaaatagggaatctttcctcatttcttgtttttgtcaggtttgtcaaagatcagatggttgtagatgtgtggtattatttctgagggctctgttctgttccattggtctatatctttgttttggtaccagtaccatgctgttttggctactacagccttgtagtacagtttgaagtcaggtagcatgatgcctccagcttagttcttttggcttaggattgacttggcaatgtgggctcttttttggttccatatgaactttaaagtagttttttccaattctgtgaagaaagtcattggtagcttgatggggatggcattgaatctataaattaccttgggcaatggcagtatggccattgggaaatggcagtatggccattttcatgatattgattcttcctatccatgagcatggaatattcttctgtttgtttgtgtcctcttttattttgttgagcagtggtttgtagttctccttgaagaggtccttcacatcccttgtaagttggattcctaggtattttattgtctttgaagcaattgtgaatgggagttcatgatttagctctctgtttgtctgttattggtgtataagaatgcttgtgatttttgcacattgattttgtatcctgagactttgctgaagttgcttatcagcttaaggagattttgggctgagacaatggggttttctaaatatacaaccatgtcatctgcaaacagggacaatttgacttcctctattcctaattgaataccctttatttctttctcctgcctaattgacctggccagaacttccaacactatgttgaacagaagtggtgagagagggcatccctgtcttgtgccagttttcaaagggaatgcttccagtttttgcccattcagtatgatattggctgtcggtttgtcatagatagctcttattattttgagatacatcccatgaatacctaatttattgagagtttttagcatgaagcgctgttgaattttttctaaggtctgttctgcagctattgagataatcacgtggtttttgtctttggttctgtttatgtgatggattacgtttattgatttgcattatgttgaaccagtcttgcatcccagggatgaagcccacttgatcatggtggataaactttttgatgtgctgctggattcgtttgccagtattttattgaggatttttgcatcaatgttcattagggatattggtctaaaagtctcttttttggttgtgtctgccaggctttggtatcaggatgatgctggcctcataaaatgagttagggaggattccctctttttctattgattggaatagtttcagaaggaatggtaccagctcctccttgtacctctggtagaattcggctgtaaatatgtctggtcctggactttttttgtttggtaggctattaattattgcctcaatttcagaacacgttattggtctattcagtaattcaacttcttcctggtttagtcttgggagggtgtatgtgtcgaggaatttatccatttcttctagattttctagtttatttgcatagaggtgtttatagtattctctgatggtagtttgtatttctgtgggatcagtgatgatatcccctttatcattttttattgcgcctatttgattcttctctctcttcttctttgatagtcttgctggcagtctgtcaattttgttgatcttttcaaaaaaccagctcctggattcattgattttttgaagggttttttgtgtctctctctccttcagttctgctctgatcttagttatttcttgccttctgctagcttttgaatgtgtttgctcttgcttatcttgttattttaattgtgctgttagtgtgtcaattttagatctttcctgctttctcttgtgggcatttagtgctataaatttccctctacacactgctttaaatgtgtcccagagattctggtatgttgtgtctttgttctcattggtttcaaagaacatcgatttctgccttcattttgttatgtacccagtagtcattcaggagcaggttgttcagtttccatgcagttgagtgattttgagtgagttccttaatcctgagttctagtttgattgcactgtggtctgagagacagtttgttataatttctgttcttttacatttgctcagtagtgctttacttccaactatgtggtcagttttggaataagtgcgatgtggtgctgagaagaatgtttattctgctgatttggggtagagagttctgtaggtgtctatcagctctgcttggtgcagagctgagttcaattcctggatatccttgttaactttctgtctcattgatctgtctaatgttgacagtggggtgttaaagtctcccattattattgtgtgggagtctaaatctctttgtaggtctctaaggacttgctttatgaatctgggtgctcctgtattgggtgtatatatatttaggttagttagctcttcttgttgaattgatccctttaccagtatgtaatggccttctttgtctcttctgacctttgttggtttaaagtctgttttatcagagactaggattgcaacccctgcctttttgttttccatttgcttagtagatcttccttcatccctttattctgagcctgtgtgtgtctctgcacgtgagatgggcctcctgaatacagcacactgatgggtcttgactctttatccaatttgccagtctttgtcttttaattggaacatttcacccatttacatttaaggttaatattgttatgtgtgaatttgatcctgtcattatgatgttagctggttatttcactcattagttgatgcagtttcttcctagcatcgatgatctttacaatttggcatgtttttgcagtggctggtactgattgttcctttccatgtttagtgcttccttcaggagctcttgtaatgcaggcctggtggtgacaaaatctctcagcatttgcttgtctgtaaaggattttatttctccacttatgaagcttagtttggctggatatgaaattctgagttgaaaattcttttctttaagtatgttgaatattggcccccactctcttctggcttgtagagtttctgctgagagatccgctgttagtctgatgggcttccctttgtgggtaacccgacctttctctctggctgcccataacattttttccttcatttcagctttggtgaatctgacaattatgtgtcttgtagttgctcttctcgaggagtatctttgtggcattctctgtatttcctgaatctgaatgttggcctgccttgctaggttggggaagttctcctggataatatcctgcagagtgttttccaacttgattccattctcctcgtcactttcaggtacaccagtcagacgcagatttggtcttttcacatagtcctatatttcttggaggctttgttcgtttctttttactcttttttctctaaacttctcttctcacttcatttcattcatttgatcttcaatcactgataccctttcttccagttgatcgaatcggctactgaagcttgtgcattcattatgtagttctcgtgccatggttttcagctctatcaggtcatttaaggacttctctacactggttattctagttagccattcatctaatcttttttcaaggtttttagcttctttgcgatgggttcgaacatcctcctttagcttggagaagtctgatcgtctgaagccttcttctctcaactcgtcaaagtcattctccatccagctttgttctgttgctggctaggagctgcgttcctttggtgggggagaggcactctgatttttagaattttcagcttttctgctctgttttttccccatctttgtggttttatctacctttggtctttgatgatggtgatgtacagatggggttttggtgtggatttgctctctgtttgttagttttccttctaacagtcagggccctcagctgcaggtctgttggagtttgctggaggtccactctggaccctgtttgcctggatatcagcagcggaggctgcagaacagcgaatatttctgaacagcaaatgttgctgcctgatccttcttctggaagcttcatctcagaggggtgcctggccgtgtgaggtgtcagtctgcccctactggagggtgactcccagttaggctacttgggtgtcagggacccacttgaggaggcagtctgaccattctcagatctcaaactctgtgctgggagaaccactactctcttcaaagctgtcagacagggacatttacgtctgcagaggtttctgctgccttttgttcggctatgccttgcccccaggggtggagtctacagaggcaggcaggcctcctcgagctgcggtgggctccacccagttcgagcttcccagccgctttgtttacctactcaagccttagcaatggtgggcgcccctcccccagcctcactgccaccttgcagtttgatctcagactgctgtgctagcaatgagtgaggctccttgggtgtgggtccatctgagccaggcaccggctataatctcctggtgtgccgtttgctaagaccattggaaaagcgcagtattagggtaggagtgacccgattttccaggtgccatctgtcacagcttcccttggtcggaaagggaattccctgaccccttgtgcttcccaggtaaggcgatgcctctccctgcttcggctcacgctcggtgggctgcacccactgtcctgcccccactgtctgacaagccgcagtgagatgaacccggtacctcagttggaaatgcagaaatcacctgtcttctgcgtcgctcacactgggagctgtagactggagctgttcctattcatccatcttggaactaccccctaagaatattttaagaaattgagagaaaattgaaaataataaccgtccaacaaattttagatttatatatacctttctcagaaaagcaattaaaaccatggcttgaatcagcaaggaattgatatgtgtggccagaccaccaactgtcagtgtatctccctgtgaatgtagaatgcaccagatacccaagagagagccatagggatcaggcacttctgaaatgggagtctactgaccatgaagcagtgcacaagtcatgctgccacaggccctctgagccaggtgtgggctcatctccattggcacccagcctggttgcttccaacagaaatgcacacaccagaggggctgaagagtgcttgtctccttgggtaaacaaatattgagaaacagagttagatgtgcatttgtgaagtcactatattaatcataaattaatacataaatgattttatttccctctactctttcagattccttttacacacattatttcattggatcttcattattattgtcatccatttaccagataatgaataatttcagacttatcaaaggttatacacagggggattacaactgaaagtcaccatatcatgtggatatggcttttcctggagatgatttctcagtagtaaaaaagcatttaccaagtacttatggtgtatcagtgcactgaagtaaacacttttagatacattatcttattcaacccttactataatcccacataaaagttattactaaactgatgttacagatgaggaaactgaaactcagacagattacatcacttacccaaggcccctctaataaatgaaggaagcagaatttaaacccattgctaaagactacatgatatttaatactacacaatgttgctctctaaagtggagtagagttatatatgcctttctcggaaaaacaactaaagccaaactattttatttgactaactactgcctatatttaaattacactaatgttgaaagagcaataataatgcacacaggcctgtgttttgcctttaggcccaatgattcatgctgaggtgggcaacaccgtcctgatcatatttaagaacaaagccagtaggccctactccatctcagcccagggtgtggaggagatggatagtggaaagcaattccaagtgcccatgacaaaaccaggtaagttgtgtcagaggtctgctccatcttgaagaagaacattggcgtcaactcttttctggtctcagaggtgtcttaaagagctcatcttaatgtcaatgtgtttcagccatcatctagtcactctggtatgagatcatcattcatccaatgaccaaatgtttaggaatttctagggttccattagaaacctccattagggaccccattgtcaacatcccccaccagagtagtacatttgttgtaattgatgaacctacattgatacatcattatcccctaaagcccataatttacattagggttcagtattggtgtgtatactctaagggttttgacaaatgcacaacaacatgtatccaccattttagtcctataaagaatagtttcactgccctaaaaattctccgtgctctggtgtttattttttcctcttccttaacccctggcaaccactgatctttttactgtctccatagctgttcttacagtagctcccccttatcacggttttgctttccttagttttagttacctgaatcaatcttggtctgaaaatattaagaaattttgagataacttcaattagagacaataaaaagatattttgagagtgagagtctacattcacatagcttttattatagtgtactgttataattgtcatattttattattagtaattattgtcaatctcttactgtgcctaatttataaattaattataggtatgtctgtataggaaaacacatagtatatataggtatggcactgtctgtggtttcaagcatcccctgggggtcttggaatgtatctctcctggacaaagggggactactgtagtaaacataaaaattaacacattaactgccttcaaaatgaagcattatcctgtgtatttaatgacattatttcatttaatcctcacaacaattagaaaactatgatgaccaacccactttacagataaggatactaaaggttagtgacattaggtagctggtcaaatgtgggataaataggaagtcatagggttgagatttggaactaggtctctctgattctggttctcaccagatctcacctgcccacttgagaagcttttaaaaaacactggcaccagagtcctagaccctagactctctgatttcactgtctggggtgaggcctgagcagcaagggcttacaaagctccctggtgactcccataagaggccaaagcagaggtccttgatgacaaagatgtgctcaaggacagctcttgggaaggagataaaacatttaaggaggaaaaacagtgaggtataaaatgtttttatttcctgaatacacaccagttgacaatagaaaaatgcaaactagagggaaggctggagcctgaaatgacaaatctgccatttcattttgaaatagtagaaatcaagatgggagtttaataagaacatttgtaatgaatgagtaattctctccagcaataaacattaatgaaaatatataaagacctgcttatatttcttcagataaatcatctgaaacacagataattctaataaattttttccatttcatttattacaggagaagtaaaaacttatagatggaatatccctaaaagatccggtccagggccttctgatcccaattgtattccatgggtttactattcaacagtaaactttgtgaaggtaaggtggagaaagcaaccaaaaggcttaaaataatttggatgaaagttgactacttgggtcatcacaatttgggttggtatatgtgaaagcgtataatgatttagagcaagggtctcatactatggcccatttacgaaatctagacatgctggacgtttacattgtcaatggttgacttgagtagctgcaacagagactatatggcccacaaagtcaaaaatatttactatctggtgattttttttttcccaaaaaaaaaaaaaaaaaaaaaaagtttggtgacccttgacttaaagtatggggaataaaaacaaaatcccaatgtttcaattaccaaatttagaacttaaaaagataaaaggtttgaagcaaaagaggatatgtaaatatacaacaataaaataaatataacttagagtacaatttatgtatggttttggatgtgtgaaatctgtttattttaaatgcattattatcagggctactagggctcaggagaagaaagttcactctaaacatagtaactgaaactacaaaattgtttgaatgattaatgatctaactttgaaataaaaggcaaagattcaacattgaatttgagccaggtatgtgtatgtaaaacaaccacagtctttaattacatgccataaaccaaagtccaatctaaagtcgttatttgatgtaaaatgtaagcattgcctattaaagaaaaaaagggagggattatcataaccttcctcttaggtattagatggcttgtattaatgtctttgagttatactggacagttctagagttcaggagatagaaatacaaggcacttgaataaataaacttacatatgagaattatgggaaaatccaaatttatttatgcatcacaacaaatacttattgagcacttgtgatgtgcaaatgaccccaccaaatactatgagagatgcagatactcttgtcttaaagaaacttataactttgtgggaaaataatatgtccacacttgtaactgtaatagagctctgaatctggtgaattctataggagtggcaggctaactaaagtactatagaaggttttggagggagagtctaggaagaaagagcattatgagcacagctgaaaatagggaagtagagggagtgtttgggacatgttgagagtcccatttggctatcatatggggtccagtagtaaatcaaggggtagcctaagtcagaaaatttcattaggggagcacatggagggctcacagacctgcaagggtttgtatttaattctgtaggccacggaaaatcactgaagacttctagatacgggagtataaagattactgtgatggtggtcaacaggatgggctggaggtggggtgaatcagagctgagagaagaatcaatttctagtccagggtgaggtattatgaccctacactagaatggtggcaggtggaatgaaatattattaaattacttaatggctcttttaactcagtttattttttcttccaggatacgtatagtggtttgatgggtcctctgattacatgccgaaaaggagtcttgaatgaaaagggaagaagaagtgacgttgattatgaatttgctctcttgtttttggtatttaatgagaatgaatcctggtatctggatgacaatattaagaagtatctcaacaaagatccacgagattttaagcgcactgatgattttgaggaaagcaacagaatgcatggtatatccaaagtttaaaaagaagcctatgttgagataagctcataggaattcctgtaaatgtaggaggctcccagcatccttctctgagcctttcctccttcccaggggcacctggactgaagaaagtcctctaatgctttccttcagactgaaccagcctagccactgattggctggcagcaaagtcattgaggctttgtactaacttgtagggacatgtatttctgaatcctgggatctctaagctctaagactgtaaagtaattctttaaaaacaaatcatcatttattgtcatatttttataagaatatgccataacttctatttgtttaaatttaagggccaggtttaattgtctctgggatatgaaacactaccatcaaatttctgttttaatgtatctgtgttacttctacataatttaaggtagtttgttggtgggagtaatgtgttcacattgacacatccacagtttctcaccaacagctatttttgaccaaaagtgcacaaaaaggccttgcccaaggtcacaaagctacttgttaatatagattagaatatagtagcctgattccccattcagctactctttcccctaccagttttgctttcttctcctaaagatgtcttagtatgctctccatttttaatgaatgcaggtcatttggttgcaccacaatgcacagaatcaaaagtcagtagacagtggaggagtgggagtcaccatcatgtaaactcagtttgctttggtcattgttaggtcatgagctcagcccgtgtgaagctctcttttatttttggagattcagccaggcttaaactattctcaacaagtgaaatattaagaaaataccttctaagtcactcaatttttatttacataaacttgtttatgccttgatttgttctctgtagagtggtataaatctgactacctctccaatgagactgtatttcccttcataaagagattatgctgaataaacaaacaaaacactgccaccaagatacggctttaaaactgctatttctctgttctcgctctctttgtagaaggatttctcagttatctgaattttgggtctagaatggtaggacactgctaggggtgagtgagattgttgcatgtttactagacagatgaaaatatcagtgacctaaagatcttctggaaacatttaaaaaatcagcttatcttttaactaaccaaaggttattttcttatcaccttttaaagccattaatggaaagatttttgggaatctccatggcctcataatgaacgaagatacaatgacaaactggtatttgttagggataggaagtgaagtggacatacataccatccattatcatgctgagagctttcttttcaaagtaagtataaggaaagtgctttgggaaagacgtttttgaactaacaaattcaatgtatttccagtggaaaataagagttacttggcaataatgcttgtgaggataggtgagaatggaacagaataatgtgattgtaccgtttccctggtggatatttcttttctttttttttttttttttgagacggagtcttgctctgttgcccagggcggagtgcagtggcacaatctcagctcactgcaagctccacctcccgggttcatgtcattctcctgcctcagcctcccgagtagctgggactacaggtgtgtcccaccacgcctggctaattttttttgtattttttagtagagacggggtttcaccatgttagccaggatggtctcaatctcctgacctcgtgatctgcccgcctcggcctcccacagtgctgagattacaggcgtgagccaccacgccaggcctggctatttcttaatatgtatatgtatattattgtgcttataaaaatctctccaagcctcaggtgagagttttctcattagtgatctggggataactctgaccaccctggaatatgctgttaatattgtatatgaaaccacggacactgacagcattcgtcccttttcctcacccttccttttttctttccctttccttctccccacccttttctttttctgtgtgattagctaacagaatagctctatccagtaaaggagctattttgagctctggcctaagccctgaaactttatcttgacttttgccctagtgagctgggctggaccatgtgtgactttctaccctctagcatcaagctgtaccatatgggtggtgctcactgtacagcagagccatctggggaactatgtaaaaacccaactgccaggcccgacccagacctgctgaatcagaatctccatggaaaggtccaaatagtctgtcatccgaagttctcagtgctttctacaaggaagtggaatagaaaagaacaatcatatccaatgtgtggagaaaactggaattgatcttttctagttagacacgaataaacggtaactttaataaaacatttaatatcctttctcctttgtatatttcaacgttgtttacgacaccaagtattagcctgctatgattagagtttcacatattaaatggctatgctgcttttcagaatttggcttttttaaactcacattttaaaaattatattaaaaatttataaaatttaatacacaaaattataaaaatttacatatacactttaaaaataagatataatttacattgaatacaattcaccatatttagtgtacagttctcttttgataagcacatacagtagtgtaacgaacaacaatcacaatatagaatacttttatttcccccacaaattttaccattgcaccctctagtgtcaactacttccccatacttaacacttgtcaaccactgtctctatagttttgccttttttgaaaggttatgtggaaatcataggttgtagcatcttgaatctggcttgtttgatttaacataggcattcaaattgtatccatcttgttatgtgtatcagtggtttgtttcttgtgactgttgagtagtattccattgtaaggatataatgcagtttgtttatctattctcctgttgaggaacatttgagttattttcaagtttgtttattacaaatcaagtcattacaaacatttgtgcacatgtttttgtgtgaacatatgttttcattttccttgagaaaatacctagaagtaggattgctaagccatgtgataagtgtatgtttgatttcataagaaaccaccaaactgttttccaaaaaggcagtatcattttgcatttccaaggaaatatacgagaactccatatgttgcacatccacatatgcagttggtatttttagtttttatttcatttttttcccttaggcattccctccttggggaggggatatagtggtatctcattgtttttcatttacattttcccagtggctaatgatattgagcatcttttcatgtgtttgtttaccatctgtcatctgtaaatctttggtgaagtgtccaaattgtaagcccatttaaaaaaattgggttacttgtttccttattgtagagtttgagggctttatatattctggatacaaatcctttttcagtgatgtgactcacaaatatttgcttccagtttgtggcttatcttttcattctcttaacagctttcaaatagaagttcttaatttttgatgaagtaaaatgaagtacaatttttcttttttctcttttatagatcatacttttggtgtcatgtataaaaaattttggccttactgaaggtcccaaaaaaggtctctgttttcttttagaagtggtatagttttagatttagggctctgatacattttaattttcatatgtggttcaagatatgaaataaggttcatttttttttcatatatatgtccaaatgttccatcaccactcattgaaaagatcatctttttttcccacagaattgactctttacttttgtgaaaatcatattgaccacatatatgtgggtctatgtctgggcggtctcttctgttacactggtttatactctgccctttcttgaatgccacaatgttttgattactttagtattatagtaagtctcaaaatcagatggtgattgttttagctattctagatgtttgccttcccagataaattttagaaataatttgttgattttgatttttaaaatcctgttgggattttgattggtattgcactgaagctatacaatgggttggacagaactgacataacaatattgaggcttccaatccatgaacatggtatatctatcgtttagctcttctttgatttctttcatcagcattttgtagttttcaatatagagatcttgcatatactttgttttatttatttataactaagtatataaaaggctttggtaatagtgtaaatgatagtgtttttattttgatttatagttgtttattgccaatatttagaaatataattgatatttgcatgttgaccttgcatcctgcatctttgctaaactcactttagttccaatagttttcctatagattttagggggattttctatgcagacaatcatgttgtctgtgaatagacatggcttcatttattttcaatctgtatgtcttttatttcttttgtcttactgcaatggctaggacctgtagtgcaattttgaatatgagtggtgaaagtggacatcctcagtttgttcttaatcttacaaggggagcatttagtcattcacctttgaatataaagttagctgcagcttttttgtggatcccattatgaggttgaggaaatttccttctaaatttgctcagagttttgatcatcaacaaatgttaaattctatcaaatggtttttctgcatctattgagatgatcagatgctttttcttctttaatctgttgctgaattacatttattgattgtggagtttttaaacactttttcattcccaggataaaccttacttggtcatgatgtattattcctttttgtggaattgatttgctagtattttgttatggatgatggtatctatgttcatgaggagtattgattgtagctttttttcctcacaaagcatttgtttagttttggtatcacagtaatgctggcctcataaaatgagttggaactgttctttcctcttctattttccagaacagtttgtttacaattggtattatttctccattaaatgtttggtagaatttgccaataaagccatctggagtttaatttgttggaatatcttgaagcaattacagtttctttaatagatatagtgctatccaggttatcaatgtattcttgagtaatcttcaggagtttgtgtcttttaagggatttgttcataccatctaagttgtacaatttttggataagaggtgtttgtccagtatttcctttttaatatttgtaagattttagtgatgtcctcactttcattctcagtatttttaatgtgtccttttcccttttcccttggttagtctgtccagagatttgtattagttatctattgctgcataacaaattactctaaacttagagtaattcttggatcaggaatttgggattagtttaactagttggttgattcagaatctttcatgaggaggcaatcaagatgtcgactggagctgcagttttcaaaggtttgactggagctggaggatccacttccaaacttactgatatggttgttaactagagggttcagctcctgatcatgtggataagacatgaaaactggcttcctccagtgagtaatccaagagaagagggtgacagagtatctaacacagaagtaatgataacctaatcttggaattggaatgccagcacttcttccacatgctattgatttcgcataccaacccttatacaatgtaggtaggaaccacaaaggttatgaataccaggaggtggggatcattgtgggccatcatggaagctggctactacagaatttattgattttattgatctgttcaaagaatcagttttagatttctttgacttatctctattgtacttctattcttgattcctgctctttcttatgtccttccttttgcttactgtgggttttatttgtttttgctcttctttctgttcttgctgttctgagcaaagaaggctactagctgttgttttttaaaacgtttttgcagatagataaatcttaccgagaagatgtgtatgatctctttcctgggacattccaaaccattgaactgtttgcagatcacccagggacatggctgctacactgtcatgtgtctgaccacatccatgctggcatggagacaacctacacggtccttcgtaacataggtacggttgtctgtcagtgatgccagatgatggcaccgagcttcctgtagacccccaaaacaggaggcatgacaaaaacccagatatagccctcaacaagctcagagtcaagtaagagagacatatatgtaaatatgtaactataatcaagtatgctatgtgccgtagcagaatgcagagtacagggcttaatagcagcagtaggagtgaatgggtaacagttggaggatatgagccaaagtttcacagaggccatgatgctccagatagactcagtgggtgagcagaagtgggaaagacagctggggcaggaaagcatgtacatgggaatgaagtagcacagtaagaatccagaaatgattggcagatactgatgggataagtcctcgctggtgaaatgaaatgactagtgtcatgaaaagaatccccttctgttgttaataaaacaatgaacttgttttctttgtgcagacaacaggattccttactccaccacatctcctggagtggcatctcacccagccacggtgccatctaacggtaatgataccctctccccatgtaaatgagtcaacatttcacccctcaaaaatgtcaggggcctgacaagtttatctttttcacagaacgacctggcaaagagcagctctatttctttggcaagaatctgggtccaacaggagccaaggcagccttggtcatccttttcatcattggactcctccttctaatcaccacggtgattctctccctcagactctgctctgcaatgaagcagacagattaccagcaagtccagtcctgtgctctccccacggatgctctgtgaaccatctggtctccctcaacaggaaagggtgatgtcccacagctggccagatggcagccaacagggaaactggaccaaggcatcactcaccaaggaaggttgacactgtatcctggatcagccttctgatcctctcaaacatcatccaaagcaatttgcttttatttatttatttttaaatgggctgcgaataatcctcaggtataaaacacagaaaaaggagaatgggcatggctgagaatgtcaactcttagtctattctttggttggattcactgaataggagacactctgaaagatatctttatattccatcttttataattcttgaacagtgctttcttagctaaccaccaaagtttctaggtgaacagcttctagaaaaagttagagtgcctcagacatttaactggaagggcactactttttcaacattgttgcataacatgcatcccttggttctgtggaaaatatctttcttaggagttcttggcaatgtctaagtcagtgtctgctgatagaattagaccaaataaattttttggaggctttaaccagctctcctggccttttcctctttgatataaatagcctgtgcagtgcttgttttaaaaagcaaagttatacgttttttaaaaaattgctgctgtttttattcaaacctgtagaaatacttgaatgtttacaactcacttcatgttacatgtttttacaatatgtttctgtggcaatgtttgtactttcaaaaatcaagtagagaaattgtatttctactgcagactgtgggagggctgaaatctgtaaaagaacatgttaggctctccctttatgaatcagggactccctgagagtttagagcaagctttctatcagggagggaagctttgcaggaggcaagtctgggcttgaatttggagtctgatttttcattcagttagagggaatctttacaagtcctcatcttctatgaaattataacattctcattgtatgagaaacatcaggaggaatttatcaatgtaggtgactagataggagaagggacctctaaatatcctagattctatggcttttaaagacatacctcttcatggaaggagaaaaaaggaaaaggaaaggtgagaaaaagataatcttggtggcagattctcttaaaccattaaaccagctttgaaaattaataaataatttccaaggttcaaatgcaaaaaaattattgaacaactaaactcaacccattatgaggcaatctacactgtccatacctatgcttagacagtaggtgtaagattgataaaagtaacattgtttattacaagactgagaaattgcttttagctctgggcgagatgccctgagattccaatgccaatgctagatgagtgatactggtatgcctgccttagcagtgggtaatttgaatgtcaaagtgagtgacaaggacctaagaaatattctggtggagggacctttcacactgtctcatcttcatcttcatgaggggaaatgggtaattggatagaagctatagtcttaacataaaaggggatgcaaatgctaatagttctgttcatagtttgcttgaatgtcatatcaaacagcatacacaaaagattttgaatttcaatctgctaaccattgacaatgtgatttcatagtacatgttctacagttttcatacatgtgtaggctgcataatttcataattatggtaaatgccttatttattacccaccttagtaagacaagttgttcagttgtttttttttcttttcagtttatttttttaatgaaaacaaaaccacaaagtagtttgattgcatcatttatcattttaataaagtgtcacataaggtggctatttgcatggttattttcacttaaaattatctatcactgaactaggggaggtggttaaagtggaattaatttttagatatttaggggctatgactatgccaatgacacttgttagaggaaatgaaacaaaatagtgtatctccacaaataatatgacttctcaaacattgtttcctcaaacataactacactccttgttctcagcctcactcttgagaaaatcaactctgccttcacttacacacatatttcttcctattacaatacacgtgtccctgctcctagcaggacagtctcttcatttgactttgggtctcattgcttcttgctttctcaagacttcattcccttgggtatccatttttcctcctgcatctttctatgaaaccatcagcaatgtccgccattaaaaacagaaagcaatgtgctgtcttatttaactctataaccccctccgacacagtttctctcttcctttgatagcagaacatagaggtattcacacttggtgcctgtactacctcaccccatgcattcctcagcccattctgatggctttcaatccagcgtgcccagcccccacaccccaatctgctgtggtagagatcaccaatcatgatgccatttccagtggcttcttctccatctttatcttactcaacctctcagcaacaagaaacagctccttccttctgaacactcggagtctctagtcccttggctctgcaacatgactctctgccagccttccttcttcctcaatgactattccttctcaatctctttttctagttccttctcttctgtctgacctaaatgttagcatgcctcagaacttgacactgggtcctttttcgctttttaccctctgtggtaggctgaatattgccccaaagatgtcatgtcctaatccctgaacctgtgaatgtcaccctatgtggcaaaagggactttgcaggtatgattaaggatcttgaagataggaaatttatactggattatccataatggccctatatgtaatcatgagtgtccttatgaaagagaggcagtgggagatttggctacagaagaaggcaatatgacaaccaagacaagatgccatgctgctggctttggagatggaggaaagggccatgggccagggaatgcaaggaatgcatctccagaagctgggaaaggtaagggaaaggattttcctctagagcctccagagagaggttggccttgcagatatcttgaaactgattttggacttcagaggtccagaactgtaagagaagaaatgtgtgccaacaagtttgtggtaatgtgttaccagccactccatagtttattttatccatccttatgatcggaaaaccatttttatgcaaacaaattcaaaatgtatttctctaaccctgaccttgggctgcagattcacacaaatcctgcttgagtagggccactgcagcagtccccaaaccagcctctccatcatcactactgctcctttccaccactgtccacacattgcctcacgtttttccaaatttcatcactttcctggttactaccctttactgtcttcccatttcacttttaataacatccaaactctttaccttggtctttaagacccagcttgacttggcccatgcccactcctccaacttcttgaactctgctccagctttcatccgctcctatactctgctagttctttcttgcctcagggcctttgcacatgctgctttctatgcctggaatgctctccctccctagcttcctcattccctctctgtattagtcggggttctcttagagggacagaacatatatatatatatatatatatatatatatatatatatatatatatatatatgtaagaggataataataccggtcttgtgctttaagatgattaatctgccagtcatgtgtagaatagatcattttatatatatatatataatatataatgatatataaactcattttatatgtatataatgatataaaaactcattttatatatatatataagttcattaagtattaacttacatgatcacagggtcccacaataggctatctgcaagctgaggagaaaggagagccagtccaagtcccaaatctggagaacttggaatctgatgttcgagggcagggagcatccagcatgggagaaagatgtacgctgagaggctaagcccatctctccctctcacatttttctgcctgctttatattcactggcagctgattaaattgtgaccaatggattacgggtggatctgccttccccagcccactgactcaaatgttaatctcttttggcaacacccacacagacacacccaggattaatactttgtagccctcaatccaatcaagttgacactcagtattcaatatcatattctcctagcttttctagttcacatgtgggttcccctgacttccctctctaaagtgggtccttccctctgttatttactatcttcactgttttcctttgcagcacttattacaggacataatcattttatgtctgttggcttaagttttgtctgcctctttggctggaatgtagctctgtggaagcaaggatgcctgacctgtttggctcaatgttgcatccccagcagagatcatagtacaaatacataatagtttatcagcaaatattcattgaatgaatgaatatataaagagattaggcagtctactgaacttcactattttgacttagactattttggttgcaaaactctcatattcaaatgtcaaggttctcaaacaagtaaaacagagttctgagagactgcctatgagtttcacaacctaccttggcttcttttttgtttgtttaagacagagtcttgctctgtttcccaggctggagtgcaatggcacaatcttggctcactgccatctccacctcctggtttcaagcgattctcttgcctcggcctcctgagtagctgggattacaggcatgtgccaccatgcctggctaacgcctggctagcttttgtatttttagtagagacatggtcagccaggctggtcatgttggccaggctggtctcgaactcctggcttcaagtcatccactggcctcggcttcttaaagttttgggactgcagacatgagccaccacacctggcctccaccttggcttccttctaacaaatgacactgggacaaggggagaggcaggtggacatgggaggaggatgtgtgatttaatccctaaatgtataattattaaaaagtgatgtcatcaaaaacaaagcatgagaaacagccaggaggagctaagaagacatgctgatgaaagaaacatactgtggtaccctagatgggctcctggaacaaaaggatattagggggaaactaaggaaatatgaataaactatggactttaattaatgtaccaatattgtctcatttgttgtaagaaatataccacactaatgtaagataataataataggggtcttgtgttttaagatgattaatctgccagtcatgtgtagaatggatgcaggaatggggtatatgggaactctctgggatgtgtgtgtgtgtgtgtatgtgtgtgtgtagagatagagtctggctgtgtcactcaacctggagtacagtggtgcaatcacagctcactgcggcctcagactcctgggctcaagcaatcttcctgccttatcatccagagtagctaggactacaggcacacaccaccacacctggctattttttaaataaaactttttgtagagatggagtctttctatgttgcccaggtttgtcttgaacttctggcctcaagtgataaagtctatgttttaaaaaaacaatgttatctacactctcatttgacatgttaaagtcctgtggttggtaatgacagctatcaaatgctaaatgccaccaatgtggcaggcactgttacatacattatcacatttgatcctcagaacaacccatgaggtcagaagcattatccctatttggagaatagggaaattgaggcttagagatttccagcgacacagccttagtcatgtatcaagtaagtgacaaacccaggagttgaacccagggtcttctcattaccctgaaagaatgctggcacatgtcagattgtctgatttgatttttacagtaggaaaaaatggttcccttagctaccacacccttctgtgctacccatttctatcctccagaccacagcaccagtttgggcctttgttacttctcctttgccaaactttgacagcctcttacccagcctctccatctccactctctgcattccagtctattgtatacatggctggcagattaatcatcttaaagcacaacatcctttatattcctcccttccaaaaaccccctaatgcctactgaaaaaaatctgaactacctcctctgccccaacctttccatctttgacttggccctataccagtgtccagtggctctacatcctaatgagaggtgaagccagctgggcttctgggtcaggtggggacttggagaacttttctgtctagctagaggactgtaaacacaccagtcagtgctctgtgtctagctaaaagtttgtaaacgcaccaatcagtactctgtaaaaaagcaccaatcagcgctgtgtgtctagctaaaggtttgtaaatgcaccaatcagcactctataaaaatggaccaatcagcactctgtaaaatagaccaatcagcaggacgtgggtggggccagataagggcataaaagctggccacccgagccagcagtggcaacccactcaggtcccctgccacactgtggaagctttgttctttcgttcttcacaataaatcttgccactgctcactcttagggtccgcactacctttaagaactgtaacactcacagtgagagtctgcggcttcattcttgaagtcagtgagaccaagaacccaccggaaggaaccagttccagacacattttggtgaccatgaagggactattgcctattgccaagtggtgagtaccatcggacccctttcccttgctattctgtcctatttttccttagaatttgggggctaaatactgggcacctattggccagttaaaagtgactagtgcggccactggactaaagacacaggtcaggctttctgggaaagggctctctaacaactcccgactcttcggagttgggaggggtggtttgcctggaaccagcttctgcttttcctgtacttctgggctgagccaagtgtcaacagagaggaaagtcattcagctctggggtcctgacaacaagttggttgaccctgcggccatgagcagaactctcaaagtcatgtcacccaagcgagactcgcccatctatcctatctatcctgacccttgcctactgggtcctaatgcctgtcagacaaacttcctctcctctctcttctccaaggctagtcctgcttctaaaaaccactccttgcctctggtgcttttctagtttctcctataagaatgatttctagtataaacttcaggactctattcccttctttaggcacccagactcaccaaccagaaagacataatttttgcccaaagctccatcatagcggggactacctggaattttaggatccctcctcagacaagcaggcctaacaaaagctattcctgaagctaggatatggggagcctcagaaattttatccttcctattcatataagtgaggacaaaaggcatcactcttccaactctggagttcctgtccctccctcagggtatggccctccacttcatttttggggaaaaacatctttataggacacaagtaaagtcccaatactaacaggagaatgcttaggactctaacagtttttcgagaatgcatcggtaagggccactaaatctgatttttctcggtcctctttgtggtctaggaggacaggcaagggtgcgggttttcgagaatgtgtctgcaagggccactaaatctgaccttccttggtcctccttgtggtctaggaggaaaattagtgtttctgctgctgcatcagtgagtgcaactattctgatcagcagggtccagggactgttgcgggttcttgggcagggggagaaacaaataacccgtgggtggtttttgtctttcagatgggaaacactcaggcatcaacaggcttacccttgaaatgcatcctaagccattgggagcaatttgacctgcaaagcctgaaaaagaggcagctcattttttttctgtactacggtctggccccaatattctctctctggtggggaaaactggccacctgagggaagtataaattacaatactatcctgcagcttagccttttctgtaagagggaaagcaaatggagtgaaataccttatatccaaggtttcttttcattgaaggagaacacacaactatgcaaagcttgcaatttacatctcataggaggacctctcagcttacccccatatcctatcctccctatagctccccttcgtattaatgataagcctcttctaatctcccccacccagaaggaaacaagcaaagaaatctccaaaggaccacaaaaacccctgggctatcagttatgtccccttcaagttgtagggggagaggaatttggcccaacctgggtacatgtccccttctccctctctgatttaaagcagatcaaggcagacctggagaagttttcagatgatcctgataggtacacagatgtcctacagggtctagggcaaacctttaatctcacttggagagatgtcatgctactgttagatcaaaccctggcctttaatgaaaagaatgtggctttagctgcagcctgagagtttggagataactggtaccttagtcaagtaaatgacagaatgacagctgaagaaaggaacaaattccctactggtcagcaagccatccccagtatggatccccactgggatcgtgactcacatcatggggactggagttgtaaacatctgttgacctgtgttctagaaggactaaggagaattaagaaaaagcccatgaattattcaatgatgtccaccataactcaggcaaaggaagaaaatccttctgccttcctcgagtggctatgggagaccttaggaaaatatactcccctgtcacctgactcactagagggtcaattgatcctaaaagataagtttattacccaatcagctgcagatatcaggggaaagctccaaaagtgagccctgggctctgaacaaaatctggagacattattaaacctggcaacctcagtgttctataataggaaccaagaggaacaggctcaaaaggaaaagcgagaccagagaaaggccgcaggcttagtcatggccatcggacaaataaaccttggtgattcagacaggacagaaaatggagcaggccaatcacccagtagggcttgttatctttgtggtttacaggaacactttaaaaaagattgtccaacaaaaaagaagccatcccctcgtccacgtctgctatgtcgaggcaatcactggaaagtgcactgctccagggtgcaatggttctctgggccagaagcccccaaccagatgatccaacaacaggactgagggtgcccggagcaagcaccagctcatgtcatcaccctcactgaggcccgggtatgtttaaccattgagtgccaggaaattaacttcttcctggacactagcgcggccttctcagtgttaatctcctgtcctggacaactgtcttcaaggtccgttaccatccgaggaatcctgggacagtctgtaaccaggtatttcttgcacctcctcagttgtaattgggagactttgctcttttcacatgcctttcttgttatgcctgaaagtcccacgcccttattaggaagggatatattagccaaagctggagctatcatctacatgaatatggggaacaagttacccatttgttgtcctctacttgaggacggaatcaaccctgaagtctgggcattggaaggacaatttggaagggcaaaaaatgcctgcccagtccaaatcaagctagaagatcccaccacttttcctaatcaaaggcaatatcccttaaagcctgaagctcataaaggattacaggatattgttaaacatttaaaagttcaagtcttagtaaggaaatgcagcagtccctgcaacatcccaattctaggagtacaaaaactgaatggtcagtggagactagtgcaagatcttagactcatcaatgaggcagtaattcctctatacccagttgtacccaacccctataccctgctctctcaaataccagaggaagcagaatggttcacagttctggacctcaaggatgccttcttctctattcccctgcactctgactcccagtttctctttgaggatcccacagaccacacatcccaacttacgtggactgtcttgccccaagggtttagggatagccctcatctgtttggtcaggcattggcccaagatctaggccacttctcaagttcaggcactcggtccttcaggatgtggatgatttacttttggctaccggttcagaagcctcatgccagcaggctactctagatctcttgaactttctagctaatcaagggtaaaaggcgtttaggtcgaaggcccagctttgcctacagcaggtcaaatatctaggcctaatcttagccagaggaaccagggccctcagcaaggaacaaatacagcctatactggcttatccttgccctaagacattaaaacagttgcgggggttccttggaagcaccagcttttgccgactatggatccctggatacagcgagatagccaggcccctctatactctaatcaaggagacccagaggacaaatactcatctagtagaatgggaagcaggggcagaaacaggcttcaaaaccttaaggctggccctagtacaagctccagctttaagccttgccacaggacaaaacttctctttatacgtcatggagagagcagggatagctcttggagtccttactcagactcgtgggacaaccccacaaccagtggcatacctaagtaaggaaattgatgtagtagcaaaaggctggcctcaccatttacaggtagttgtggcagtggccgtctcagtgtcagaggctatcaaaataatacaaggaaaagatctcactgtctggactactcatgatgtaaatggcatactaggtgccaaaggaagtttatggctatcagacaaccgtctacttagataccacctgctactccttgagggactggtgcttcaaatatgtacgtgcatggccctcaaccctgccacttttctcccagatgatggggaaccaattgagcatgattgccaacaaattatagtccagacttatgctgcccgagatgatctcttagaagtccccttagctaatcctgaccttaacctatatactgatagaagttcatttgtagaaaatgggatatgaagggcacgttatgccatagttagtgatgtaaccagagttgaaagtaagcctcttcccccaaggaccagcgcccagttagcagaactagtagcacttacctgagccttagaactgggaaagggaaaaagaataaatgtgtatacaaatagcaagtatgcttatctaatcctacatgctcatgctgcaatatggaaagaaagggagttcctaacctctgggggaacccccattaaataccaccaggaaattatggagttattacacgcagtgcaaaaccccaaggaagtggcagtcttacactgccaaagccatcagaaagatgagggagaagaggcagaaggaaaccgtcgggcagatgctaaggccaaaattgctgccaggcagaacctcccattcctgcaaaaaactgggtctttaccaacttaacataccaccctcgttttgaaggaaaagaccctttccgacttctaaatatgcaatcattagccaacttccccatctctgataggaccaagaataccctaacaggacatgcgatacaacttttgcgttcttacatttccaacctcacctattacacaagcaatgaaaagcccatacacagccctgtaactacaaataccatcttaactttccaagcccctttatgcatccaatgcaacctgttatcaggtctgctcctggggcacctactaccacatcagtgtaattacaccatacaacttcaagccccaactgatcatagtaacttccaagtcactcaaacagctccattcagacggcttgtccacgtctcaggggcccccaaaatcatcacctcctccctgcttaacaaacagtccaggttttgtaatggcaaacatactctctgcatgaccattcacccctggaccccctgcagcagtatccccaccactagtgaatgccatctcatcccctctttcaatcgctctctcgaatggttcctagtagatacaaaatggttttttctccaatgggaaaatagaacacagggagccactcagtttgctcccaacacccctttccagccactcatagcagctatcttggcaagtattctaggagtataggaaaatgaaaacaataaactcacacacctttataacatacacaaccagttctgtctacccagccaaggtatattcttcttatgtggaatgttgaactatatctgccaccccactaactggaaggcacctgcaccttagtatttctaagtcccgacattaacatttccccaggaaatcagaccctatcagtacccctcaaagctcaagtctgttagtgcagagccatacaactaatacccctacttatggggttaggaatggctactgctacaggaaccggaatagtcagtttatctacttcattatcctactaccacacactctcaaaggatttctcagacagtttgcaagagataacgaaatctatccttattctacaatcccaaatagactctttggcagcagcgactctccaaaacggccgaggcctagacctcctcactgctgagaaaggaggactgtgcaccttcttaggggaagagtgttgttttcacactaaccattcagggatagtatgatatgccacctggcgtttacaggaaaaggcttccaaaatcagacaatgcctttcaaactcttataccaacctctggagttgggcaacatggcttctcccctttctaggtcccatggcagccatcttactattacttgccttcgggccctgtatttttaaactccttgttaaatttgtttcctctaggatcgaggccatcaagctacagatggtcttaccaatggaaccccaaatgagctcaactaacaacttctaccgaggacccctggaccgacccgctggtcctttcactggcctaaagagttcccctctggaggatactacaactgcagggccccttctttgctcctatccagcaggaagtagctagagcagtcatcacccaattcccaacagcagttggggtgtcctgtttagaggggggattgagaggtgaagccagctgggcttctgggtcagatggggacttggagaaattttctgtctagctagaggattgtaaacacaccaatcagtgctctgtgtctagctaaaggtttgtaaacgcaccaatcagtactctgtaaaaacacagcaaccagcgctctgtgtctacctaaaggtttgtaaatgcaccaatcagcactctgtaaaaatgcaccaatcggtgctctgtgtgtagctaaagttttgtaaatgcaccaattatcactctgtgaaatggaccaatcagcgctctgtaaaatggaccaatcagcaagatgtgggcggggccaaataagtgaatacaagctggccaccagagcggcaagctgctcagcttcccttccatgctgtggaagctttgttcttttgttcttcacaataaatcttgctgctgctcactctttgggtccacactacctttaagaacagtaacactcaacacgagggcccgtggcttcattcttgaagtcagtgagaccaagaacccaccagaaggaatcaattccggacacactattttccaacaagttctccatctggcttctattttaaattcattaaaagtaggataacatcatatggaatgtaaaaaattgccaaaactgagggcaatttatgcaactgctgagattcactccagatcctcagaggaacttgctatgtaatgaaaaaagagatacacaatccatcatcccatcacaggaggcaaaatgaactaacttctaggccagaggagagagtaacaagggagggaaggattcattacaactggaggatcctggaaggcttcctaaaaagggggcatttgagcctaaaaaggggccatttgagcctatcggatgattagcttttggcaaggaaagaagggaaatggcacccatgatttcctgactcccagaaagcccctgtcccagctctgaatgtcccaactgacacattctcccaggccctacttattctctgcacctcccttggtataccccacttttcacaataatcactctttctaccttgcattatagttaattgtgtgcatgccttatttctcttgctaagccataaggtctttgaggaaatggaatccattcacttcatttctgcttccccatccactgagcccagaactggcccatcaccagcctctaatatatgcctggaatgtatggataaatgagtgtgaactgggccagttttaaaaagtgttcagattccttcagacatttatttaataatatgaattaaaacatcaactctgtgtgaggcatttgtgctaagtgttgaggataaaagtggtacacatgggcatgggcctaccctcaagaagccgatcacataaagtggtggcaaacactaaataaatgaataaatatttgttgagttgcaatggtgactatttttaagaaggaaaaatagagaacaatgacagatgaaatgtacctagattcacaaggtgccaggcactgggcactacccacgtgttaactcatttggtccttatcacagtcctaagaggtacaacctttttacagatgagaaaactgagacacaggagagtcaaagaactccccaagactaatagctagtaactagtgtggctagtattatgggagaatttcacaaagggacctaatctagtctgtctacttagggaaggctttcccagggaagtgacatcaagctgaggccagaagggtgaataaaggtgggccaggcaaagaggccactgtggggagtgttttgggtgggaaggcctggaggaggccaagggcttagctaacttgaagaactgaaaggaaagcagtgaagctggtggtgaggtaggcagaggccatgctaagaaatttgtattttatgctaaaaacaatgtacactttaagtagaaaagatgatccgactggagttttgaaaagctcatcctggcagctgtagaggagaatggagggggaccctgtctcacatatttcctatatgtggttaggagacaggatggtgagttgaattgggtattggcagtgcaggtggaggggtgtcagatttgctatatttaggagagagaagcaagagaatttgaaaattggttatggcagctgtgagaaatggagtgttgaagatggtgctccaggattccgacttgggtgcacaggtggctggtggtacatttagtaagatggggaagatggagttcaggtttaaggggaagatgaagactgaagtcctggccgttatgagtttgaagccctatgagccatctacgcggagagagctgtatacgctcttggatgtgtgtttagcggccaggctggggtggagaggtacatgtgggagttgaggcttgtatctgtggacccacagagaagggagccaagccctgccccaaggagccctcatgtttgcaggtcctgcctgcttcaaatgttactggtgataacctacatgtcacatttgacagggcttccaaactaagccatctaagaaaggtcttatgattcatggcttagatcctgtccctgagtaaaaaatcttactgtgagtccttcaaatccttttgtcagttcctcaaactgctgatgtactgattagtatgtaaaatactgacattgaaaagaacactgacttgtttctgaatcatataaactttgattttcttgtgcacaaaacattttagcctgtatgttgtcatctgcagccagtgactgtaacctgtgtaccataccctccgatgaaaaaaatcccacctctgatataaggggtcctcctcccttttcctaaactttcttctaaaacccttccaacgtgtaacaaattttgaaacatgcccaactttgctggtaagtcttcttgggtggatcctcacatttagcttccaataaatcaaattatttctacttcaacagccttaatttccgtggacactggtcagagtatttcctcctgtctttccatcatccacttcctatgagctgttcagaagcagctctctgcagccccaacacccacctacctgcaggcccccctctctctgctggctcccggaacaaggctctgattgggatggcagaggaaagagaaacgggaccagcagcgctactcaggcctcgaaactccacactcactaccgtttccgcgccaccctctcacgcggagctcctggaagggtccagcgctccctctgcaaggcaccgtcggtctacaccgctcgattggccttttatggcactgactgttctttgaagcttttgcagctccttctaacccgatttcaccgtgttggaaatgttgggggtggggcgtaaagggggccatcccatccacagaaagagtcgcttgcagaaatgattttaaaactcccgggtgccaggacgtgaggagaatccggcagggagggacgggagaatttccaaaggtgccgctcagtgggaaaatccctttgtcagagagtggcccgaggggcgcggaatgcagccgcgcccaccccgccccgcgtcaccgcgtcttccggaagctccacgcccctgggtacttggtttccccgcatggttccggaagagcgcggcgcagctggctgtgagcgcagggctatcccggcggccgcttcggcagccagggcggcgcggaggggcagggccagagggaagcgctttgttccgcgcgtggttcccgcgcctgggggtgcgcgggagaggcgcgaatccgagtgccgcgcgcggcccggggacttgcacgggcgtgcggggtggaaccgcaggaagcggagctctcgggttcccgccccgccccgccccgccggcggcggaggcagcgagcgcgagagcccagcggagtcgctgggagcctgaggcaccgagacacaaaggcaggcgggatgcgggagcaggcaaagggaaagcgaaagccgcgcgcccggccggtgactgggtgaaggcgccgcgcagctttcccgacgccggctgtacccggacctcctggtcgagcctggcgcgccgcagccatggccatcgctcaactggccacggagtacgtgttctcggatttcttgctgaaggagcccacggagcccaagttcaaggggctgcgactggagctggctgtggacaagatggtcacgtgcattgcggtggggctgcccctgctgctcatctcgctggccttcgcgcaggagatctcgattggtaagcctcgcccaggacggaggggagtggccgccccggtctggcccggtgagctgcgattttacggctcacaggcccgagtctgggtacgcccagctgtgatggtcgtgagcgtcaggaagggcagtggccccagttttatggtccaaagcgttctttgcccaggtgtttcattggtaccctggtctactctgctcgcatccctactcctcagttcttttgttcctcatgcccctctgatcggactgtggcttatagtttatgttccacccttagaactggcaccttgccaccagatttgccaagaatagctgtgtccccgtttttcacccctgtctcctacatatttgtccagccgcctaaaattttacaccagagaagttcctgagtggctacatggaggatgtgaagaccggtgctccatgagaagtgtgttctttcagtgtcttacatataattggtatttgctgagatcttagctctctagggttgtgaatgataggaaatatctgcacttggcaggcattagagggatcctcaacttggacggtcttacaaatgtgagatgaacaagtccccttcctgtaaattatcatttgagcttcataacagttgtgtgagattggaaagtctggtggtttgggcaggatcacgtggctacgtgccttaccttcctcatcagctgttctgactctccacacaggagagagtgtttatgaaccaacaggaaggtagcgcaggagggttaaatacagttctgtggcaggggaagagagaggacccagtgcggctggactttgggaaaacttttgtcagagggtgggtgggatttggacaagaaggagtaagacctttgttaaggttttgagatggcagagaatgttatatgttcctggaaagagagacacagtgactctcctagccaaggcaggaggataagtcagagttcctggagtctgagagtgaatatgggcctgggtcagcctggaacagaagagtgtaggctgatggtttcagaactgtgaagttattgtttgagcagaggacagactggttgaatgatggtggcatttagggtctgggaagaaggtgagaggatggggcctggagggctgggtgccagagagcaaggcatcggctgaggtcttgtgcacagagggtgtgaagagtggaagaaaatgggtgggtgattgctgtgcgatcaaggagtaaataagcagcacttgagtacctagtatttaataggccatgaacggcagtactggtcaaacgtgctgcggaggttgtatgtctgggtgagtggagtgtggtgttggtggtgatgggaattgtgaagttgagggaatagttgattaggaaagaatgactatgagtgtgattttgcaatctgcagcactaagttgttcagcttggcaggaagttgccaaattcattgtggaaaatagtttttagttttcctgctctttgcgcaggcatagtcatcgggatgttctttaagtttccatttgacagtggattgaggcttccagctgaaagcaaaaccaccaagtagcatgagtcctggagataatctctccctttggtcaattcctccttcagtactggctgtgtgctgaactcggtgctgacctccaaggacccgggagtaaaagaggcatgatccctgtcttggaggtgcaagtcttgggtacctggttgggacagaaaggcaggaggaaggagttagtcaccctctgtgaccaatctccacctctagcacatgtactagagggactcctaaggcacctgtacctgtaatgccttagatacgtctaaattggtgggctgtctgagaggtatttttggggtattgggagtggttttaactagcaagagtttgagctcatgctgtgtgcatagcactgttgtgtgctgagggagatgggaaaggattttgagaccttgttcttgccctgccctctccctgccctgtggcagtttactatgcagttgggcactagaaggtatctgttagcaggtaagtcattcagctgtgtgtaattcagcacccagccaggtgttgagctatgagctccaggctggtgaaggttggcaggcacttgggtgaggagctgtcaagcagactcccatgttttctgaagtgttttcaggagttccaggggaggacagacatgtgggatgaagctaacaggaccagggaagacctattagattaggtatacatttagataaaaccagaagaagggcttttgagaagaggggagaggtacatagattaatacatggagttggtacagtgggagggatcatgtcatgcagcatttaattttgtgtagttagtagtatgcactcagccaaaaacaaaccaaaaaaaagaacagcaataaagggagaatgaagtaattgaaatggagctggcactttgcccaccatattggccagtgaactcaggccccgggaagacactgagataaggcctgcagacttaaaacatggcttcatccttcctctgttgataattactgcttccctctctggtgcttggaatactcttttgttgaacttaacacagagctttataacctgtctatgcatgttttgcatggagattgaaactactctataaacatttgttgtgaattaaaggtgatagcttttggcatcatcagaccttgctaattgattgttatgtgcatgatgctgtaccttggcaatggggtgtcagacacacgtaggacataagaatctttcctctggaagcacggtctagtagagaagttgaacgcataaccctcctaatgcaggattcatggaacctgggcagtgtcagaagtgtgtactaaagcctgatgctgtggaaaggcagaaggaggggtttcttctgactcatgaacagtgagagtttcagggcagagttggcccctgaggcaggattccaagtgtgtggagcagtgttggctgaagctgagacgtgtgagacaacatgtggctgctggagctttagtggcaccgtcacatggagaggtgggagccaaagtaagggtccaggggctccacatgaaagaaggcatagcaaatcccattgttttcctgtttgtgttgggggggtggtgtgtgtgtgtataaaattagaaacgagaaaatcagctgtaattacatgtttttcctttttccacctgtatgataaactagtatatataagaattcatctcttttgatataaaatcccctcaagcgtaaaataaattatattttccagttactttccaaaaattaaattttctgtcaactgttgtttgataaaatagggttcaagttgaaactttgtggcgatttttcctttaaataaatgattttttactttaaagaaaatctattaaatcaagaaatgtgcatggattgtgctttagatttaagagcaggttctctgtgggggtgggagtgttgtaggttagagagagggaatgtcctcatatgataaaatacttggcttcatattaaaggcttccgtttggtctttggccttttctcttagtagttcagcccactgggctcctctcagaaaagagggactgagcctgcctgggccacagagacccatgggcatagcagcaggctgatctttatcaagccctgctgggtgccagcatggtggctgcaggtgaagcgtccactcctcagaggttctggccccttccctcccacagcagttcacgcaggtcctgcatggtaggcactggtgtggggctacctgggctggtggggactgtgttggggacagagagcagaagggactctgccttgctcattcaccagatcttggtctggctgcccacaatcacaggttgagggtcactgcagaagtgatgtggtctggaggggcatggcaaggctggtgccatggtcaaggtggaggcaactttggtagtctttgcggcagccactcattggtccagatgtgccctgtgatagtgagaattacaagcagaaaccctcctgagggagtggcaaggagactcttctgagttgtgcctgggagcattttgaaggcttttggacagtgagatactaaggattgaatgtaagaactaaaatgtgcacctgtctggttaggcctgatacttctagtcagcctttctaaaatactgcaggtgtgcctcctctgagattcagctgggtagggggaaaataagtgacacacagcaaaagacagtttaattgtgagtttgggctagaaaggctgtgtggtgggagccagagaagggagaatcagtggtttcaccagccctcatttttccttcctcttgtcttctaccatgtcttgccctcaacaagtgctccataggaatttagtgaaggaagtgccagagcacactagggaactctcccagagtggctgtgctgagggaatggacggagtgttctggataagggtcccagttgcttggaagtgcgccctctgagtgccatttaatgatacaagtgctgtcctgggtcaggcctgtcctggccacctcccagacacctgcctctgatgatagcagtaaaggatgcacatcgtcatgataggtaagttgtcccacttgatttataagctcaggttatattgcgtgtgcctcagattcttttttatgttatttttgtgatgaggaagaatctgtgttcagagtgcagaatggtgtactgtggaagaaggatgagtgtgatctgtgtggcttgggtaccctatgggtgtcaccttgtgcaagctgctgggagacagtgccttgaggcccttcatttctaacacatctactctcagatgcctctagaagtgctgcacatttcattgatggggggagaggtttaggaaatggctgggcgacagctttgtgtagaatataagcatgattgcatgacgtgaccttcaagctctgaaattctagaagtatttctctaaagttatgaattcccttagtgtgctgcagttatggactgaatgtttgtgtctcccaaccgcaaaattcatatgtcgaagtcctgatccccaatgtgatgctaattggagatccctttgggaggtaattaggtttggatgagattatgagagtgggaccttcatgatgggatgcccttagaaaaagaagaaatccctctttctctcccccctccctcttcctctcccccctccctcttcctccttctctccctctttccctctctctcccactaccccccttcctctcttcttccctcttcctctctccacaagtgcggccacaaggaaaggtgtgtgagcacgctgggagaagggggccatctgcaaactaggaaaagagctctcaccagacaccgaatctgctggtaccttgatcttgaacttcccaggctgtgagaaaataactgttgtttaagccacccagtctgtgggattttcttacagcagcctggttgaagacaaaactatcaacagaccagactctgaatgggattcatgtttaaggggtcttttgacagggcctcctgtgccctgcgcttagggctgtacaaggcctgaggcgtcaggggctgctttgattccctggtgcctcatgtggcacatatcccctgggaaggagagcccgtgtctcctgccaggatgtttctggctggctggaccaggtggggagctggggcagccagtagtctactagggaaagggtgtctggtcagccggggaccctgcctccctcacccactgacctcttagtgggcagccaccgttctgggtagagaaggacttagtctttctgagttagcactgctcttttgctatcattacagggcaggcattgggccagccccagtgagtcaaaggatagatataactgcagctgcttccaatatagtttgcttggagttcccctttcatttcctgcaactgagtcagcggctgggtggcttaagttatctgctctgttgtggctgaatttagacctgtctttgggaatatcttcaggctgctttttagcatgtaccagctggcaaagcagatcgattcttttcagggttgtctatcagagtgggccaatatttagggtctcatggcataggtcctataatagaacatcttcaactcacactaaaccaaagagccaagagagactcctaacccctccagaaggatgcatgctgtccagagagtctactgttggatacatgttttactttgttaatatttttcttgtacaagtagtagctaaatacatcatcatggtaaaggattcataaatctctttcactatgtgctgaaggtaggtggacactttgtgcagccttattgctgtactttgtctgcattagcataacgtgtacaccttattttattttttaaaacaaatcgagtcataccatagtggcttgctttttctcacttagtatgtttggagagctttccgtgccagtacataggtgtcacctcactgttttataatagaacagtattccatagcttagaatatacttacaattcatctaagcagtcccctaatgatggacatttactttctttcaaaatttctactcacacataaagcttgtttgcatgaaaatcttcgtaaatatttctctcctcccagcattaaaaggaaaggagactagtcgcagcagtatcagtttccagaaggatgacatcattttccgaatagttttgcattcctgcgttcctatttgaaataagtggaagaaaaaaaaaaaccactgccctgtacactatccagctctgactccctcaaaatgtgactgcattagaagtttggaagaagcattttgatgtgctcttggttttaagaaagaaagggcctccttcagggggtagaattgcaactttaagtagaacttcatgatacatgttctcctaacactgtaagtttccttcctaacatttaccataacttgaagttaggtaattacttgcatacttatctgttgaatactgtaagttcatttagggcagggaccatgtgtccttaaaacttgatacatatcggccgggcgcggtgactcatgcttgtaatcccagcactttgggaggccgacgtgggcggatcacgaggtcaggagatcgagaccacggtgaaaccctgtctctactaaaaatacaaaaaattagccaggtgtggtggcgggcgcctgtagtcccagctactcaggaggctgaggcaggagaatggcgtgaacccgggaggcggagcttgcagtgagccgagatcgcgccactgcactccagcctgggcgacagagcgagactccgtctcaaaaaaaaagaaaaaaacttgatacatagaagtattaggcagctctcacattgctatgaagaaataccagagactgggttatttttaaagaaaagtttatgtggctcatggttttgtgggctgtacaggaaacctagtggcttctgcttggcttctggggaggcctcgggaaacacagtcatggcggaaggcaaacagggagcaggcacgtcttatatggcaggagcaggagcaagagagaatggggggaggtgctacacatttctagtggctcacacctgtaatcccagcactttgggaggccaaggcgagcggatcatgaggtcaagagatcgagaccatcctggccaacgtgatgaaactccgtctctacttaaaatacaaaaattagctgggtgtggtggcgcatgcctgtagtcccagctacttgggaggctgagacaggagaatcgcttgaacgcgggaggcagaggttgcagtgagctgagatcatgccactgtactccagcctggcgacagagcgagactccttctcaaaatatatagacagatagataaaacctgaaaataggccttaggaccttcatggactctaggtttggattagcaacatccctttaaaaaaccatgcaaacaccttttttctgcagctggttgctttcttggattgcttccttgtcaaacccctaactgaggcagcgagagcttggtccaaagtggagaaagggaggcaatttgggggcatttgccctggctaagctaggaactctgggcgaggcaggccccgctgcatgctgtggggtttctgggggcagcagggagacattagttacttggggagaagggggcctaaagagaatctaccatctgcttggtaccaggcacacctagttctgtggggggtgaaaggggtggtggggaggggacgctgttgttttttaataaattctctataaagctcacactcctttttaaaatataaatatttatatatgtatattatatcattataaagataaaacttactgtagaaaatatggaaaatacagaagagaaaatagcagtacatctataatactaccagggataactactattcttgaaaaaccaaacactaagtcaaggccatgttaccatgttcctaaattgttgtacatgattttttttgttggcagtgacatggaatgttgtgcacgtgtcaaaatttaactgtttcacaagttttgtaatataaatagcattgtgaagaacactcctgtacataataaaccacctctctaaagatctcagtatttcaagtgattgtataattctaattacaaggtcaaagtatacatagacatttttaagatttgactggtgtggttgggttgccctctggatagacccccaatggatacttctccccgcagctgaaggagtggctttccccacagctggcaaaagttagtggattatcgtccacagcttaataggtgaacaaaggtgtgccattgttttaagtcgcatttattcagttacggcattgaatgttttttcgtatgtattttttccatttatataattctgtgaattgtctgttcttatcttttgcttatttttccaaggggatgttggtttctcaatgggttttattaactatttctatgtttcaaatattttctagctagcctttattgtattttcttttccggttgtccgtttcctttgaattctgtttatgttaagcatttttgttttttaatttttaatttttgttggtatgtaaaggtatatattcatggggtatgtgagatattttgacacaggcatacaatgtgtaataatcacatcaggagaaattgggtatccatctcctcaagtatttatccttcgttacaaacaatccagttgtactctttcagttatcttaaaatgtaaaattaaattattattgactacagtcactctattgtgccatcaaatactggatcttattcattctatttttatgcccattaaccatccccatttcccctgacagccatccctcagtaacctttacagtataagttttgataagcagaagttattttaagtcatcaaaactacccatcttttaattatttcttcagttgcattatgattagactgtcatagcccatccttaggtctatcagttttttaaaatgatctttaatgattttatttgaacatttacctctacagtctgttttgttcttttggtgctataagtcaagactctagctgataatccccccattgtcatttattgaggaacccgttcgttattcattgatccttgatgatttcccaatcatatagtcaactcaagtaagtgagcctatttttgggctgtttatattgttccactggtctattaattttcatgaaaataccagaccatccattttgtcactgctttcatactggcttgtttttagatgtgagtagatacctaggtaaattaaagttataaaatattagaatcatgacagggaaactgaagctcagcaatctaagtgagtgacttgcttggcaccaattgtcacatcgccttagcagattaatttctcataatatatcagatatttaaaaggctcttgaattataggaagagcatcattatcagcaggatccttactggaaacttgtcaggctatctcactattggaccttttaaaatattgtagttatgaggaacactattttgatatataataaatatttatttggtctttggtttcccagcactctgctgatgaggtcactgatggcagtggtctcctggatagccttgtgagccaggcttgttgccaagggaaccaactatgtgattagagggttgagactctcagccccaacccctgacctcacgggaggggagagggcctgaagcctgagttgatcactagtggctcatgatctaatcaaccatgcctgcatagaaacccagggagagggttccgagggcatccacgttacatccacgctgggagggttgtgcatcccaactccatggggacagaagctccttcactcaggacccttctgaacctcgctctgtgtatctctttacctgtctgttcatttgtatcctttaaaagatcctttttcgtaaattgccaatagtaagtaaagggtttgccttagtttgtaagtcactctagcaaatgaatgaaccataggaaggggttgtaggaatcctcaatttatagctggttggtcagaagttctattactgctgttcttgtaattgtgggaagctgtaataaataatggatgggctaaatagagtagaaatgctttgaaaaagattacaacttccagatcggttcagaaagtggtgaatatttcagtatgaaggataaataggctatacatggacttggtgcttcagctaatgagacaggcccattcatgggtaccccatggctgtcctggggtgctcactgcatcagccccaggaggtcccctcaccttactgctggtgtggcagtggagggagttttccaggttaattttaatttgccaaatgtctatatatgtcgaagttcagacagtaagaggaaacattaaagccctgcccttttttatggacacacctcaatctcagtttcttccccagaggtaactactgttcctgtttagtgcatattcttttacagtgctcatttttttgcagtttgctcatttatctttaatatgtcccagagatatcttcatgttagtgcatgcagatctgcctcatctttttaaatgtgccacaattttccatcatgtgactatacctcaattcatttaaccgtctgtttatgggctagtatgttcattccactttttcctactacaaacagtggtttaatgaacatccttgcatgtgcttctttgtgcagaatgtgtttctctagagccgtggttctcaaacattttggtcttaggacccctttacacccttaaaatttcttgagaattccaaagagattttgttgtctattggtatttatcatattagaaattaaaactgacagacttaaaaatatttattaattgatttaaagtaaacccattacatgttcaggtataacatatttttatgaaaaataattataaaacaaaaacttagtaataagaatagcattattttctatttttgaaaatctacttaatatttcatttcatagtagatgactggattctggattctcattcattatgttgtaatatcccacatcagtagcccccaaaactgcactgcatacactcatgagagaacgagagtagaaaggtaagtaacaacgtagtatcgtgaacatagttttaatgtcgtgaacctcctgaaaaggtctcaggtttcagggtttccagaccacattttgagaaccgttgttctagtggggtttgaaatcagagggacaaaagttgtgcacattttaaatttaaaagacactttcaactgccttccagaataccagtttacactcccatcaccaatataggccaaccccgccctacttctttaccaatgtttaatactttcagagttttaaatttgccaatcttaatggttaaaatgccatctcattgttttagcttgtagttccctatttacactgggatttcatgagacacacatttctgggctcactgtgacacttggcggtgtctggtgactgccccctccctccccagtgcccacctttttctttggcctgggatgtttgatcctagagagactgacaggtctccgcttgttttccttggcttatgaaataccccttccttctgaaatccatcttaactattttttaattaatttttttaagctaaaatgtttttttcaaaaaaccctagttgtttcacttctgagccctctgtttcctgtttacatttagtcaactagcaaatattatttattaggaaatgtgaataatgattaaggcatgagttataaagccagacttcctgggttccaattctggcatggcacacattgactgtgagaccttggacaagttacagaatttctcagtgcctagcctccttgtcagtaaatggggcagtaatagaattctcacctgtgtcacagggtgagaattaaataaattagcgctcgaagcactggaacggtgtctggtacgtaggaagcactcagcgcaggttagctgctaaacatcccctaatcctgttttggccctttgacaggtgacgacctggggctgctggggttggggaatgtgtctggggcacacagagtggggctagagtgcattgctctttccagagcctgggttctcaggcactgctgtgtgctctctgccccttcctgtcgtgtgtctgcgggacacaggactgcgtggggcaagctcacagcccagctcagaagctgctggtttgtgctgggtctccggctctgctgccctaggattatcttccctaccccttggattcctgctggggagggtgcctagtctgttaagcgccaccaccaacctcaccctcagttcagcactgcagcctcagctggtcattaggaacatgggtgtatggattatagtaccactggggacttgaaaacacaaaacacagctcctcaccctcacctaccaagccctccttgcctttactcataaatttaagtctggacttcccagtctgtcaccccaggatgtcctttatctgaccccagcttgactgtgtgctccagacacagtggtctgcttcctgtcttaaatgggctgtcagctttaaggactcagtgttttcttgcgctgttttccaagcctaggttcccttctctcctcctttgagtacgaacatttgtcatggttcagtcattacccttatgtgatttgttttcatctacaataattggtggtttatatccttggctgcctccactggactgtaagcccttggagggctgagaccaagtcttctttatctttgaatcccttgcattgcatatggtaccatgtacataatagcccagtgaatgctttttgggttaagcgccacacagttgagctgagtgccttagggagaatacctgtgctctgttgccccgtgtagaaacgggaagaatggagccctggggagggcgtgctcctggtataaaggccatgtggcattaaatacccagctctgatgaaaaagtgtggatgtcccttttcttttttgaggttccttgaaaaagtgtttgccactctagcatctgcatctgtcatgagtttttgtctatttagaatgcccttgtttgcaaagagatctcatgaccagttgtctacataatagtaacagtcattgtaagtccttttcatgttgccagagtcactaatctttgtttcagtactgaatttaaacactcaaggccttgtcctacacaaaagggtttctttgtcgcaagaactacaaaatccagcttttaaaaggcatctttgagggagagatgatgcagaaggacttaatgaagttggatctagtttcaggctgtggcccctttaaatctaagatcccagttatccaaggaggcctgctttcatgatgtgtttgctctagtattgtagaggataagacagatgggtaaacaaataaatatgaaattcatgataagtgcatggaagaaagtaatagaggatgcgacaagggagccctccattcttctatctccagtgcttaccatgttgcctgacaaagaaataaaaatactagttcccatttactgaattcttaactgtgtgctggtactatagcagacattttatttaatcctcctgggaattctgtgaggttttactaataagaaaacctcagagaggttaagtaagttgctgggaagtaaaagagaaaaccgaatgtctattgaatctaatagaatcttttttaaagcaacattcaggaataaagactccagagaacctctatttatagaacacttacctaacttttcccctttaagctaaaagtccctcctccatatctttttttttttttctttttgagacagtgtctctctatattgcccagactggagtgtagtgatgggaacacggctcactgcagccttgacctctggggctcaagtgatcctcctgcctcagactcccatgtaggtgggaccacaggcgcacgccaccgtgcctagctaatttttaaattttttgtagagacggggtctcactttattgcccagactgttctcaaactcatggcctcaagcagtcctcccaaagcgctgggattataggggtgacccatggtgcccagtccccctcacccatatctaactggatttctgcttgtttcatgcacattaggcctttgtgtcagtgaagaccagctgaagagtaattttgttctaacccttcttctacttgaagaagtctattaaagctgccccttggccttaaatagtctgttcctttaacatttttctgaagtcaatccctcttcttctccctcccccattttttttccatcattcatttcttacaatgcaaaaaccaagaccaagcacatttcctctagtgaatgtgtgaccagtctggggttgctgcaaggattcacttcccagctctcacatgtcacattcctgttgtgacatttttgatgatgtcgtttttttgatctggccctttccttccatgggtccagcttctgtctccaccaggtgaactccacctggtgcccagtcccctccaccctgtcagcagtctttctgactccacacagagtagccttaggcgctctgggtggggttctcacactccagccattgactgcaggtggctagtcttgtcagctctgtggtttttaatgaacttgggcctagagctcgggaccaggtttctggggagattggtgctggccctttcttgctgctgcttgtgttacgggctggcctggcattccacagtgcccatccttctccactccacccagcctccatggcctgtctgcaccttctctcctccctggccattcatcctcagggtgtcataggtgttggggaaagagtatgaccacacactcagggctgaattgcaacttgaccaagtattagctgtcttactttacttaacctctctgagcctttatttctcctctgtaaaatgggtataatgatagctagctcacaggtttcttttactaggttgaatgagagaatctaattcctgtcttatagtagtattcagtaaataccgtctccccctgattctgtgatggaaaggagctcatatgtctgatcagtacataggggaaatgatatcaacataatatcatatcagtgtaactaatcacattggttatatgtgattttttccaacatgtgaatgatttgtgccatcaagtaacaacatgtggatgaagcaagccaaagaggactatagcgtgtacgtgatgccccgctttccccttggctttgtttgaccatgtgttccatcttagaaatgctgttatacagtactctctgctctttgtgcatttagtccttatatgtgtaacttggcagcctcaacctttctttatacaccccttaattgtgcaagcatgtttttatcaggattctagtgctgttggtttaaaaaaaaattgcatagatttttgagtgatctgccccaaacctatatgctccagaagcactgttattttcgtggctttgcagaacacgtttgtgaacatatcaatagttgtatagcagagatatttggttttcttttcttccttccatctagctttttgcattcatggtcatttcatggaaccacaatctttggcctgtaccaggctgggacctagaagtgatagaagagattccttgcagacatgtgctgtgactgtatcttcataccatctcctgagttattgcaatagattcctgtctggtctctgcttctgttcttgaccccagatagttgttgacatagtgtccagactaaaccgtttaaaacaaaaatcagaaactacctttgctttaagaattctgaaattattttgtgtacagtttgggattgagtaaatgaataactatagatactgttgggagccaggattctcactgtgaaagaagaaagaacaaacatgggatgggggaagatgaagaagaacccagtggtagtggattagaagtaaaagtttccatctcagtttacaattttttataaaagatttcttttctagtttctgctgaagggcctaggaacaatggcatcttagtaacaaggagcacatcgagcacccaaataatggttttaaaatttctttacccaccaaaaggaacccagagctctttgcagaaatggccagttgcagagtggaaacagaaagtagacgacaagcccagaacattttgtaccaggatccatgggactgctcaggaactgaggggaacatgtcgaaggacacaggagctagtttgataggaaccatttgaacatcagagtgaataacagtaatggattataaaatattgaataacaaaggattacgtgagtccatattgatactaaaaaatcaagagaaagctcttcttaatccattgcaactaatacatgtagaaggagcaaatcaagttggaaaaaaaatacttattttgcaaccacatttaaagtatttgattcaccactgggtgaaagtgtgttctgggacacaatattgaccctgtctgcgaggatccctccacagaccacttatcattgcacagggggaaaggcacttttacggcagaagagacctagcaggcagcaccttgactaagtgcccaccatagctgatgtcacccagttatgggggaaaggtcatccaatgctcccagggtgctgtcctgaggacccacagcccttcctcgggattcctgccagcaatgcagaatctggattggagtttggagaaacaatcagacagacccaaaatgaagagcattgcattaaacaggtggtgctcgccacacacattagggtcgcaaatgacagagaaagacagagaaagttccaggataaggtgactacagagataggacaactaatgcaatgtgtagggcaggactggatcctgcttggatgaaaacagttgctataaaggctcgtttgggagatctgactatagataattgcttgtatctggtattttaagaactttagtaattgcactagattatttaaagagaatgtccttgttttagaagacacacacttttgagagtaaagggtcatgatctctgcaactaactcccaagcggttcagaaaagtaaaggatatattatatatgcatagagagagagggtgtatggcagagtgttaacactggttgaatctaagtgctgggtatatcagatttcattgtaatagtcttgtaatcttttggtaggtctgaaaaaattttcaaaataaaatatttaattttaaatagatgaggtaaatagagcaaaatgtcagtattgctttaaactcttaggtgtctgttacattattttctgtatgtttgaaaatctgtatttatcatctgtaatctgatgacaaaagtaaaatatatatatttaaatacatccagtactttcatcttaatataacattgagttcttctgatgccttttttccctggtacccaggtcatgaactttttttccacccaacagtggtgacatttacattggaattatatgggttttttctgtggtttagaccttgtgggtgtgtgagggactggacttggtaacacagggaggaaacccctcaaactgctacttagttttcttgtctgtctattcttgtgggtgtcatcctgtcttcgtggttgcttgtggctgtcatctccagcccagcctccttctcgtttctgttgctgcacttagcgggctgcgttgttcataccgtcattcccaattaaatgagataagcctcgcaggttcccttctgaggcccagcaatgtggtcatttgctctctttggctgtggggttgagtggtcacatcatggaccacgcgtttggcaggtacagactattaattcttccctccatctggtgagggcagtgctgtcttgacagtgccgtgtctgatctgttggactcacaggggcaaaccattcattctaaaatgccccagagttatttgttgatctattcaacagggttggggagggaagcatctggggcttcttgtaattcatttaaaaggaaacatttgatgatgctcagctttagttaaggggcaggtgttagccctgatgtgttctctttaaaagccaggcttagctgtgggaaagaaagacctggtgaaccaatgtggtttaaaggaaaaaaaaaagaagtatttcaattccattttttagtttgggctgcggagggtacttatattttctcactggtttaaaacatgcatgtgcctcagagtcagttcccacagaagaaaagtgaaggcagtaatggacaatttgggacatccagaatatatttaatttcatgtgtttgaagctaaagatgggtttggattgaagtctgctggaaaggtgaaaggagaggaatttggcttgtttttagtaagagaagttattctgagattcttgtaacattattgtattttatgatagttgagaactataagtattgggcaagaatacccttcggggcaaacgtcatttggtcttagtatgttggggtcagaggtactttaaacaaattcagacctgtttcatccttctgagtgcttgttggtgttctgggtttgttttcagagctgaccactgtccatctcttctctataccacacattcagggtcctctttgtatgattgttctcactgagaatttataatagttttcagatcttttggcaaccttaaaatatagccagacctttcaagtctggtgctttatgggttgtaatataatctacttggatcccatatatatggggtatgtgtgtctataatttacattaaggtgaattaaaccaattttttgttgtgtaacttaaaatcatttcgcagacttttaaaatcatgtgtatatgctaatgattgtacttgatataatcatcatcatattctctgttttccctttgagcctccagaacaaccccaggattttctctcctggctccttccttctcatccctccattgctgacctgattttctttaataatttatgcctttcacctcctctttcttgtgtttaaaaggtagagagagctgagttgatatcccagcttcacaacccactagccacaagatcactgtgcctcacacctcactttcctcacctttaaaataggggtgaaagtacacagcaagggttagttcccttctcctgcctaggagcaggatctaaccctgtgttattaatgcatgagaatgaaagaaagcatgttaaaggagaggaacaaaaaaatggggggcgtagatcatagcaaaagtaagccaaagccctcctgctgaagtggaacaagaatggagagccatcccactgtggtgtctttgagaaacctctggcttgctcaccccagccccagtcctatttttctttaggctatgttactttctaatcatttataggtacaggtcaaggctacaccaagggccacctgtgctgctgctcaggcagaaggtgtgaccagcaccctatgctccaggtcaaggcacctggaggagggtggatggggagatgtctgtggcatggattgccacagacattatttaatggatgttgtggctacttcctctgggccttgtgagcacacgttttctcctggtgatctgttattatatttggccagacgtacataaatgtaaagcccacagctgcctctgcactctcagccaagtggaagtagtattctttgttgttcttggcataaacctgaaactcctttctttctttcctgtacagtaataaaaggcagtgcatgtcttgcaaaatctgttccctagaaattatagcacacacttgttaagctgacacacagtggagcagagcatggggctgtggctggggatctcatgggactctgttttctcacctatcaagttggacagtgatatctttgggggatactttaacattaattgagatagtatttatgatagtactttgaaactttcaaagcaccagacagatgttacttggtacacaatcgtgcatgaagttcagagacagaatatgtcttgcctgtaaaaccttgatgtagtactagaggagataagacatatatgtctatgtgacatggttcaaagtggttttctgcacatctctgatttaaagatgtgcagaaaagcactgtgggaagtcagtgggggaggaagctttgtgaagagggtgatgcctaagcagagctttgaaagatgagccattgaggaagatggtgtgtatggggcattgacttaacaagcaggttctggcaagagggcctccgggcagaggggatcatgtaaggcatagatctgagtgcatatcaggcctatacaagccacagccttcattgagttggattggagcattgatttggatttgtaacccaggcagtagggaaccactgaaaaatgttgagccccaggagtggcaagatagaactgagctctaggatgaataacttggcaacagtttaaacaggtggagaagggagagactggaagacttcctgactcagactacttggaaaactcacgaagatctaacgtgtttacctcccaatattatcttgaagagtaaatgagatagaggatgtggaaatacatttgaaaaaatgaatccggatggtccctgtcccaagcttcctggcccccggccccctggcagcagctgatcaccctgaccccttgcctttaggtgccttcaggcagcctgggtgaaggtgtgggctcagagcccagctgtgccggtcccctgtaccctcctgctttgcccccctcttcactcctgctcttcactccctatttgttgcctgcccctccctgcctggctcttgacatccttgacttggtttcccatttctggcctgggaatacccaatacctggggattgatgtgtttctttttctagaaatgcccttgacccttcccaggaagctgtccccttcctggccacttggaggaaccacctacttagaccacacccattccaacaaagccctggtccccaggagctcctccagggtggccttgcaggggtgactggcttagagaggagtgctgagagaaactgggagttggatacagatttaaatgaatgctgctaccattcactagcttgggtaggggattactgaactacttggagctttggtttactccaggggaaaaggaaaataatgatgtgtctctccatttggttgtgaggcttaaatgaggtaatgatttaaagggctggttggtgtctagtgaatatgagttggccactgccttttcttctgactttccattccagatgaagaccatttcttaagagcttcacatgtttctgccctcctctctctattttccttcttcctcttttgcaaaagctttagtataaaaagtgtagttatttctgctccaggagtttctactgctgccttgagggggaggtcctcgagatcccaagatagagcttgaagcactctttcctatagaaagaatgttaataaatgttggatacttgcacaatgaggactttgcctaaggaacattctgggccaggcaggctttcatgaaatcataacagcattattcattttcatgagtgagtacttggacagatattcccaagcaagcagcttatcagcatccttgccagaaaccatctgattgtaacctgaggactatctgtccccttaggtatttactgttgccctcataagccttggtaggtggttggcttaggaagcatttcacactgatgcgggaaccgtgtgagcttagtgccaagtcctgtgctgtcccgactactcatctttttataaaatctaagaacttaagtttaatgggataagacagtcagaagggaccttgaaatatcttacctgtcccccactcatatttaagccattcttgaatggcaagaactaccccattatagaacacttgctgatgtttgtgacttttcatgatgatttcctgtaaagcctcttgctgacaagtcctttcttgatggctgtgggtgcacaggcccctgatggggaagaaatgctcagggctttgccgcataccactcctaccacaagaatatactctcctgaaaacatctccatcacttctctcttgtaccataagcataaaggccactccctccccaggcaaagatgagtgtcgaggccttttatgtgccagggattagggaaatccagctccgtaacttcccactgtccctatcattgctccatagggtgggaagggagaatggtaggcacatcccagtctttaaggcaatatgagaatctacttgttgcttcatctagaaaaatgtaacactaattcagcaacttctgggaaccagacaccctcgcaagtgctgcagcaagttttgttttttgttttttgtgtgtttttttaatttttgtattcaccacaacaaatctgtaatgtggatacactattaatgtcattcctattttagagatcccaggctttgggaaattaatgacttatcagctgtgactcaccctgctgagagtggcagagtcaaatttaaatatgactcatgtcagagcccagtcactgagcacactcccaggctgtgatggatgtggaagagagtgtgcctgtcatggagccttagctctgacccctatgcctgtgacacacacacctttgaatgtgccaggtggggacaggggatcagggctgggccaggcaaggcctagcgccagcccctgtgctactggtgggaaggggaggacacagccctgcctgagccttacgatcctattggtcagtttccctccatggcctgtgtgtgtcaggagcacaaagagtcttccagatggtaggttttacagatgtgacggtagcatctgcagagagatgtaatcttcagtttgcagaggagaaaaccaagtcccagagtcccttcccagaagagcgagtgaacggtagagccccaccaggacccaggtcttcccattccccatctaccgcccatctgctgttgggaggtttgcagtcgtgagcgtttcccttccaaatgtaaaccagttgggctgcagtttcagcctgtttcttctttagtgttacaggaggtaggaaaccactgatttcccatccagtgttctattaccaatgttcccttcagctttctcttcctcaggctaatagttctttgcttctttgttctaaaagaacttgtttttttagtccaattttccgcattcaggtgcctcactgaccctcccacataacctttcctttttctcaatccttactccaaactaaaccaggtctctccacgcttgcctcttgaattctgggctctggttcttttcctgcttcctttttctttgtatggtagttctacttcttttaagaatttttccccaactgaggccaagctgctatcatgaccagtgttggccaaaaccactctgtgatcttttgttttaatatgaacttgggtgtttgtttttagttctgtcctaatgtctccacctcctgtcctggtgctccctaacttagacaaaactaaaaacatgtgagatggggacaagagtccaggtaagctgtgttttcattggaaactatctgttttgcttcttaggtacacagataagctgtttctctccaagttctttctcctggcgtcaggctgcctttgtggattcatattgctgggcggctgttcagcagaagaactcactgcagagcgagtctggaaacctcccactgtggctgcataaggtaaagggagacatttccaaatagaacctgtttgctttatagataaggaaactaaagcccagggaggctatgccaaagaccacacagatattgtagccaaccagtgctgtatctcagattgtaaaactgtagcaccttatagtcaaaaagaacctcagagatgacttggtgtaggcaccatcatttagcacaatggggcaatgggaagtgttctttgagttttagctctataacagcaggcaccttttgtgtcttgacacctttatatcataatgcccagcaggatgtctggcccgtagtaggttcttagtacattttgagtgtctgaatgagcatagctagacagtggcagagctaggattcatgcatagcttctcagctagcaccttttctaccacacacagggtctcttgcagaaagtaaggactgacctagagttcagttgcttctagctgatacgttactggaacatcaaaaagcctagtgatgaggccctctgggggtgttggctgtagcactgtttttggaatggatccctttgctttttgatagatccagatactgcagggaaggggagatactacacaagagacaccaatgtctgggttccactccacttcccatagagaagaggtacattctgtagtcagggaagtggtggtttgtgcatgcaggtggcaggggatgcagtgaggaacttaggcagcagttgataagtttgtgcagaagaatgttctctgagttatgaagtgactgcattaggtcttctctgtgcttctgaaagtaggactttgtttcagcctgtcattaatttcaaccactgtttcttttgtccattgtgaaaacaattagaatgtgtatcttctggtattcttttctgctgaagaaaatatagaattttagctttcgaaaacccaaaagccaaagtttgactctcttctgctttgacctgcttccagacacaccatcagcatccttcttcgtaaaaggaatgatttaagggagctatgactcaggcatgtttgtttatagttgacccttgaacaatgtgggggtcggggcactggtcccctgcacagtcaaaaatttgtgtgtaacatttgacttccccaaaacttaactactgatagcctactgttgactggaagccttaccaataacataaacagtcaattaacacatattttatatgctatatgtattatatactgtattcttacaataagctagagaacagaaaatgttattaagaatattataaggaaaagaaaatatatttactattcagtttgtgcaaacgtaattgtgggttttgccattaaaagtaattgcaaggtgggtgaggtgggcggatcacctgaagtcaggagtttgagaccagcctggccaacatggtaaaaccccgtctctactaaaaatacaaaaattaaccaggcgtggctgggtgcggtggctcatgcctgtaatcccagcactttgggaggccgaggcaagcggatcacttgaggtcaggagttcgagaccagcctggccaacatggtgaaaccccatctccactaaaaatacaaaaattagctgggtgtggtacgggtgcctgtaatcccagctactcgggaggctaaggcaggagaatcgcttgagcccaggaggtggaagttgcagtgagctgacatcgtgccattgcactccagcctggggaacaagagtggaactccatctcaaaaaaaaaaaaaaaaagccaggcatgctggtgcatgcctgtagtctcagttactcgggaggctgaggcaggagaatcacttgaatgcgggaggtagaggttgaagagagcagagatcacaccactgcactccagcatgggcaacagagtgagactccaaaaaataataataataaaataaatatataaaagtaatggcaaaacgcgcaattacttttgctccaacctaatatttattaagtggaagtggaacatcataaaggtcttcatcctcgttgtctttatgttgagtagctcaggaggaggaggaagaggagaggttgttcatgctgtatcaggagcggtagaggcagaagaaaagccccataaaagtgggcccatgtagttcaaattcatgttgttcaagcgtcaactgtactgcttgccattttgcatagtggtgccctatagtgactcttttctccttttaggttgggcttttctctttattttcagccataggtgggttctcgtcagctttgcatggtttagtagccaaggcaacaaataataggacttgcagtgtgaatgaccacagttctaaagtttaacagcttgctttgtaaatccaaatttttactgttgtagtttaagttcgtttgttatagtgttctcatgaaaatagagagttttaatgagtcactgggctgcctttgatggatccgcaggagaattgtctaagagttggcaggggtgttagtaattattttagagcaagaataaactgaaagattttttatccagatgtattttacatttaagggtaagggaactttgagggatctagcctaaaggttataggaccagttactgaccaacacatcagagctcagatcttcagacttctagcccattgctcttctagtcaaggaaggggaaatctggaaacagtataggtagccaaaccttaagttacctggtattaatgagagattaagaaaccctctttctggcagtggaagactgcttgtttgaatggaggtttatctaagtttctcagcagagctcttgccagattcacaaggctggggacagaaattgaagtcaggacctgccacgttggaaggacccttattaacactccttggcatttggttgggactctgaaaggctgttccttgagaataaggggcgatccagaattaatctagctcccatagggacaagagtcctgatttaaatcattgcaatagcagttgaatgacagaga

SEQ ID NO: 185 - DNA, 728 bp, Homo sapiens
aatattccagtgtatgggcttctataataatttacttaataaatattttgctgagtcacagcacagtggctcatgcctgtaatcccagcactttggggattgcaggaagattgcttgagcgcaggaggttcgagtctggccagggtaacgtagcgggaccccatctctacaaaaaaaagagcaggtggcagggggcagtgcttaactcagagggttatgtccctgagggtgaccctgtgggcccaggagaggggccacccccagctccacacctgtgctgtagccgtcctggagttccatgatgaagccgtgggcattggccttctgtgcggcctccaccaccatctcgaaaggcacagtgggcaggccgtaggagatgttatccgtgatggagcgggcgaacagcacgggctcctggctcaccagggagatctggggaggagggagcatggagcatgagaggccaggaatgtgttcatccagctgtccccagcagccttgctgcctggggcctggagacaccagcagtctcaggcctgaaacctgatcagggcccagtgactgcactgagctgcctctcttcttccccaacagtgactcccgcctgtacccacaagccctcagcctcccctaatcagcaaactggggcctgctacatttgctgctctgggataagccaagttccctgacctctaagagaaagctcactggccatccctgtcctgaaa
